United States Patent 10,407,724 (METHODS AND COMPOSITIONS FOR SCREENING AND TREATING DEVELOPMENTAL DISORDERS) - sequence listing, part 93

SEQ ID NO: 2702 - DNA, 36655 bp, Homo sapiens
aatgggagacgtaaaaggtgagtgcctctgaaaccggggtgttctgaaatagctgtgcacctcaaaccctaattttgtttttgtttgtttgtttttgagacagggtcttgctttgttgcccgggctagggtgcagtggtgcaatcatggctcactgcagcctcggccttctgggctcaagtgatcctcctgcctcagcctcctgagtatttgggactacaggtgtgtgccaccacagccagctactttttaagtttttttgtagagacattgtctcactatgttgcccaggctggtctcaaactcctgggctcaagccattctcctgccttagcctcccaaagtgctgggattacaggtgtgagctaccatgcccagcctcacactctagaaaattttttacatgccaggatattcagaatattgggggatattggcatgttaggaaatctagtatgtagggggagggcctggaaggtcaggaaatctagaatatggtggtgttttgtaatgctcacagatctagaatattagagtcatttttttttccaggccggagaatccagaacgctcgtgttgctgaaatgctggtcattctattcttatttcatgtttaaatttttattattttctttatttcttttttttgagacagggtctttctctgttgcccgggttggagtgcagtggtgtgatctcagctcacctcaacctctgcctcccgggttcaagtgatcctcccaccttagcctcttgagtagccgggattacaggcgtgcgccaccatgcctggataatttttgtattcttagtagagacagggtttcactgtgttggccaggctggcctgaaactcctgacctcaagtgatctgccctcccacctcggcctcccaaagtgctgggattacagacgtgagccggccttattctgggggagggggtggggggggagagagagagagggagagagagaggagaatttgggatgttagcaaatctagaacactgaagagctgggttttttaaatgctagagatagtattatcctagtatagtattaactctgtgtgtttttgtgcgtgagagggcatggggggaggggtggaagattctggaatgcggggggactagaactctgagggattctgaagggttgagatgagttaggattcaagaggtgacatagacacgatcctgggagatagtgacactgatgggagggatggggagctggggactccaaattctagggggaggggaggctaacgccggaagttgcagtggtgagccagaggatgttgcctagcaacaagcattgaagatgcgctggatcccggacagaagggagaaatttcagcagcgcccccagcaaatgctccagccacagggtaggaggtggtgaggggggaagcgggtagggatatgctgtcctgcagggtcatgtgagcaggggtcttgggggttatacaaaaacagggtcatggagtacagtcatggggcagagccgggctctgggacagcccacgaatagctgtgaatggagtgtgagtgccgtcgtcacctgccccagggactgtgtgtccctggacggtgctggacccagatttctgggtgtcagtgtgggatggaggcatggattgctgtaggtggcagtaatggtgtgtagccgtgtgagtcagcctgtgtgtctcacagtgagcgggggtgaagggcttccccgtcagtcctgcacaccctcctggattggaagaaggagcaggagtggggggtggggggtgcaactggatcagttgccattcttggtctggggtgggctctgtggtcacggcgtgtggcctagtaccctgtgtgggtggagcctgggatccacgaggtgggggcggggctaacgctacagaactgggaagcttaagaatccaactgctttgggatatggggcctggaaccccaaagcgaagcaaacatgaaaggggtgggcttgggatcctacatgtggtcacgtcccagttttctgtgggaaagggtgtggcctgaaactctggaaaaagaggtgattaggggcagagtgaagctctgagggtggtgccttagggagagaaggggcttgtatttcagagaatatagggtggagccttgaatttataatgatcttctcaaagaattgatcccttctcaaggccctaggcttcaggggttccaggctcaccatctgcaaaagcttgctccccgaagctctgtccctcagtgaacccagccaggctctgcccctgacccacaggatctgctcccagggggtcctgggggctcctggctctgccccctcctgcacctcacttattgccatccccagagggtatcagacccccttccttgcctgagtctttgaatgctcccaagagctttgagtctcaagctgggcttgagaccctgagtttgaaggcttgaagcctggaaccccggtgtggacggggtttaagggcccctgtggcttgcagctcctagtggtggagactcttaggcaaggaagggatcggtactctcttttatatagttttatgtatttatttattattgagatagggtctcactctatcgtccaggctggagtgcagtgcagtgcagtggtgccatctcaactcactgcagcctccacttaccaggctcaagtgatcctcctacctcatcctcccgagtagctgggactactggctcatgccaccatacccggctaatttttggatttttttttttttttttttttttttttttttttgagacagagtcttgctctgtcgcccaggctagagtgcagtggtgtgatcttggctcactgcaacctccacctcctgggttcaaacgattctcctgcctcagcctcccgagtcgctgggattacaggcgcccaccactgcacccagctaatttttgtattttttagtagagatggggtttcaccatcttggccaggctggtctcgaactcctgacctcatgatccacccgcctcggcctcccaaagtgctgggattacaggcatgagccaccgcgcccggcctaatttttggatttttaatagagatggggtcctatgttgtactatgttgctcaggctcacctcaaactcctggactcaagcgatccacctcggccttccaaagtgctgggattacaggcccgcgccagggcacctagccggaactgggaactctctaaggagaaagtctgcaattctgggtggtgggaggctgctcttgggagcattcaaagactcaggcaaggaagggggtctgataccctctgggggcggcgataagtggggtgcaggagggggcagagccaggagcaccctgggagcagagtttgtggatcaggggcagagcctggctgggttcactgagggacagagcttcggggagcaagcttttgcagatggtgagcctggaatccctgaagcccagggtcttgagaagagatcaattctttgagaagatccaatgtgaacttgggaccctcagaggggcaggacctgggggctggtgcagggttggtgctccatttgcagaatcctcagtctctctcgtggaaaggggtacccgtggggggcttccagcttctacgccagcgagggagctaaattctgaccgaattctcccagaactgggagcagagagctgaggactgccagatggagtccagcttaggggaccctgcccccaaccccgctcccgtatccctcccatttttaagcacccctacgcctgggacctctgttccacgagaaggttcacggagccagtatccgagtcctaatttccccccaccgcgtggggaactcgaggtcccccgcgcccctagtccggcacctgtccctgctgcctcctgattggccgcgcggcgagcgctggcggcgccgggctgtgattggcgggaagttcgcagcccgtggctggactgtggagaaagtgagtcggcctcgggcgggggcgggggcgggggcaggggcggggccggggctagcctgacccgctggacagaccgcccgcccggagcgggactcggcgcccgacacgatgccgaggcctggcaccagcggccgccgccccctcctgctggtgctgttgctgccgctcttcgcagccgccacctccgccgccagccccagccccagccccagccaggtcgtcgaggtcccgggggtccccagccgcccggccaggtaagccccctgcttccttgtgccccttccacccaataagtctggtggtccaggaggaccacggctttcggattcaggggaaactcgaacccactgcttcgatgtggagatgcaaagagggcccttggatttattaggcgccctcaatttgtaggggttagattcggggagtactgagatttttaggggaaagagtcccctttattgtggtggagaaggctaagtctccagagaatcctggggttagttcggggaaaggtctctagtttattggggcagggggtggggggctgagctctcctagaatgatagagacgtgtggggtcttcgagctaggatggagcgccccaagtttcttgggcgcgtaaggaggaaaggtgttgggggattctggagggactttatgaggccgctgagttgtcctggttttctaggatttgggggctctgtgttcatgaaaagcgacctttgggtttttcgaattggtcaggaagacatagactcttgcgttgatggtggaggggcttgtggggagtggggtcgggtgggggagtcctcaggcttcagaacggttggggatgctcaagtttcctagaattagaggactctgggattgaatgaggctccagtgatttcaccgcgagagatccaggattccctatagatctgggggctataggcgcccttcctgtctgcgggtgacgggactgaaggaagccgtctgcccagcacccccacccaccctccccgcctggcggcccagcgctccgttacaaaggccccgggctcctctcccgcctgggtctctgcgaatgcgtttagtaacccgagccgcggcgggggcggggccgggaaggggttaacctggagaaaaggcgggagggatgacggcaagatcggggatccccgaggctccccaccagatggcctcatcctccactcggccccacccacctgagaggggcccacgcgctggacacccccctctctgcacccccccactgctctcctctcggggtctgggcgcgcgccctcgtctctagacccccttagcctggggataatggacttgtctggggggccccttcattgcgacgcacttgaaccggagctggaagctccgccactgagaccctctgggctgggagatgtctgcaagaacggcacctttctcctggtcaggcgggaaactgaggcccaaagaccaagaaacgctggcttctggacacacatcgtggaagggcaagaacgggctagaactcaggctctgggattctcagtcctggactgtgactcccgttatccccctccacctcagcaccctgctggacccacagtcagagggaagagccttccctccccagctgccgaggcctgtgaaaatggcgccacctgtcggccaggctcaggatggcgtctgagtcccggaccgggatgtgcgggagggcggggttctagattcccagacagtgcgggcttagaaatgctcttagaaatcgagtcttttgtttttgtttttgttttttaatcacttttaaaaggctttaaaataacgtattttttcaataaaatcgtacgccaaaatctcttcataagacaaaagtacggtttctgtgcccttcagcccgaagtctaagccaatttgcctcccattgtacagatggagaaactgaggcgtggggagaagaacctcgttagtcatatacctgtttcaagccccctcaggatgcgtcttggtttcccctccccgattgccctcctttgcagagttctggggtgctaggggcctgagtgacttccactccactatttatagcgttgctgtttgtcgctgctgcccgggccagacgtctaggaggagccgctgcatccgaggtgggttctggaagatggagtatgagtagggggcaaaagggaataggaggagaggggcagggagctccccatccctcccctcatcccagtgggagagctggatgcatttggtagagaagtacttggtcccctccttccccacttagtccctggctgtctccgaagccttctgcagggtccgaagctgccagcccaaaaagtgtgcaggcccccagcggtgcctgaacccagtgcctgcagtgcccagtcccagccccagcgtgaggaagagacaggtgtccctcaactggcagccactgacgtgagtgggcagtccctcccctaccaaatcctccctcaggaactcctagctttgcccccgtttccgctcctcctcccttcccctctccctctctctcccccctccctccccggctctttcttttgctatcagcctgtctgtccgtttctatttcatcccttgcctgcctatctcaggctcttcccatctctgcattatttctgtctctttctgtttctttctagttacctgtctcttttcctctctctctttctccctgtgtctcactgcctgcctctatgtctaagtctctctgccccttctctctttctctcccccaacccccatcatctctctttctctcagggtctttgtttctctcccactagaggcctggtccccataaataggtgttgtggggggagggttgggcagagccgctactgaaagacattttcctggcatggaggccctttggtggggaggtcagtttaacccggtgacagcagcttttccgtcctctcccacccaggctccaggaggccagagctctactgaagcggcggcggccccgggggccagggggccggggactactgagaaggaggcccccacagcgtgcccccgctggcaaggccccgggtaagcacatccgcctttcctccgcctggggcgaggggggttccgggccagataaagccgtctggttcccacggtccagccgccgcctacccgccccccgttgtagctcagcacccacccccaggacgaggccccctctagggaccccagcgtccggccgtgcgaggtgagcccgggacaggaccagacacaggccagaggcactgacccgcgggggtggggccgggaagccaggcgtccgggctccccgcggccgaagagggagggcgctggcccgttagaaagctccgccgaaccagcccagacaacaaaagcgattgtgcgggttggcgcctgcctgggcaccaaatgctcaagattgtggggcggctgggggccaaaggcctcctcctgtttcccgaatcttccccctgccctcctcccgctccagctcttgacccctagtctagaacacccctcatctcaaacaccctcaaaaccctcctcttgctgtagccttcagcccagatgtgacccctccccctaaagtcttccagatgtgagcctcgggccagatgttagtacccccgcccacagcctccctttatccattgtgacttctcccgccaggtgtggcgttctggccagatgtggctacatcttcacatgtatcccccccacctccagcctcctgcccaggatctagacgcccaattcctttatgtgcccaggtgtagcgacccttctcccatccctcagatgtcccacctggctgtccagatgtaccatgatagccccctatcaagatgaagcccctttctctgtgccccgggcagaagaggatcaactcttagctgtctccccaaatgtggcccccactactcttaatggatttcctctttatggattcagctctgtctggggggaaacccgcccgcccccacctgttcccttccccgccgctcccctacaggcccggtccacttgttggtgcgcggatggggacagagggggcgccccgctcacccctgcgagtctagcgcccagcctgcgagcctctggctaagcgcccagccccacgcgcccccgcgcggccgccggggagggagtggtgaggagggggggcctgagcgggggcgcgggcgacctcccccgcgggcgggcgggcgggtgcggccgggcccctcgggcgggctggggcggcggcgcggcggagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgcctgtgagtgcggggtggtggtcccgagagagcggctccgggggggaggaggatccctggggatggaggagacagtcctccagggagagggagcccagattccatatgcaatagtgcaagggaatatcaggggctatttgaggaagggggccccaaattcctggcttttggggttgggtcctgagggttccgattttgcaagcaatgagggttcttagaggcctgtgatgtcccacgtgagggaattggcgccagctttcatgctttgcgtcaaaatggggatctcagaattgaggggcctgagaacttttgggaggggggctcgaattctgagacgctgagtaaggagtccccggggaccaagcaagagtctcaggaccgcatgggggacgtctcagtttctgtgtgtttgggtgggaaggttctgtatgggaatgcctgtgaggtggggtactagagagaagaaagttaatccgaagaactaagagggagaggggacagagacgggggttgtgtgtgtgtgtgtgtgtgtgtgtgtgtgtgtgtgtggcggcgggggtggggtgggggtgtctccgcaggacctgagttgcaggggtcccacgtgcgacagaaatccagataagagggcttacggaaggggcgccccctgggggcggaggggacaggaggtgtatgcaccaggcactcctagagatggggagccttgggggttcaggtgaggtgggggagggcgcaccacctgttgttccaggatgcaaaagtgggcagactctctgggatcgggccttcctgccccctaccccgcagaccctatggagtggggagtgggggcccctggagcggagaactcgcccagcctggcccccagccagcccagcccggccggcgtgagctcatctcccgcctgagcccccgcccgctgccactccctctctcctccccttcctccctctttctttcactctttcccggcccagccccaacgtgcctgtgccaggcgccatgcccaggcgggtgccaagcccttgggggtgcaaggagtggcatgtgaagtgggggctgacctcaaagggacccctatgtcctcaactccccgcttggccagggctgtggggcatgacgttggctgtggccatctagtggcccaccctgggtgtaggcacccccagggagctggcctgcgggcctgcattcaggccaagagaaggcagagaaatgcctctggagcctgggaaataccctcagacctggctggtttcccaccccctccatcagagacccttaccattctgcaattttgattcctagttaagcctctcctaggccccactactcaattaaaagcccccattagaccaccctggagtcatggccccacactcctacctaagggagctgagtttttgctccaggccctagacccgctctccaaccatggcaacagactttagagaccactcctccagtgaaattccctctcattcttccctcccacctcccaaactgtgcctttccccagataactctgtagtattgtccagaagtcctgttcttctagctcacccccttccccaggaacttctgatcccatttatcttcagagaaccccagggttggtcttgataagtgggttctcgcaagaggactccagacattgtgctccttacaggcagccattaataaaaagcctttggcacttaatccttagctgggaggggaggggattccacagagggactcggccaattgagcctcttaagtgctgatgacttccaggaattccacttcactatctaaaccctgttttcagcaccgtcaaactggttgtctcctaggcggcactagagtcctgttttctaggtaactgtccacaaaaggactcctgctgaaaggacgcctcagtttcctctgagctaggttcctccatcccagaaacctccagccgtctttgaactcgagaggactgccctttagtcgatctcctcccaggactccagtccctttatccttctaaacggaggtggctctctgcgtcctttcctctctacagttgtggctcagaatcccacacgcgcctcccccggccgcctgcctcctccctcccctccgcacagctgtctccagctgttctctgcagccccgggagagagagggagggggtgccctcgcaggacagcccggcctcctttggctcaaaggtcccggggctccccaagggtccggaatgtggagcctccgccctgcccccgccgcacctctctctttgtttaccccgccgcacagctggcagtgccccgcccagaggtggcctggggcccagcgagggcgcgcagaggggagtggaggcgcgttcccgctcgtggctccgccccggtgctactggaggctgtaaggccgagctagaactctaaagccccagccagaaagaagttgggcggagacacagcgcggtgggcggaactagggcacccggacagcctggaggtggggtgggaggggcgtgaacaagtgagccgggcgaatcagagtgcggaaaggaaggtgggaggggctagaggcagcaggttaagctcctggataggcggggtttagaatcccgcgggtagaaggtaatgtgagaggggctacaaagggggcacagccagggggcggaggtaggacttcgtggaccaagcagagggagtgtgggcgggcatagaatgcgaaggagacagagttgggcggggagttatgccagggagtggttaaaatgtggtttgagtcaatggaagggatcagcattgggtcggaggggctggaacagcaaagggttccgtcggactacggaatgggcggggtcagcgccgtctgggctggtctggaactccgtggactcagccagaaattgggatccgagaggttgacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggtgaggaaagggtggccagagtcccctccgacccctgtcaagcatttcactttgcccctgaccctcatatttcccgccttcccgagcacctttgcccagctcgccctccccgccttgtctagccccaccccgtaagaacccgtgtagacatccgtttgcccggccgtgcctcccctaggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaagtgagaggaggcccgtggggaggggcccggagcttgcctccgcgcgggggcgcgctcacccaacacttccccgcagtgcgcgtccccgctgcccgggctccggacgcaggaggtctgctgccgaggggccggcttggcctggggcgttcacgactgtcagctgtgctccgagcgcctgggtaagccccaggacgtccccgaagtgctcggagctggggagtggtgacaacctcaccgttcctcctactctgccctagataaacccagttcacaaattgtagccacgcctaccccattgtggaggcgacttccagtcctgagcttttcataccgctctgggaccacccaccccattttctgactttggccactctgttctcaccctgcctttgtgccttggccccccaccatatactttgggagtctccaatgttgccatttcaactgccaacctaaggctgtccctgcacttaaactacagccaacatcttttagtccctcccaccccgtcttcgtctctgcccactccattctcgctctgcccacctgtccctggcccacccctctcctctcgccacagggaactccgaaagagtgagcgccccagatggaccttgtccaaccggctttgaaagagttaatgggtcctgcgaaggtgcaacggggcaggggtgggaggggcttggttctgggggcgggatttgcagggatcaagttcctgactccacggtgacctccccaaccctggcagatgtggatgagtgcgcgactggcgggcgctgccagcacggcgagtgtgcaaacacgcgcggcgggtacacgtgtgtgtgccccgacggctttctgctcgactcgtcccgcagcagctgcatctgtgagcaaccagcagggagctgaggctgggtcccgccctccctgccctcagaagtcccagagcatcctggggcctttaattccctcggacccccccagactcccgggttcctctgtcagccttagagccccctcagaacttctcagattcttatacagcttcagcatccctggaccacctttagacctttcaagccttttggatccagatccctccagactcccagacttttttttttggagatggagtctcgctctgtcgcccaggctggagtgcagtggcgcgatctcggctcactgcaatctctgcctcctggtttcaagtgattctcctgcctcggcctcccgagtagctagaactacaggcgggcaccaccatgcccggctaaatttttttgtatttttggtagagacagggtttcgccacgttggccaggctggcctcaaacccctggcttcaagtgatctgcccacctcagcctcccaaagtgctgggattacaggcgtaagccactgcgcccagctctcccagactttctggaatccttctcagacccccaaatcctctcgtccccctcaacgactcgactatcttcagatcttgagatccttctcagagtctctcattcaccactgacaccccattgaggctccaagcccttctcagacctccagagcccactgctctccttcagaccctctcagacctctcccaaatgcccctcgcacccaccaaccccccacccccaaccccagaaccattcccctctctcccaaatccctcagtgctacagcattcccagccccgccctgaaggatttcctccctgctcctcgcagcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcaggtgagcccctgcggcagtgcctagccctacgcgcaacacatgtggcgctcattctacgccccaccctccaaccctgagttcactgccccaacctgactggctgggctccagccttggccacgcagcagcctctgagacccgcaggcctcagactggacagcatccatggctccacctccatctgtagccacagccacccctccattcgtagccacagctaccccggagctcccaagttagtttttgtctcctgagcgtcaacgcccagtcccaccctgtccctgaactttgaccaagtccttggcttctgagacactgccttcagcttagccccaccccaggcatgcccctccctgagacacctccctggcattctatcttctgcttaaaactaaatctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctgggctggccatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggtgagctggctctggcagaagtgggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactgggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggagtcacagttgggctcttctgtgtcaatcgagcaagccatttaacctctgagactcagttttctcattggtaaaatggggatggttgttgagatgcctctgaagtgtctgacacctagtaagtgctcagataaatacttatggtagataattatttttcattatctaatattagataattatttctcaggtagggcactaagaatgtatctcaggcggagggttggagagcaaactattcaaagccagagaccttggggtggcatgatgaggggattcggccaaggatctgatgagaacgttccaggataaaaaagatggagatcagaagaagactgggcttgcttggggaggagacatccatgaaggtgttttatggatgtctccgggggtgggggttttactgggatgaaaggaacggaggattcagagatgggggaaccctggctgactggaccccccaggtccctcctccggcatgtgtcagcgcaacccccaggtctgcggcccaggacgctgcatttcccggcccagcggctacacctgcgcttgcgactctggcttccggctcagcccccagggcacccgatgcattggtgagcaagacggagggcgcggaaggaggcggggcggggggctttgcctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccaccccagggtctcgctcctgctctcactccagagcctctccagccctcccacgcttcccctctcgggtcccgccccaggactgctctgccctggcccttggccctgcccttccctgacccgcctccacccagctccagcctccctttgaccccacccctacccagctcccaaactgccagtttctatcggggcctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccctatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccaccgcgtgccgccgccgtgtgacctcgggcgctgcgagaacacgccaggcagcttcctgtgcgtgtgccccgccgggtaccaggctgcaccgcacggagccagctgccagggtgagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacagaaaggctgagtcatgaaagatggagaagcagaatgaggagggatggagatgtcagtaatcgggtaaggggagcagagttatggaggaaaggggagaaggaggccttctcatggggactacagagacagaaccagccaggcagcttagtagggattggtggaggatgcagagtcagatgatggtgacaaggaggaatagagatggggtcacggggacagaatgttggagggtggaaagccaaagtgacagaggtcagggaggcagaggggaacaagtgaccccgggccccctgccctgtgcagatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaggtgagggtgctgagcccagccctactccatcactgtttgctgtggagactggagagagattattgaggggcagagaggcagagtgatggggctcagggatggagaacaggggctgagggatggggacctcactccagagtcttctctcctttcaacaaaataaggcagtcctccccacccctcctccctttttgaaagatactcttgtgcttatgggaaccctgaggagggggtcacctgaggcagggcaggcaacatggagttggtgccttagcccccaccttagtagctggagagaccattgaatggggacacgaggaaggtgtctgtcttcctgggaagagggagcagcctgaggcaagtccagaaggcaggctcaagactggaatgctggggtgggtggtgatggccatgggaatggattcaggccccttcctcagcctcattggtcccctctgccccagatgtggatgagtgtgcccgaagccccccaccctgcacctacggccggtgtgagaacacagaaggcagcttccagtgtgtctgccccatgggcttccaacccaacactgctggctccgagtgcgagggtgaggccggggagggagggaggagtgtggatgggtgaggggggagttggaccacttcttcaaggccaccctctcccctgccccccagatgtggatgagtgtgagaaccacctcgcatgccctgggcaggagtgtgtgaactcgcccggctccttccagtgcaggacctgtccttctggccaccacctgcaccgtggcagatgcactggtgagaccaggccctggctgtgaccttgggcctgcatcatgacccccgacccttgacccagatcacaactatgacctggccgtaacctcctgacctggacctcagtccctcagtccccagagcctgtgactcctgaccctgacctggaccacaactcttgaccctgaatgtgactcctgagacccaacttgacagtaacatttgaccctaaccatcacccttgatgatagtccctgcccataccctgatagcaattgtgaccctcatgactctggccctgaatgtgacctataactcctgaatttgactgtgacatttgaccctaatcataaccactaaccatagcactgaccataaccttgactgtgtgactcttggtcctatctctttcacagcccctgcctcttctcagaatcccttctctggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttgatttctgatccctgtctgatccctctcctgactccaaaatcctggcacaggtagttcctagaaacctagacccacaggacttgcaaccatggtccccggaacccgagaaccttggtcagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtggtccccacggccactgcactaacaccgaaggctccttccgctgcagctgcgcgccaggctaccgggcgccgtcgggtcggcccgggccctgcgcaggtgagcagcatagggacccgccagagagtctgggagtagggcctgggttccagggcaaagccggctggaaaggtggaggcgggaccaaggcgctgtgggaggagcttagaaacctggcattggtgggggcggggttactgcgatgtgggcggagcttgtctgggaggccgggtcccgtgactccgcccaatctcccgcgtaccctagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccaactctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcgctagcgcttgcaacgcggtgctggaggctgctcccttggggactgaggaggggcgccctgcttcccagacttaggcggagggaaagaacaccctctcaccgtatctctgtagtggaaataagccgccaccgtgtccatgtattttcttgtgtcaggatcacggccaagcctcccttccagccgcagtccattccccctctgcagctgaagcccggtccacattttaggctatgcccccagtaagacaccgccccaaaactgttaggccccgccccttccaatcggcctctggattaaaaccccctcttcaggccccttctcttcctaacagaagtttggacgtgccctttccgcgccctccaccagtcctacttccagccttccctccaaagaggcccaatcccggtggccctaggccccattctttcccaatgagaaattcccaaggtgaaattctcctagcattggcccccgcccgtttaagctctgcccttccttggtctctctagacagggctttccattcgctcggatggctccagtctctcgaacacttaggccctcccttcctatctttgctccgcccacagacccgccccttgccttttcttactttccaggccttccctcccgccccgctctttcacccctcccgggtcaggctccagcgaggcaggagggtggggctaatcttccatacagtatatatttttttgtgtcggcgggggggggggggcggtgatggtgtgtgagtccgcatcttgtggaacacatgaaacaaaacatctgtgggctgccgttgactctgctagacctctgactcatggaaatctagcttcataagatctcattcattaattccacaagaattcactaagcacctactctatgccagcgtctggaaaaggtaataagagcaacaggaaataagtcatataaaaacccctgccttcctggagttattgtggggtaataaatatgtaaataaattcaagatttatacagcaggccaggagctgtggctcatgcctgtaatcccagcactttgggaggccaaggcggatggatcacgaggtcaggagatcgagactagcctggccaacatggtgaaaccccgtctctactaaaaatacaaaaattagctgggcatggtggcatgcgcctgtagtcccagctactcaggagactgaggcaggatactcgcttgaacccgggaggcggaggtggcagttgagccgagatcgcgccactgcactgcagcctcggcgacagagtgagattgtctcaaaaaaaaaatttatacaacaaaaaactggggggcaccttactatatgttgggcactggagatgtagcaaggaacaaaatagacacaaatccctgctattgtagagtttgtattctagagaggcgacagttggcataccaataaatacatacgtataacatcaggtttaggaaggaaaacaaagcaagacaaatgggacagagatgacagagcagtggatggaggagtgctaggagggcttgacctagacaccagacagaagcgagggaggcagccatgcagagagctgaggggagactgttcctggcagagggaagagccagtgcaaaggctctgaggcaggaccatgcttttgagaaatggcagtgaggacttgagagttatcaactatgctaggtgtggtggcacaagcttgtaatcccagctactcaggaggctaaggtgggagaactgcctgaacccgggaggttgaagctccagtgagccatgatcctgtcactacactccagcctgagcaacagagcaagaccccatttaaaaaaaagaaaaaaaagctggatggggtggctcatgcctataatcccagcactttggaaggctgaggcagctagattgcctgaggtcagaagttcatcaccagcctggccaatatgatgaaaccccatctctactaaagaaaaaaaaaaaagatagtggctgggcgtggtggctcacacctgtaatcctaggacttgaggaggccgaggtggacagatcgcttgaggtcaggagttcgagaccattctggtcaacatggtgaaatctcatctctactaaaaatacaaaaattagctaggcatgatggtgcatgcctgtagtcccagctgctctagaagctgaggtagaattgcttgaacctaggaggcaaaagttgcagtgagctgagattgagccactgcactccagcctgagtgaaagagcgagactccgtctcaaagaaaaaacaaagttttcaacattgttgatcttcagaagctcaggctcctagaataccagattgctaaagacttcttagtcttgggcaccggaagtggtgttagaacttctgaattcaggcctttgactcccctttcatctcctccacactctgcagatgtggatgagtgccaagaatatggtcccgagatttgtggagcccagcgttgtgagaacacccctggctcctaccgctgcacaccagcctgtgaccctggctatcagcccacgccagggggcggatgccagggtgggtgtccatcaggcatcgggtgagatgtggagatggtagaaggtccagaaatggcctgactgtctggtggttgcagatgtggacgaatgccggaaccggtccttctgcggtgcccacgccgtgtgccagaacctgcccggctccttccagtgcctctgtgaccaggttacgagggggcacgggatgggcgtcactgcgtgggtacgggacttcaggaggtggatgggaccaaagggggtgggggaggttggtcaggccctgtccctccccatatatctgaacaaatgggaattttcgggttgtggaatttagactttggaatataagatcatcttcatgccaggcacggtggctcacgcctgtaatcccagtactttgggaggccgaggcgggcagatcacttgaagtcaggagtttgaaaccagcctggtcaacatggtgaaaccccgtctctactaaaaatacaaaaattagccggatctggtggcaaatgcctgtaatcccagctactcaggaagctgaggcacaagaattgcctgaacccaagaggtggaggttgcagtgagccaagattgtgcaattgcactccagcctgggtgacagagtgagaccctgtctcaaaaaaaaaaaaaaaaaaaaaaaaatcagaactgttgtagtggctggtgacagaaacctgacttaatcaggttttatttttgtgtgtgttcttttaaaaatgtataaagtataaatgtataaagtactaatcttaagtgttcataaacattaatctttcctaacattttatgaggaaaatttctaaacacaaagcaaattgagagaatcatagaatgaacacctacctactcatgatctagattatattatcattttattacacttgcttcctcacatatctatccattaatccatctaattttttggacagagttaaaagtaaattgcaggcaccagtctgcttccccataaattcttcaatatgcatatcactaaccagaattcaatatgtgtttaccaatgtattcttctcttctctcttttttttttttactttgaggtggggtcttgctctgttgcccaggctggagtgtggttgtttgatcatagcttactgcagcctctaactcctgggctcaagccatcctccctccagaactgagcttccgagtagctgctaccacaggcacacgcaaccacgcccagctaatgtttttaatttttgtagagatgagttttttttttttttttggagacagagttttgctctagttgtccaggctggagtgcaatggcatgatcttggctcactgcaacctccacctcccgggttcaagcaattctcctgcctcagcctcccaagtagctgagattacaggtgcccaccactatgcccagctaattttttgtactttgagtagagatggagttttgccatgttggccaggctggtcttgaactcctgaccttaggtgatccgcccaccgtggcctcctaaagtgctgggattataagcatgagccaccacgcctggcctgtagagatgagttattgctctgttgcccagactggtctcaaactcctggctttaagcaaccctccctccttggcctcccaaagcactgggattacaggcatgagccattgtaccctacagatattttcattcaacgttcaatttatatacagtgaaatgcagcaatcttaattatacattctgtaaattttcacaaatgcaaacacaacaggttttatttctttaaagggaattaaaactataaagtcttgggatatatttgaactccaggcataactggatccaggaattttaacaaggctatttctatcttctctgagttctgctttcttctattgcatgattttcaggcagattatttttcacaatgatgaaggtggccctagaacctctgggctaacatctccagtgggccacccgagagctaaaaagggaggtttttttttcaatatttctagcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacacattatatttgaaagctgagactttcggacctttggaatcatagaagcttataaccactgagtccctctcccctgttgtctcctgcttacagatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtggacagctaccatcagctaaatactgttgttttaaacatcaacaaaagacacataagttaacatgggtagtgagactgtgtcaggagaattagaccctggtcctgactctaccagattctttcattcaacaaatgttcacagggtgtgcactgtgttcaggccatcttctgggcactgagaacatagtagtgaccagaagggatcactgtctgtcctcaaggggctcacaagccaatggggcagacagagatatcaccagatagtgacaacccagagaaatcaacaagactgtgacggggaaagcccaggggggttttggaggaggcgcctggcccagcatgagaagaggattagggagttcttcctgtaggagacgacatctgaactgagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaaattttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaaggcgggaggatcacctgaggtcaggagttcgagaccagcatggccaacatggcaaaaccctgtctctactaaaaatacaaaaattagctgggtgtagtggtgcacgcctgtaatcccagctattcgaaaggctgaggcaggaaaatcgcttgaatccaggaggcggaggttgtgggattgcaccactgcactccagcctgggtgagagaggaagactccgtcccaaaaaaaaaaaaaaaaaaaaagctatgtatttatttatttttaataatttccatctttactttagattcaggggatacatgtgcaggctttttacctgggtatatttcgtgatgctgagctttgggatacaaatgatcccgtcacccagatagtaagcacagtacccaacagccagtttttttttttctttgagacggagttttgctcttgttgcccaggctagagtgcagtggcgtgatctcagctcactgtaacctccacctccctggttcaagtgattctcctgcctcagcctcctgagtagctgggattacaggtgtccgccaccacgcccagctaattttttgtatttttagtacagacggggtttcatcatattggtcaggctggtctcgaactcctgacctcaggtcatccacctgcctcggcttcccaaagtgcagggattacaggcgtgagccaccatgctcggcccaacagccagtttttcaacccttgtacctctgtccctcccccatctagtggtccccagcaactattgtgggcatctttacatccatgagtacccactgtttagctctcacttgtaagtgagaacatgtggtatttggtcttctgtttctgcattaatttgcttaggataatggcctccagctgcatccatgttgctgctaaggacatgatttcattctttttcatggctgtgtagtattcatggaagggttctaagcaggaaagatagaatcagattttgaaacctccctctggccgccatgtgaaggtgattgaagcgggtgatatggaggctgggagctcagggaacaggctggggcaggggcctggacaggagagaacagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctagaatgcagtggtgtgatctcggctcactgcaacttccgctcccgggttcaagcgattctcctgcctcagcctcccaagtagctgggattacaggcatgcgccaccacacccggctaattttttctatttttagtagagaccgggtttcaccatgttggtcaggctggtctcgaactcctgacctcaagtaatccaaccgcgtcggcctcctgaagtgctgggaggacaggcaggagccactgcacctggcgacaaattgtaggttttgagatgaagactcagccagtttgccacacactggataagagacccagagaggcatccaggaagccagggaagttccctcaccacccacccaagctgttagctgcagtgacgggaaagtgtgaggtggggaggcaagagatgcagaaatgacaggaggtgacagtgggagaaagagaaacagtgacagaggagcgtgagaggtgtggagtctggttctgccactgatggctgccaccctctgtttccctatctatgccagcctcagtttccccatctatgatagtggcggggctggggattcagcccacactgggctaaagctccttgtctccccaggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacaggtgggcatgggctgatggggacacagggctgagggcttgggtggaaatactgggtggggtgtgggcctgggacaggggacacttttggacagggccttgaggtactagtactgtcagggcaagggcgagctgccaggcaggtgggcatgggcagacataaggctgagaggtgggcactaacaggcacagggccagagggacttttgtgacaagtgggcacgagcaggtcagggctggggctggggctctggtgtcctggctcaggcttgtctctgtgtgtagctgagtaccagtcattgtgccctcacggccggggctacctggcgcccagtggagacctgagcctccggagaggtgaggccagcctttgaccctccaccccactcagctctgaggcccagcttcgtctcttcctgttttctttgcctctgtctctcaccctttctgtttctctgtatctgtctccccgaccccacccatactctgtctctttctttcttttctttcttttttttttttttcttaagatagagttttgttcttgtcgcccaggctggagagcaatggcgagatcttggctcactgcaacctttgtctcctgggttcaagcgattctcttgcctcagcctctggcgtagctggctacagacactagccactacgcctggctaatttttttgtatttttagtagagacagggtttcaccatgttggccagattggtctcgaactcctgacctcaagtgatccgcccaccttagcctcctgaagtgctgggatttcaggcatgagccaccgctcctggcctctccatctttctttccctgtctctacttcttggtctatcaccagctctgtctctgtcttcccacgtcatgccctcacacactccacccatccagcccgcccccatctctctctctgcttttcgcacagacgtggacgaatgtcagctcttccgagaccaggtgtgcaagagtggcgtgtgtgtgaacacggccccgggctactcatgctattgcagcaacggctactactaccacacacagcggctggagtgcatcggtacaagccccacctcccccaacccccggcaactctctccaacccctagccttgccagctcccctctggaatgtggccaccaccagcgggaagtctttcctggagtctagactccatccatcacactgccaatgtgctgggaagagaaatgggaaagggtggggagagttgaaggggatgcctcttaatcatcctctccctagacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcggtaaccccgcccacgccatccaggccctccttcccttggctcggcctcacacccgcacccgggccacacctttgcgacggccacgccctccgaaggccacgccccatgctcctggctcgaccacgccccactgagccctcactcagtctctgtcccactgtctgtctctctgaggcgagctggctaggtggttaaaggcaaaagttttagggcaacctttgcatgttgcctcttggactccaggtttctttctgcacactgggtgaatagcccctaccttatagggtggctgtgaggaattttatttaattttatttatttattttttgagacggagtttcgctcttgttgcccaggctagagcgcagtggcgccatctcagctcactgcaacctccacctccggggttcaaacgattctcctgcctcaggctcccgagtagctgggattacaggcatgtgctaccacgcccagctaattttgtatttttttctttagtagagacagggtttctccatgttggtcaggctggtctcgaactcccgacctcaggtgatccgcctgccttggcctcccaaagtgctaggattacaggtgtgagccaccacacctggctgatgaattttattttattttattttatttttaatttttaatttttagttttattatttattttttactaagtaccacatgagtgctgcctgttattatttatctgcatctctaggtctctgtctctttccagctgtttgtggatttctgtctttggggttttctctgaatttctgacaccctctggatctttgttttcaggtccctttctcctgcctctgtatctttgttttcctgttttgagtctttgactctttggatgtgtttctctctctctctttgggtcttttttctcccttttcgtttctgactattttcctatctctaggcccctaacaacttctgctgaagctctgtctcttgaacactctacttgtcgttgtttgttttcatttttgagacaagatctcgctctgtcatccaagctgaagtacagtggcacaatcacagctcactgcagcttccacctctcatgcccaaatgatcctcccacctcagacttgcagtagctgggagtccaggagcccgccaccaagcctggctaatttttgtatttatatatatatatatatatatatatatatatatatatatatatatatatatatatatatatatatttttttttttaaagatgggtttttgccatgttgcccaggctggtcttgaactcatgggctcaagcaacccccccacctcagcctcccaaagtgctgggattacaggctccaacacactctctctgtgcttcttgccacctctctttttgcccactgtcccaaccactcttctctcatttcctgtgccttcagcacttacccccatacagtgagatgtcagacaatgctcagagaagcaaagcaactgccccgaggccacacagccctccagaggccagacttgggtagacccctctcaggccctacctcccagtcattggacaccttcttctgccctctcctcctatatgacagtctccttgttcctcaatccagaaccctggagtgacctcagagaacttccagagttagatcacagctgatgagaaggatttgctgataggcagagggtgcctgggctgctcagcaggggaagggtccagcccctgggaggacctgagtgccaggcccactctgacacatgctgtctccacctacagatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcaggtgctggcactggcctaggctgaactcagaggccttgccccatgggctccaaatctaggccctcagatccccagtcgcagaacccccagactctatccaaactctgtcccctagaccaacccctatgtcgcagcccatcccaaaatcttggtccccgattcacactccaaagacttccaagtctcagccacagacatcccaaggcctgacccagcagatcccatagtaccagacccacaggcccctgaggtctggtctctcatatgctcagctcctggtctctagaaccaccagacacagcctatgagatgtcctcccctaaatcctgggcccttagacctgaaatgccagttgctcagacctcaccatcctggccccagaccccctggtcacagccccacagacctccaagtcccattgccttagacaccctccaagtcccattgccttacacaccacatccgggtgcctaagaccccaacacacagccccagagattcccaagtcttggtttctacaacctctgagtccctcagtcctcagcccttaggaacccagttccaaagccccagtcctgggtcctcagacctccaggtcccagtgcctcagactgtctcccatgcatcctgccccctcaggtccccagcagcaatccctgggattccccagtcctggtccacagaacacccccatctaatttcttcaggtccctagtcctagctcccatgggtcgctccaattccagcctctcagaccctgattcttagcaggcttcattacccttgatctcagcacgtccgaatcccagtctcagccttcagattctcagcgctggctccagaaaccccggggccacccaggaccctccccatccagtcctctgcctcctctcccaaggggggtatgtgagtggtgggtgtgggggccagcaggggctgattgtttgccttggctcctgttcccagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggtgagcactgccagcgcatgatgagactgagatgaggggtgaggtgtgcacggagagaggagggagggaaacagaaggcgggaggagagacggaacacaggtgcaactggagagagccacagaaagggacagagaagtgtctatagcccggcaaagaaagagaaggtggcagagggaaagctggcgagagaatgaggtaagcttactggccccgcagcacccgccacagccctggagcgggatggacagtttacagcgagaaagatggagccaaggacgcgcacccaccgttgtgggtaaggggtgaaggcagggacctcaagtcatagggtccccgcatttcccacaggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttggtgagggcgggcccggggccagcatgcgcagggagaggcgaggcttgtccagggagggtggaagccctgactagggggtgctggtcagggacgggaaaggacctcactacaggggacgggccagcgcaaaagggaggagtaattcttccacctgggtggggcttgactgaagaaggcggagtcagggtgccagcagggcagggcttaaccacggggctggagccgggccttgaagcaggatagaggaatagaatagtgctggtgtgacttgcagtgctaccttgggcagtctgcaggacctctttggagagcctcagtcttcccacctgtaaaatgggaatattaatcaagtctgcctaatttggatggcagtaaagccaagtgattaaaatcaagaacatagccgggcgcagtggctcacgcctgtaatcccagcactttgggaggccgaggcgggcggatcattaggtcaggagtttgagaccagcctggccaatatggtgaaaccccgtctctaaaaatacaaaattagccgggtgtggtggtgcatgcgtgtaatcccagctactcgggaggaacccaggaggcagaggttgtggtgagccaagatcgcgccattgcactccagcctgggcaataagagcaaaactccgtctcaaaaaacaaacaaaactcgaggaggtcacatagacctcagactcagtccagcaacttgctgtgtgacgctggacaggtcactgtcccttacctaatttttctgatatgaaaaatggctacagtcaaagatcccatttcatagaattgcgaatattattaacactgatttacaataacattgagagtcatgtgcaaatggaggcacatgcgtaaaacgaattacagtacctacctaataggggtattagaaggacaaagttaatacttgtaatgtgcttaaaacaatgcatgaacatttattgttgttgacaccatcatcagtatttttttcttcttttttttttcttttcttggcgacagagactcactctgtcgcccaggctggagtgcagtggcctgatctcggctcacagcaacctcctcctcccaggttcaagcgattctcctgcctcagcctctcgagtagctgggattacaggcgcccgccaccatgcctggctaatttttgtattcttagtagagacggggtctcaccatgttggccaggttcgtctcgaactccggcctcaagtgatccacccgcctcagcctcccaaagtgctgagattacaggcatgagccaccgcgcccggccattattattttcttaacaaaatcctagtgcggtatgggccaccatatccatcttacagaacacgaaactgaagcacagtgaggttaagccacctggccgggctcacacagttagcagatggcagaggccagattggactccaaactgctcagcatctgtgctcctctgttccaagaacttaaggggccaaggaggcgagcttctggggccccagccttcagcagcgatcgttgtctcccctccgcagacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatc

SEQ ID NO: 2703 - DNA, 14550 bp, Homo sapiens
cgggtgcacacccggaagtgggtgcgggccagccggctcgcccgggggccatggcagcagcggctactgcagccgagggggtccccagtcgggggcctcccggggaagtcattcatctgaatgtgggaggcaagaggtgagtgtgggagactcctgaggtcccatcctcgggggcgggaagcggggtgggagtatccgcctctcctgggggaatccctgtccatcaagggttgctccgccccccccccctttggaggcgcgagattctggaaaaacgccgggggagggggaaggggagggaaccctggatcctgcgggagggggacgcattcctcacccgctcctcttcatctcttgcgtccgtttaccttccccgcccagattcagtacctctcgccagactctcacctggatcccagactccttcttctccaggtgatcgggagagcgagtttggggcgagggtaggagggatggagagggcgtgggagacctaatatccactcccccggcccgtgacgcctgctcggtgtcccttccctgcagtcttctgagcggacgcatctcgacgctgaaagatgagaccggagcagtgagtcggacaagaactgaaatgggatgggggggaggggttggtaggaagaggggcaggaccccactcagtcctgccttttaccccatccatcctctgcccccctttcccgcagatcttcatcgacagggaccctacagtcttcgcccccatcctcaacttcctgcgcaccaaagagttggatcccaggttggcatggaaaaaggggagggagtccctcactgtcttcagtccctgaggagttctttcacctcctctgaatgtccacgtgagctccattctattagaattctcattcagaaccttgatcacaggccgggcgcgccgggattgctcacgcctgtaatcccaacactttgggaggccgaggtgggaggatcacttgagcccaggatttggagactagcctgggcaacatagcgagaccccttctctaaaaaagcaaacaggcaaaacttcatgagaatcttgatcatgttaaaattttatgtccttcgatttctccctacacacacacacacacacacacacacacacacacacacacacactcaacatttcctccacccatatcatcactccttagcatctttattccatcaaaactttctaccccttgacattctctgtgcagttttgaaaattaccctctcagcattctctgttcacccccacacctagaccctgacctctagtcaattctactacccaggggtgtccacggttccagcctcctccatgaagcccagttctatgggctcactcctctgggtaagtgggagcccccagctatcatcctcattgtatagaaaaccaactctgtgatgctacctgcccctcttccccttctctcctgaaagagggctggggtagaggtgggaggactggttatggccctggccgggtctgtattcgtactgggaggagtattggtactctgtgtagaaagaaatggggagggggaaatggggtggcctcagcatctccctaagtcccagcctttaagtcctcctgttgcagttcgtcgcctgcagcttcgagaggagttggatcgatcttcttgtggaaacgtcctcttcaatggttacctgccgccaccaggtaggcactcccaatggaatggaggggcgcggaggtgggccaaagactacatttcccataaggctgcagctctcgggtgcctgtgctgtgcgtcctgagatacagtgggaggtgtagttccctatcagatgcttgggctgatgcttggaaaggaagttggacacagcatttcccatgagacaatgggccagctaactcttgaggctcagaaggatgtcctggagccccatgggagttgtagtccgggtttggtttctttgtagggggggctttggaagacctgggattcttcgtatggaggggagaaatattaataggaagttattgacagtaatgcccatgatagccagcccactggccatggaaggtatgccccagtggttattggaactaggcttttctgattggtagaagtaacagagtagggaaatttcatctacagctttatttccctaactgcagtcagcacctgctaccttcatgaaagttgccagatataaagatctgtagtagtacttttccaacttagttttatcctgttttccgaaaaacaatcatttatttatttatttatttatttaattttatgagacagggtctggctttgtcacccaggctggagtgcagtggtgcgatcttggctcactgcaacctctgcctctcagattcaagccatccttccacctcagctctgccactgagtagctgagactacaagcactcgccaccatgcccggctaattaaaaaaataataatcattttaaatgcaagctttatattataaatacaaagtaaacatgaaaataaaacccaaacatagcagtgttattaaactctggcctgtagcagtggctcacacctgtaatcctagcagtttggaggccgagacaggtggattacttgagacctggagtttgagaccagcccaggtgacacagcaagacctcatctctactaaaaataaaaaaaaattagccaggtgtggtggtatgcacctgtggtcccagctacttaggatgctggagtgcgaggatcgcttgagcccaggaggtcaaggctgcagtgaactatgatcactcattacaccccagcctgggtgacagagcgagatgctgtctcaaaacaaaacaaaacgaaaaacaactctggctagatgctattgcttgccaagggtgcagtcttccatttattaaaagtgaaaattagggccaggcacattggctcatgcctgtaatcccagcactttgggaggctgaggtgggtggatcacctgaggtcaggagttcgagaccagcctggccaacatggtgaaaccttatctctgccaaaaatataaaagattagccatgtgtcgtggtgggtgcttgtaatctcagctacttgggaggctgaggcaggagaatcacttgaacccaggaggcagaggttgcagtgagccaagattgtgccattgcactccagcctgtgcaacgagcgaaactccaactcaaaaaaaaaaaaaaaaaaaaaaacggaaaattaggtaatactgcagattcattaatatcacagcagcactaaactcagtcttcctctgtgctgggctcaagggaactgaaagggaagtaacttgctatgtggttcagtgtcatttcatgctgtgtcactgcaccacttaaaatcttcacccggagactatgtcccacacatggggaaatcaatcaccgtcatattttaagtgcttgctgtgtgacagccacgattacaatgactgttactctacctcttattctcactgtagtgttcccagtgaagcggcggaaccggcacagcctagtggggcctcagcagctaggaggacggccagcccctgtccgacggagcaacacgatgccccccaaccttggcaatgcagggctgctgggccgaatgctggatgagaaaacccctccctcaccctcaggtacgtttctatctcgtggaaggttggggcagctgtggggtccctgtgaccctcttctgatccctactcttcccctcaaggacaacctgaggagccggggatggtgcgcctggtgtgtggacaccataattggatcgctgtggcctatacccagtttctagtctgctacaggtgcttggggagggagtggcaggaggtcccagccctgttgatgggaagggcatgcggtgagggttggtgatgtcccctcgatcctacaggttgaaggaagcctctggctggcagctggtgttttccagcccccgcctggactggcccatcgaacgactggcgctcacagcccgggtgcatggtggggctttgggtgaacatgacaagatggtggcagcagccaccggcagcgagatcctgctatgggctctgcaggcggaaggcggtggctccgagataggtatgaccccaagccttttccagaaccctctgtcctttaaattctactgcctgttaaaatgacccaccccataaaatcctcaaacccataagaattctctgctctattagatctgtttgtgtcattagaatgctccagcccttcagaattctgtatcctgttagaattccctggcttcctagaaaaatccacccacatacaattctccctccatcagaattccctgccctgttagatctcttggttttgttagaatgcgctattctgtgtggccatgagaaatgtctgacttggcccggtgcggtggctcatgcttgtaatcccagcactttgggaggctgaggcgggcagatcacttgaggtcaggagttcgagacccccttggccaacagggtgaaacccagtctttatttcaaaaatacaaaaaaattagctgggtgtggtggcacgtgcctgtaatcccagctactcaggaggttaaggcaggagaatcactggaacctgggaggcagatgttgcagtgagctgagatcgcaccactgcattccagcctgagcgacagagtggacagagtgagacaccatctcaaaaaaaaaaaaaaaacaaaaaaagaaatctctgacttatggctgggcacagtaactcacatctgtagttccagcactttgggaggccatggcaggaggattgcttgaggccaggagttcgaggctgccgtgagctatgtaagccatgattgcaccactgcactccagcctggacaacagagcaagaccctgtctcaaagccacagcaacaaatctcggacttattaatctgtccccaaataaatctcagccctcgtaagaatcccctgccaccagtggaggtttttttgccttattgcaaatctcagtgctgttagaattccagaccgttttagaatcccataccccatcagaaatcttctggcccattttatcttctctaattcctgctggaatcttcactttttttttttttgaaatggagtcattctctgttgcccagattggagtacagtggtatgatctcggctcactgcaacctctgcctcctggggtcacgcaattctccttcctcaacctcccaagtagctggggctacagttgtgtgctaccacactcagctaatttttatattttttagtagagatggagtttcatcatgttggccaggctggtctcaaactcctggcctcaaatgatccgcccacctgagcctctcaaagtgttgggattacaggtgtgagccactgtgcccagcccctgatggaatcttctatccttcaaggattctgtggtcccactgaaccctctggtccttggagttcttcctcccacctctcctcctccatgaggcagggttccagctgagccctttttgcccactgcaggggtctttcatctgggggtgcctgtggaggccttgttcttcgtcgggaaccagctcattgctacaagccacacagggcgcatcggggtgtggaatgccgtcaccaagcactggcaggtcagagttctggccagcctggctgcccccttcccagttttccagactgtacagacccaggaaggggttcacgtctgcccccacccccaccccctaagcctggaggaagccagagaaccagcagctggccagagcctggggatgtctgtgataaaggcctaaggagcaccagggaagccttcctggaggaggtgctgcagagcccacatgaagcatgaatgggtttgaaaaggagtagggaggattgtcttgggactgggtgagagagcaggttaggggggatgctgtagaagacaagaactggcttggctcggtggctcacacttgtaatcccagcactttgggaggctgaggtgggaggatggctttgggagaaagacagacagaggcagagaaagagacagagaggcagaaaaccaggcaaatagaaatagaaaatcagaaagaggtgacagagaagggtagacagagtcaaaccagactgaaccactgtggcagatgggggaactcagagagataaatggagatgaattagagtcatgtcagaagtacatagtggaggccgggtgcagtgactcccgcccgtaatcccagcactttgggaggccgaggcaagaggatggcttgagcccaggagtttgacgccagcctgggaaacataataagactctgtctctacaaaaaatttaaaaaattaaaactttaaaaagtacagagtccaggagaggccaagagtcagacagacagatgcatcaaagggaggaagggagggaacaagacagggacaaaggcaggcctggggtggacggggctggggagcagtgggtgggttctggaggtggaggagagggcccatcctctgtgaggggtcaccacggaaggaaaggaatggaagggctcccggctgcagcctgtcctgccccacccccaggtccaggaggtgcagcccatcaccagttatgacgcggcaggctccttcctcctcctgggctgcaacaacggctccatttactacgtgggtgagcagcagcctgtgtcccgggtgcccgagaccctcccctgggagaggggaagggagggagagaggctggggcacttggaacaaacccgctccaccctccctgcccaccccagatgtgcagaagttccccttgcgcatgaaagacaacgacctccttgtcagcgagctctatcgggacccagcggaggatggggtcaccgccctcagtgtctacctcacccccaagaccagtaagctatgacccggcttcccctgctgctgtcacctgccagccccagccccagcctgcagctgtcccccaacttgtgtagcatgacccagaggggtttatcgaggggcggcagattcaactctctctcatttttttttctgagacagactctcattctgttgcccaggctggagtgcagtggtgcaatcttggctcactgcaacctccacctcctgagttcaagcgattctcctgcctcagcctcccaagtagctaggattacaggcgcccactgccacgcctggctaatttttgtagttttagtagagatggggtttcaccatgttggccaggctggtcttgaactcctgacctcagatgatcctcccgcctcagccccccaaagtactgggattacagacgtgagccaccgcgcccagccagattcaactctcatccagtcattcaacaaatatttactgagtatccctgtatataagcacgttctaggtgctagatggtggccaccctctccactaggggcagaatggaccattaggagttaatctttgtgtttctttcccacctttgtgattaaggcatgatgttcacatgttcataaaacaacacagatgcaggttttacagcagatgaacctgagttctcttacttgagacagttttttgttttgttttcttgacatcaaatgcagaatgggttaatttttgagacgtaattctcataccataaaatttcccatttgaacgtgcacaattcagcggattttagtatattcacaaggttgtacaactatcaccatgaacaaattccagagtatgttcatcacccccgtaagaaaccccctgatctttagcagtaactccacatttctcacttctgataccctctagaaatcactaatatgctttctctttttgtttgagacaaggtctcgctctgctgcccaggctggagtgcagtggcatgatctcagctcactgcaatctctgcctcttgggttcaagcgattctcatgcctcagcttcctgagtaggggaggattacaggtgtgcatcaccatgcctggctaatttttctactttaagtagagactgggttacgccacgttggccaggctcaatatgcttcctatacctatggatttgcctgttctggacaattcctgtaaatgggatcatacattatatggtcttttgtgtctgcatttttcacttagcatatttttttaaatggttagtgttttctgggtcttaagatatccttacctattctaggttacaaagatcttctcctgaatttcttctagaagatttacagtttagtttttacatggaagtctgttctatcagaaattaaattttatgtatggtgtgaagcagggattattcttttttaaaaaaaaatagagacagggtcttgctctgttgcccaggctagagtgcagtggcatgatgtgagttctctgccacctccgccactcgggctcaagcgattcttctacctcaacctcctgaacagcagaaccacaggcatgcatcaccacacctgtctaatttttgtatttttttgtagagacagggttttgccatgttgcccaggctactcttgaactcctgggctcaagtgatcctcacactttggcctccaaagtgctggaaatacagacttgagtcactgtgcttggccatagctgctgctgctgcttttcttttttttttaaagcagaaataagttaataatacacctaacttcatgacacattatcacctttcttctttgtaaggcccttttcttatttcttttttttctttctttctttttttttttttttgtcttttcctgagacagagtatcgctctgtcattcaacccaggctggagtgcaatggcgcaatctcagctcactacaacctctgcctcctgggttcaagcaattctccagactcagcctcccaagtagctgggattacgggtgcctgccaccatgcccagctaatttttgtgtttttagtagaggcagggttttgccacgttggctaagcaagttttgaactcctgggattctcctctcgtcgtctcccaaagtgctggaattacaggcatgggctgctgcacccggcctctttcttatttcacttacttactcatttcctcctcatctcccttcccgccacatgccactattatgtcatttttctttgttttttgagacagtctcgcttcgtcacctaggctggagtgcagtggcgcaatcatagctcactgcagcctcaccccctgggctcaagtgatcctcctacttcagcctcttgagtagctgggatcataggtgaatgccatcacacccaactagttttttaaaaatcttttgtagagatgagggtctcactatgttgcccaggctggcctcaaacgcctggcctcaagcaatcttcctgcctcggcctctgttctctgttttactttctctttcctctcttatttgctgtttcactgttacaatttctgtctctgggcctctcctcctttgacctgtgcctttgtctccctgttcctccatttcccacatctcatcaccatctttttgtgtccttccctctctccttgctttctgactgtgtctctgttctgtgtctctttctttctttctttctttttttttttttgagacagagtcacattctgtcatgcaggctggagtgcagtggcgtggtcttggctcattgcaacctctgcctcctgggttcaagcaattctcatgcctcagccttctgagtagctgggattacaggtgcgtactaccaccaccagctaatttttgtatttttactagagacagggtttcagcacgttggccaggctggtcttgaacgcctgacctcaagcgatccacccgcctcagcttcccaaagtgatgggattacggcgtgagccaccgtgcccggcctctccttgctttctgactgtgtctctgttctgtgcctgtttctttctccctgccctggtttctgtctctgtggcccaggccctctcctcatccttggcccctcaccaggtgacagtgggaactggatcgagatcgcctatggcaccagctcagggggcgtgcgggtcatcgtgcagcacccggagactgtgggctcggggcctcagctcttccagaccttcactgtgcaccgcagccctgtcaccaagatcatgctgtcggagaagcacctcatctcaggtgagcctctgtggggtgctccagtgctgggagagacagctcagatgggagtgtggagacaggaggatgagaatttccactggggagggacattgtgtaggaagagagctctggcggagaggattgacctgggatgggactgtaattgcagaagtgagagaataccataggggatcagtctggggaagagtgaatctgtgtgtgtttgggaatccatcaattcagcaacgatttacggggcacccaccatgtgccaggcataggggatacagtgatgaacaagacaggccaagtccctgccctcgtggagctgacattctagcagcgatggcagacaataaatctataaaaatggacatcaatggccagctgcggtggctcacacctataatcccagaactttgggaggccaaggcgggtagattacttgaggtcaggagttcgagaccagcctggccaacatggtgaaaccccacctctaccaaaaatataaaaaattagccaggtgtggtggcacgtgcctgtaatccccgctactcgggaggccgagggaggagaattgcttgaacctgggaggcggagattgcagagagcccagatcatgctactgcactccagcctaggcaacagagcgagactccatctcaaaaataaatagataaaaatgcaaatcaggctgggcactgtggctcatgcctataatcccagcactttgggaggccaaggtgggaggattgcttgaggctaggagtgtgagaccaacctggacaacaaagtgagacattgtttctacaaaaaatttttaaaaaattagccaagtatggtggcatgcacctggggtcccagcttcttgggaggctgaggtggagggatcacttgagcccaagagtcaggggctgcaatcagctatgattgcacccctgcactccagcccaggcaacaaagcaagactctatctcataaaatattaataaaataatctaaatcaacaccaggcaatgataagggctatgaataaacatgaagctgtgtgtggctagagagtgtcaagtcgctggagaggggtcattcagggaaggcctgaggaaggacctttgagcagaaataacagaatgagcagtgcagattggtagggacaagcattcaggccgagggaacaggcattgcaaaggctctgaggtgagaggatgcctgaggaagtgcagggagccacttgtgcctggaacagagtaaatgagggggagaatgggaggagatgagggtatggaggtgacaagggcaggagccacagagggctccgagcaggggagggacatgactagcttcaggtgttcacaggctccacctggctgcccgtgggagcacactactgggataggacaggagcagggacctctgggaggggcgtgctgatacggtccaggcaggtgacgaaatggaccaggaccggtgtggggcagaggatagggcaaggtgagatcaggctctggaacagttttggaggcagaggcaacagggtttttaacatttggaattctggggaggaaaggattctctgaaagggaagaactcagcaagggctgaccctcctgaaacggggctgtcctgaggctctggacgggcaggcagcattgatgcctgcaccaggcctgacttcctgctctccttgtgcccctcagtctgtgccgacaacaaccacgtgcggacatggtctgtgactcgcttccgcggcatgatttccacccagcccggctccaccccactcgcttcctttaagatcctggctctggagtcggcagatgggcatggcggctgcagtgctggcaatgacattggtgcctactggctcctggccttcccaccccactgacccccttacctgacccctgttgacctccgctgattcccacttgcggccacctgacccaggagcctgcaacgattggggtgtcctgatccttgaggcacctgagctccactgactgccacaaccccccagccctctctggccctgcccaactctaacaacctggggatgggactggggtcttggggtggtgggtttcatcagtggggaaggaagtctgaggctgagggaatcccagctggccctgacccctgcccctgcctggcccaggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaaggggtcccagccaaggagcattgaaggagcaaaggctgggagggaggacaggcctggtaggtttgtcttctggtatcaaaggtgtgacaggtgttggtgggactgacctggcgcagtgccagcccagtgcaggcagggccaggttgaaggcacagggggtggggtcagggtgggatggggggcccaggcggagggggaggggtgggatgggggcccagggggagaggtcggggtgggatggggggaccagggggaggggttggggtgggatagggggaccaggggcaggggtcgggatgggatggaggagacccagggagctgtaggagccttgcttcagctgggaaaggggcctcggaggatgttctggatgaagggactctgagcagagacctagaggacaagtaggaaggagcagaagaaagaaggcaggggaagggggccccagcctgagggaactgtatgtgcagaggctgagaagggccaaatagggtcacatgggaaggacacgtgggctcctgggctggagcacagaacaggaggtgaggatggggtgcagatgcgggcgggccttgtcaggctgtggaagggctgaggctttgtcctgtgcggggagccgtggccactgcatgggggatgaaaggaggcttgatgggaggccaggagcccagggaggaggccaggaggctgataggaggtgggggagcagctgggacgggcctcaggtcttccctgcagtgggagcagggaagagcagaagctctgggagactccctgggtgtttggggctgcggtgtccaagagctgctggacccttgggactggaactcaaaagcaggctagggatggataaagattgggatggcccctggagaggcaggaactgcagccacagtggtggggactgggacgaggaagggtgagaaagcgagggtgaccacctcccccactgcaccccccagggtgtgctccgtgcgctccgtggacggctcacccacgacagccttcacagtgctggagtgcgagggctcccggcggctcggctctcggccccggcgctacctgctcactggccaggccaacggcagcttggccatgtgggacctaaccaccgccatggacggcctcggccaggcccctggtactccctgccccaccccaatcccgtcccaagccccacagcctcacccagaaccactctccactgccaactgcttgatctctctcccaggcccttgccctctgaccccttttcctttgaccccctctctgctccccatcccttcctgcccttgtttttcaacccctgtctcagcctctggcccccatgcattgatctctgcttcctctctcctgtcctgaccctcggtgcttgcactgcaatgcaacccaggcccttgccctatgacccctgtcttgccccctgaccctgcttccgtgccccccagcaggtggcctgacggagcaagagctgatggaacagctggaacactgtgagctggccccgccggctccttcagctccctcatggggctgtctccccagcccctcaccccgcatctccctcaccaggtagccacaactccactgccccttctgtgcaatgaggggagaggggacagcatggtgttcccggggacagagtggcccagctgccccgtgatgacgtgcacttactgtccttacttcctcagcctccactcagcctccagcaacacctccttgtctggccaccgtgggagcccaagccccccgcaggctgaggcccggcgccgtggtgggggcagctttgtggaacgctgccaggaactggtgcggagtgggccagacctccgacggccacccacaccagccccgtggccctccagcggtctcggcactcccctcacacctcccaagatgaagctcaatgaaacttccttttgaacaacgcagctgccatgatgccttgggatgccctggtcctgggggactcaggtgcctccctgattcctgtgggaaccccgggttcagggccagggcctccttggaataaatggttattgttactaggtccccaccttccctcttttctggaagccaaagtcaccctccccaataaagtcctcactgccaaca

SEQ ID NO: 2704 - DNA, 28450 bp, Homo sapiens
gagcgcggcgctgcagccatggcgggcggcgtgcggctgctctgggtgtcgctattggtgctgctggcgcagctagggccgcagcctggactgggccggctcggagagcgtctccgcgtgcgcttcaccccggtcgtgtgcggcctgcgctgcgtccatgggccgaccggctcccgctgtaccccgacctgcgcgccccgcaacgccaccagcgtggacagcggcgctcccggcggggcggccccggggggacccggcttccgcgcctgtgagtgcggggtggtggtcccgagagagcggctccgggggggaggaggatccctggggatggaggagacagtcctccagggagagggagcccagattccatatgcaatagtgcaagggaatatcaggggctatttgaggaagggggccccaaattcctggcttttggggttgggtcctgagggttccgattttgcaagcaatgagggttcttagaggcctgtgatgtcccacgtgagggaattggcgccagctttcatgctttgcgtcaaaatggggatctcagaattgaggggcctgagaacttttgggaggggggctcgaattctgagacgctgagtaaggagtccccggggaccaagcaagagtctcaggaccgcatgggggacgtctcagtttctgtgtgtttgggtgggaaggttctgtatgggaatgcctgtgaggtggggtactagagagaagaaagttaatccgaagaactaagagggagaggggacagagacgggggttgtgtgtgtgtgtgtgtgtgtgtgtgtgtgtgtgtgtggcggcgggggtggggtgggggtgtctccgcaggacctgagttgcaggggtcccacgtgcgacagaaatccagataagagggcttacggaaggggcgccccctgggggcggaggggacaggaggtgtatgcaccaggcactcctagagatggggagccttgggggttcaggtgaggtgggggagggcgcaccacctgttgttccaggatgcaaaagtgggcagactctctgggatcgggccttcctgccccctaccccgcagaccctatggagtggggagtgggggcccctggagcggagaactcgcccagcctggcccccagccagcccagcccggccggcgtgagctcatctcccgcctgagcccccgcccgctgccactccctctctcctccccttcctccctctttctttcactctttcccggcccagccccaacgtgcctgtgccaggcgccatgcccaggcgggtgccaagcccttgggggtgcaaggagtggcatgtgaagtgggggctgacctcaaagggacccctatgtcctcaactccccgcttggccagggctgtggggcatgacgttggctgtggccatctagtggcccaccctgggtgtaggcacccccagggagctggcctgcgggcctgcattcaggccaagagaaggcagagaaatgcctctggagcctgggaaataccctcagacctggctggtttcccaccccctccatcagagacccttaccattctgcaattttgattcctagttaagcctctcctaggccccactactcaattaaaagcccccattagaccaccctggagtcatggccccacactcctacctaagggagctgagtttttgctccaggccctagacccgctctccaaccatggcaacagactttagagaccactcctccagtgaaattccctctcattcttccctcccacctcccaaactgtgcctttccccagataactctgtagtattgtccagaagtcctgttcttctagctcacccccttccccaggaacttctgatcccatttatcttcagagaaccccagggttggtcttgataagtgggttctcgcaagaggactccagacattgtgctccttacaggcagccattaataaaaagcctttggcacttaatccttagctgggaggggaggggattccacagagggactcggccaattgagcctcttaagtgctgatgacttccaggaattccacttcactatctaaaccctgttttcagcaccgtcaaactggttgtctcctaggcggcactagagtcctgttttctaggtaactgtccacaaaaggactcctgctgaaaggacgcctcagtttcctctgagctaggttcctccatcccagaaacctccagccgtctttgaactcgagaggactgccctttagtcgatctcctcccaggactccagtccctttatccttctaaacggaggtggctctctgcgtcctttcctctctacagttgtggctcagaatcccacacgcgcctcccccggccgcctgcctcctccctcccctccgcacagctgtctccagctgttctctgcagccccgggagagagagggagggggtgccctcgcaggacagcccggcctcctttggctcaaaggtcccggggctccccaagggtccggaatgtggagcctccgccctgcccccgccgcacctctctctttgtttaccccgccgcacagctggcagtgccccgcccagaggtggcctggggcccagcgagggcgcgcagaggggagtggaggcgcgttcccgctcgtggctccgccccggtgctactggaggctgtaaggccgagctagaactctaaagccccagccagaaagaagttgggcggagacacagcgcggtgggcggaactagggcacccggacagcctggaggtggggtgggaggggcgtgaacaagtgagccgggcgaatcagagtgcggaaaggaaggtgggaggggctagaggcagcaggttaagctcctggataggcggggtttagaatcccgcgggtagaaggtaatgtgagaggggctacaaagggggcacagccagggggcggaggtaggacttcgtggaccaagcagagggagtgtgggcgggcatagaatgcgaaggagacagagttgggcggggagttatgccagggagtggttaaaatgtggtttgagtcaatggaagggatcagcattgggtcggaggggctggaacagcaaagggttccgtcggactacggaatgggcggggtcagcgccgtctgggctggtctggaactccgtggactcagccagaaattgggatccgagaggttgacatgaaagtgaataaacagcctgagggctggctgggctcacgcctgtaatcccagcactttgggagactgaggcagaaggattgcctgagcccaggagttcaagaccagcctggccaacatagtgagaccccgcctctaccaaatttttaaaaaacgtagcccgatgtggtgcacgcctgtcgtctcagctacttaggaggctcagatgggaggatcacttcagcttaggaggtcgaggctgcagagccataatcacgctactgcattccagcctgggcaatagagcgagatcctgccgacttagtgggtgggaccgtacctctgatggctgaacaactggactgggccaatgctgatgccagaattggggcggggccacatgacagctaagggcggagcgacttagaaatgaatgataccttgagggagtagggaccccaggagaacctgccaggaatggtggcgcccctgagtgtcctcgttctcctcccagtcctgtgtcccttgatctgtcacaatggcggtgtgtgcgtgaagcctgaccgctgcctctgtcccccggacttcgctggcaagttctgccagttgcactcctcgggcgcccggcccccggccccggctgtaccaggcctcacccgctccgtgtacactatgccactggccaaccaccgcgacgacgagcacggtgaggaaagggtggccagagtcccctccgacccctgtcaagcatttcactttgcccctgaccctcatatttcccgccttcccgagcacctttgcccagctcgccctccccgccttgtctagccccaccccgtaagaacccgtgtagacatccgtttgcccggccgtgcctcccctaggcgtggcatctatggtgagcgtccacgtggagcacccgcaggaggcgtcggtggtggtgcaccaggtggagcgtgtgtctggcccttgggaggaggcggacgctgaggcggtggcgcgggcggaagcggcggcgcgggcggaggcggcagcgccctacacggtgttggcacagagcgcgccgcgggaggacggctactcagatgcctcgggcttcggttactgctttcgggagctgcgcggaggcgaagtgagaggaggcccgtggggaggggcccggagcttgcctccgcgcgggggcgcgctcacccaacacttccccgcagtgcgcgtccccgctgcccgggctccggacgcaggaggtctgctgccgaggggccggcttggcctggggcgttcacgactgtcagctgtgctccgagcgcctgggtaagccccaggacgtccccgaagtgctcggagctggggagtggtgacaacctcaccgttcctcctactctgccctagataaacccagttcacaaattgtagccacgcctaccccattgtggaggcgacttccagtcctgagcttttcataccgctctgggaccacccaccccattttctgactttggccactctgttctcaccctgcctttgtgccttggccccccaccatatactttgggagtctccaatgttgccatttcaactgccaacctaaggctgtccctgcacttaaactacagccaacatcttttagtccctcccaccccgtcttcgtctctgcccactccattctcgctctgcccacctgtccctggcccacccctctcctctcgccacagggaactccgaaagagtgagcgccccagatggaccttgtccaaccggctttgaaagagttaatgggtcctgcgaaggtgcaacggggcaggggtgggaggggcttggttctgggggcgggatttgcagggatcaagttcctgactccacggtgacctccccaaccctggcagatgtggatgagtgcgcgactggcgggcgctgccagcacggcgagtgtgcaaacacgcgcggcgggtacacgtgtgtgtgccccgacggctttctgctcgactcgtcccgcagcagctgcatctgtgagcaaccagcagggagctgaggctgggtcccgccctccctgccctcagaagtcccagagcatcctggggcctttaattccctcggacccccccagactcccgggttcctctgtcagccttagagccccctcagaacttctcagattcttatacagcttcagcatccctggaccacctttagacctttcaagccttttggatccagatccctccagactcccagacttttttttttggagatggagtctcgctctgtcgcccaggctggagtgcagtggcgcgatctcggctcactgcaatctctgcctcctggtttcaagtgattctcctgcctcggcctcccgagtagctagaactacaggcgggcaccaccatgcccggctaaatttttttgtatttttggtagagacagggtttcgccacgttggccaggctggcctcaaacccctggcttcaagtgatctgcccacctcagcctcccaaagtgctgggattacaggcgtaagccactgcgcccagctctcccagactttctggaatccttctcagacccccaaatcctctcgtccccctcaacgactcgactatcttcagatcttgagatccttctcagagtctctcattcaccactgacaccccattgaggctccaagcccttctcagacctccagagcccactgctctccttcagaccctctcagacctctcccaaatgcccctcgcacccaccaaccccccacccccaaccccagaaccattcccctctctcccaaatccctcagtgctacagcattcccagccccgccctgaaggatttcctccctgctcctcgcagcccaacacgtgatctcagaggccaaagggccctgcttccgcgtgctccgcgacggcggctgttcgctgcccattctgcggaacatcactaaacagatctgctgctgcagccgcgtaggcaaggcctggggccggggctgccagctctgcccacccttcggctcaggtgagcccctgcggcagtgcctagccctacgcgcaacacatgtggcgctcattctacgccccaccctccaaccctgagttcactgccccaacctgactggctgggctccagccttggccacgcagcagcctctgagacccgcaggcctcagactggacagcatccatggctccacctccatctgtagccacagccacccctccattcgtagccacagctaccccggagctcccaagttagtttttgtctcctgagcgtcaacgcccagtcccaccctgtccctgaactttgaccaagtccttggcttctgagacactgccttcagcttagccccaccccaggcatgcccctccctgagacacctccctggcattctatcttctgcttaaaactaaatctcacaagggagctatttcctagcctccaactctgtccctgtagacccaaccggaccctgccctcaaccctgttcctaccaccatcccaaatgtgggaaaacgctcttggccccacctgtagcctctaagacattctactctttggccaggacaccaccccatcccagcctccagctcaaacccctgacactctccagccaagccctgcccctagccaaggccagagtctgggctggccatcgttttcttcccgctctcttgtcctctctctgtctctcttacctattcccagagggtttccgggagatctgcccggctggtcctggttaccactactcggcctccgacctccgctacaacaccagacccctgggccaggagccaccccgagtgtcactcagccagcctcgtaccctgccagccacctctcggccatctgcaggtgagctggctctggcagaagtgggtgccatcttcaaggggctgccccagccccatagtgaaaggaggcaagagaggatttgggctccactcgttgataccccttctttatcaggctttctgcccacccatcgcctggagccccggcctgaaccccggcccgatccccggcccggccctgagcttcccttgcccagcatccctgcctggactggtcctgagattcctgaatcaggtttgctagaaagaactgagggcattgggcctgcagcagtggctcacgcctgtaatcccagcattttgggaggctgaggagggtggatcaccaggtcaggagttcgagaccagcctggccaacatggcgaaaccctgtctctactaaaactacaaaaattaactgggcgtggtggcagatgcctgtaatcccagctacttgggaggctgaggcaggagaatcacttgaacccaggaggcagaggttgcagtgagctgagatcgtgccattgcactccagcttgagcgacactccatctcaaaaaaaaaaaaaaaaaaagaattcagggcattgatgggggtattacaggtgggattctggggtaaaagactccaaggtgaagattccaggttacagcaaataggaatggtatgggcagagataagcgtttgaagggttgggtggtagttagatcaggagctggagtcacagttgggctcttctgtgtcaatcgagcaagccatttaacctctgagactcagttttctcattggtaaaatggggatggttgttgagatgcctctgaagtgtctgacacctagtaagtgctcagataaatacttatggtagataattatttttcattatctaatattagataattatttctcaggtagggcactaagaatgtatctcaggcggagggttggagagcaaactattcaaagccagagaccttggggtggcatgatgaggggattcggccaaggatctgatgagaacgttccaggataaaaaagatggagatcagaagaagactgggcttgcttggggaggagacatccatgaaggtgttttatggatgtctccgggggtgggggttttactgggatgaaaggaacggaggattcagagatgggggaaccctggctgactggaccccccaggtccctcctccggcatgtgtcagcgcaacccccaggtctgcggcccaggacgctgcatttcccggcccagcggctacacctgcgcttgcgactctggcttccggctcagcccccagggcacccgatgcattggtgagcaagacggagggcgcggaaggaggcggggcggggggctttgcctggtcaccttgtcaccagccccctccgtgtcctcagatgtggacgaatgtcgccgcgtgcccccgccctgtgctcccgggcgctgcgagaactcaccaggcagcttccgctgcgtgtgcggcccgggcttccgagccggcccacgggctgcggaatgcctgggtgagaaatttgccccacccggctccaggcccaccccagggtctcgctcctgctctcactccagagcctctccagccctcccacgcttcccctctcgggtcccgccccaggactgctctgccctggcccttggccctgcccttccctgacccgcctccacccagctccagcctccctttgaccccacccctacccagctcccaaactgccagtttctatcggggcctggtcgcaactcgtattgctccgcccccacgcccaggccccgcccttattggccacgcccctccctgactaactccctcccccaggccccgccactgtcctgcaactgcggcaaccaatctcctgaccgcgaccccgattccaaccctgccacaccagagccctatccccaaactgctcctttcttctctagcccctaccccaccttcccttagcttggtccccaaagctctcctttctgcccttgcgctaccaaaccctgccctccacaattgcctctctcactgtgcccctctccggctgtcctggccgggtccccatcctggctctggcccaagcttggtcccgctcccgcttccctctacccctgcctccttgcgtcgcttctcccggggctgtctgccccagtcccagccgcctggtctgtgcctacagatgtggacgagtgccaccgcgtgccgccgccgtgtgacctcgggcgctgcgagaacacgccaggcagcttcctgtgcgtgtgccccgccgggtaccaggctgcaccgcacggagccagctgccagggtgagggcctgggaggggcagctgggaaggggtgtgagcggttgggtagagcgcagtgatgagggccagagagactgaacaatagggcaaagcgagttgatttggagacagaggccaggctctcgagcagacgtgtggcctgatggcagtagagagagacctgggatgcagaggccaagtgatgggaaacagaaaggctgagtcatgaaagatggagaagcagaatgaggagggatggagatgtcagtaatcgggtaaggggagcagagttatggaggaaaggggagaaggaggccttctcatggggactacagagacagaaccagccaggcagcttagtagggattggtggaggatgcagagtcagatgatggtgacaaggaggaatagagatggggtcacggggacagaatgttggagggtggaaagccaaagtgacagaggtcagggaggcagaggggaacaagtgaccccgggccccctgccctgtgcagatgtggatgaatgcacccagagcccaggcctgtgtggccgaggggcctgcaagaacctgcctggctctttccgctgtgtttgcccggctggcttccggggctcggcgtgtgaagaggatgtggatgagtgtgcccaggagccgccgccctgtgggcccggccgctgtgacaacacggcaggctcctttcactgtgcctgccctgctggcttccgctcccgagggcccggggccccctgccaaggtgagggtgctgagcccagccctactccatcactgtttgctgtggagactggagagagattattgaggggcagagaggcagagtgatggggctcagggatggagaacaggggctgagggatggggacctcactccagagtcttctctcctttcaacaaaataaggcagtcctccccacccctcctccctttttgaaagatactcttgtgcttatgggaaccctgaggagggggtcacctgaggcagggcaggcaacatggagttggtgccttagcccccaccttagtagctggagagaccattgaatggggacacgaggaaggtgtctgtcttcctgggaagagggagcagcctgaggcaagtccagaaggcaggctcaagactggaatgctggggtgggtggtgatggccatgggaatggattcaggccccttcctcagcctcattggtcccctctgccccagatgtggatgagtgtgcccgaagccccccaccctgcacctacggccggtgtgagaacacagaaggcagcttccagtgtgtctgccccatgggcttccaacccaacactgctggctccgagtgcgagggtgaggccggggagggagggaggagtgtggatgggtgaggggggagttggaccacttcttcaaggccaccctctcccctgccccccagatgtggatgagtgtgagaaccacctcgcatgccctgggcaggagtgtgtgaactcgcccggctccttccagtgcaggacctgtccttctggccaccacctgcaccgtggcagatgcactggtgagaccaggccctggctgtgaccttgggcctgcatcatgacccccgacccttgacccagatcacaactatgacctggccgtaacctcctgacctggacctcagtccctcagtccccagagcctgtgactcctgaccctgacctggaccacaactcttgaccctgaatgtgactcctgagacccaacttgacagtaacatttgaccctaaccatcacccttgatgatagtccctgcccataccctgatagcaattgtgaccctcatgactctggccctgaatgtgacctataactcctgaatttgactgtgacatttgaccctaatcataaccactaaccatagcactgaccataaccttgactgtgtgactcttggtcctatctctttcacagcccctgcctcttctcagaatcccttctctggaacctggttgggttcataatccctgaccctggcccctgacttgaggcagaattctggaccctgactataacttctgatcctaactggattcagattccagtcactaactctgacccatggctcagccgaatcccatccaatgatcctagtttataatacttgactggtcccttgccctagttgatttctgatccctgtctgatccctctcctgactccaaaatcctggcacaggtagttcctagaaacctagacccacaggacttgcaaccatggtccccggaacccgagaaccttggtcagccctacccacctctgccatagagccctcccccagcctccaactcatgagacttcccaccacctcccccagacaccctactccaaggggattggtcgggtgtgtcccgagactggaccctttctgaacacccccaccccccacagatgtggacgaatgcagttcgggtgcccctccctgtggtccccacggccactgcactaacaccgaaggctccttccgctgcagctgcgcgccaggctaccgggcgccgtcgggtcggcccgggccctgcgcaggtgagcagcatagggacccgccagagagtctgggagtagggcctgggttccagggcaaagccggctggaaaggtggaggcgggaccaaggcgctgtgggaggagcttagaaacctggcattggtgggggcggggttactgcgatgtgggcggagcttgtctgggaggccgggtcccgtgactccgcccaatctcccgcgtaccctagacgtgaacgagtgcctggagggcgatttctgcttccctcacggcgagtgcctcaacactgacggctcctttgcctgtacttgtgcccctggctaccgacccggaccccgcggagcctcttgcctcggttcgtacccgggctgatcctggccccggaaagggtgggcttagggcaggaaaaggcgggacggggagaagagggcgaaaaggggaaaacgagtttttagccggggtattccagcaggatcagggggcagctggtgggagtctcgaggcagtgagggggggcggggcgtggagatgaaagggccgagtctgggtatttggaccgtgattgtaaagaagctgttctaaacccgtcggggggcggtgtttgcagggagggaagtagcgtgaggcaggttggggaaggcgtgagaggcctaggagagccgaggggcggtggaggggtgtggcctagaatgttaggcggagcgggaggtgggccgggccttcggacgccctgtcccgcagacgttgacgagtgcagcgaggaggacctttgccagagcggcatctgtaccaacaccgacggctccttcgagtgcatctgtcctccgggacaccgcgctggcccggacctcgcctcctgcctcggtgagaggccccgccccggcctgatccctcctcccttcgactccccgactcgccgattggcctcccacctctgtctttcctcctccgcttctcccctccccttacctctttcccccgcctcctctcctagcctccccaactctcctctaccccaatcttctcctgccctctcctctgcttccccggcctcccccttctgactctcctctcccctctttgtatcccccatcttgcctccctgcttcccacatccgaccacccgacctctctcctcagacgtggacgaatgtcgcgagcgaggcccagccctgtgcgggtcgcagcgctgtgagaactctcccggctcctaccgctgtgtccgggactgcgatcctgggtaccacgcgggccccgagggcacctgtgacggtgagcctgcccccacccgccttcgctagcgcttgcaacgcggtgctggaggctgctcccttggggactgaggaggggcgccctgcttcccagacttaggcggagggaaagaacaccctctcaccgtatctctgtagtggaaataagccgccaccgtgtccatgtattttcttgtgtcaggatcacggccaagcctcccttccagccgcagtccattccccctctgcagctgaagcccggtccacattttaggctatgcccccagtaagacaccgccccaaaactgttaggccccgccccttccaatcggcctctggattaaaaccccctcttcaggccccttctcttcctaacagaagtttggacgtgccctttccgcgccctccaccagtcctacttccagccttccctccaaagaggcccaatcccggtggccctaggccccattctttcccaatgagaaattcccaaggtgaaattctcctagcattggcccccgcccgtttaagctctgcccttccttggtctctctagacagggctttccattcgctcggatggctccagtctctcgaacacttaggccctcccttcctatctttgctccgcccacagacccgccccttgccttttcttactttccaggccttccctcccgccccgctctttcacccctcccgggtcaggctccagcgaggcaggagggtggggctaatcttccatacagtatatatttttttgtgtcggcgggggggggggggcggtgatggtgtgtgagtccgcatcttgtggaacacatgaaacaaaacatctgtgggctgccgttgactctgctagacctctgactcatggaaatctagcttcataagatctcattcattaattccacaagaattcactaagcacctactctatgccagcgtctggaaaaggtaataagagcaacaggaaataagtcatataaaaacccctgccttcctggagttattgtggggtaataaatatgtaaataaattcaagatttatacagcaggccaggagctgtggctcatgcctgtaatcccagcactttgggaggccaaggcggatggatcacgaggtcaggagatcgagactagcctggccaacatggtgaaaccccgtctctactaaaaatacaaaaattagctgggcatggtggcatgcgcctgtagtcccagctactcaggagactgaggcaggatactcgcttgaacccgggaggcggaggtggcagttgagccgagatcgcgccactgcactgcagcctcggcgacagagtgagattgtctcaaaaaaaaaatttatacaacaaaaaactggggggcaccttactatatgttgggcactggagatgtagcaaggaacaaaatagacacaaatccctgctattgtagagtttgtattctagagaggcgacagttggcataccaataaatacatacgtataacatcaggtttaggaaggaaaacaaagcaagacaaatgggacagagatgacagagcagtggatggaggagtgctaggagggcttgacctagacaccagacagaagcgagggaggcagccatgcagagagctgaggggagactgttcctggcagagggaagagccagtgcaaaggctctgaggcaggaccatgcttttgagaaatggcagtgaggacttgagagttatcaactatgctaggtgtggtggcacaagcttgtaatcccagctactcaggaggctaaggtgggagaactgcctgaacccgggaggttgaagctccagtgagccatgatcctgtcactacactccagcctgagcaacagagcaagaccccatttaaaaaaaagaaaaaaaagctggatggggtggctcatgcctataatcccagcactttggaaggctgaggcagctagattgcctgaggtcagaagttcatcaccagcctggccaatatgatgaaaccccatctctactaaagaaaaaaaaaaaagatagtggctgggcgtggtggctcacacctgtaatcctaggacttgaggaggccgaggtggacagatcgcttgaggtcaggagttcgagaccattctggtcaacatggtgaaatctcatctctactaaaaatacaaaaattagctaggcatgatggtgcatgcctgtagtcccagctgctctagaagctgaggtagaattgcttgaacctaggaggcaaaagttgcagtgagctgagattgagccactgcactccagcctgagtgaaagagcgagactccgtctcaaagaaaaaacaaagttttcaacattgttgatcttcagaagctcaggctcctagaataccagattgctaaagacttcttagtcttgggcaccggaagtggtgttagaacttctgaattcaggcctttgactcccctttcatctcctccacactctgcagatgtggatgagtgccaagaatatggtcccgagatttgtggagcccagcgttgtgagaacacccctggctcctaccgctgcacaccagcctgtgaccctggctatcagcccacgccagggggcggatgccagggtgggtgtccatcaggcatcgggtgagatgtggagatggtagaaggtccagaaatggcctgactgtctggtggttgcagatgtggacgaatgccggaaccggtccttctgcggtgcccacgccgtgtgccagaacctgcccggctccttccagtgcctctgtgaccaggttacgagggggcacgggatgggcgtcactgcgtgggtacgggacttcaggaggtggatgggaccaaagggggtgggggaggttggtcaggccctgtccctccccatatatctgaacaaatgggaattttcgggttgtggaatttagactttggaatataagatcatcttcatgccaggcacggtggctcacgcctgtaatcccagtactttgggaggccgaggcgggcagatcacttgaagtcaggagtttgaaaccagcctggtcaacatggtgaaaccccgtctctactaaaaatacaaaaattagccggatctggtggcaaatgcctgtaatcccagctactcaggaagctgaggcacaagaattgcctgaacccaagaggtggaggttgcagtgagccaagattgtgcaattgcactccagcctgggtgacagagtgagaccctgtctcaaaaaaaaaaaaaaaaaaaaaaaaatcagaactgttgtagtggctggtgacagaaacctgacttaatcaggttttatttttgtgtgtgttcttttaaaaatgtataaagtataaatgtataaagtactaatcttaagtgttcataaacattaatctttcctaacattttatgaggaaaatttctaaacacaaagcaaattgagagaatcatagaatgaacacctacctactcatgatctagattatattatcattttattacacttgcttcctcacatatctatccattaatccatctaattttttggacagagttaaaagtaaattgcaggcaccagtctgcttccccataaattcttcaatatgcatatcactaaccagaattcaatatgtgtttaccaatgtattcttctcttctctcttttttttttttactttgaggtggggtcttgctctgttgcccaggctggagtgtggttgtttgatcatagcttactgcagcctctaactcctgggctcaagccatcctccctccagaactgagcttccgagtagctgctaccacaggcacacgcaaccacgcccagctaatgtttttaatttttgtagagatgagttttttttttttttttggagacagagttttgctctagttgtccaggctggagtgcaatggcatgatcttggctcactgcaacctccacctcccgggttcaagcaattctcctgcctcagcctcccaagtagctgagattacaggtgcccaccactatgcccagctaattttttgtactttgagtagagatggagttttgccatgttggccaggctggtcttgaactcctgaccttaggtgatccgcccaccgtggcctcctaaagtgctgggattataagcatgagccaccacgcctggcctgtagagatgagttattgctctgttgcccagactggtctcaaactcctggctttaagcaaccctccctccttggcctcccaaagcactgggattacaggcatgagccattgtaccctacagatattttcattcaacgttcaatttatatacagtgaaatgcagcaatcttaattatacattctgtaaattttcacaaatgcaaacacaacaggttttatttctttaaagggaattaaaactataaagtcttgggatatatttgaactccaggcataactggatccaggaattttaacaaggctatttctatcttctctgagttctgctttcttctattgcatgattttcaggcagattatttttcacaatgatgaaggtggccctagaacctctgggctaacatctccagtgggccacccgagagctaaaaagggaggtttttttttcaatatttctagcaaaagcgccaggcctggctttgattgacccagcatgatcactgcctatgtctgaaccagagaaatgccgtcatctgtttggtcattcctggaacttgtgcccacctctcagagtagatatagccctactcaaagaacaggattgaaaatagaggagcacagggttcccaagggaaattcaaggtttctcactagaagaaaaacagatgatgggatctgggccattaaatatacacattatatttgaaagctgagactttcggacctttggaatcatagaagcttataaccactgagtccctctcccctgttgtctcctgcttacagatgtgaacgagtgtgaaacactacagggtgtatgtggagctgccctgtgtgaaaatgtcgaaggctccttcctctgtgtctgccccaacagcccggaagagtttgaccccatgactggacgctgtgttcccccacgaacttctgctggtgagactgatgtgtctatttaactgatggcggctggccccatgggaaaatcacgtggtctaatcattcctgatgtggacagctaccatcagctaaatactgttgttttaaacatcaacaaaagacacataagttaacatgggtagtgagactgtgtcaggagaattagaccctggtcctgactctaccagattctttcattcaacaaatgttcacagggtgtgcactgtgttcaggccatcttctgggcactgagaacatagtagtgaccagaagggatcactgtctgtcctcaaggggctcacaagccaatggggcagacagagatatcaccagatagtgacaacccagagaaatcaacaagactgtgacggggaaagcccaggggggttttggaggaggcgcctggcccagcatgagaagaggattagggagttcttcctgtaggagacgacatctgaactgagagctgtgggatgaatagaaatgagccaggcccgatgagtgaggagggcattctgggcagaggacacagcaagggcaaaggcctggcaaagccagagagcatctggcatgtgagaagaactgaaacaggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaaattttttttaaatgttttttttttaagacagggtcgtactttcacccaggccggagtgcagtggcgtgatctcagctcactgcaacctccacctcctgtgctcaaggaatcctccaacctcagcctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaaggcgggaggatcacctgaggtcaggagttcgagaccagcatggccaacatggcaaaaccctgtctctactaaaaatacaaaaattagctgggtgtagtggtgcacgcctgtaatcccagctattcgaaaggctgaggcaggaaaatcgcttgaatccaggaggcggaggttgtgggattgcaccactgcactccagcctgggtgagagaggaagactccgtcccaaaaaaaaaaaaaaaaaaaaagctatgtatttatttatttttaataatttccatctttactttagattcaggggatacatgtgcaggctttttacctgggtatatttcgtgatgctgagctttgggatacaaatgatcccgtcacccagatagtaagcacagtacccaacagccagtttttttttttctttgagacggagttttgctcttgttgcccaggctagagtgcagtggcgtgatctcagctcactgtaacctccacctccctggttcaagtgattctcctgcctcagcctcctgagtagctgggattacaggtgtccgccaccacgcccagctaattttttgtatttttagtacagacggggtttcatcatattggtcaggctggtctcgaactcctgacctcaggtcatccacctgcctcggcttcccaaagtgcagggattacaggcgtgagccaccatgctcggcccaacagccagtttttcaacccttgtacctctgtccctcccccatctagtggtccccagcaactattgtgggcatctttacatccatgagtacccactgtttagctctcacttgtaagtgagaacatgtggtatttggtcttctgtttctgcattaatttgcttaggataatggcctccagctgcatccatgttgctgctaaggacatgatttcattctttttcatggctgtgtagtattcatggaagggttctaagcaggaaagatagaatcagattttgaaacctccctctggccgccatgtgaaggtgattgaagcgggtgatatggaggctgggagctcagggaacaggctggggcaggggcctggacaggagagaacagggctggaccaaggcaggggctgtggaaggggaggagaaggtggtgggagaaaaacccaagaggccatgtggacaagctgtggatgtctgggtggggaagctgtgtccaagacaaggcataggttttttgtttgtttgttttgtgacagagtctcgctctgtcgcccaggctagaatgcagtggtgtgatctcggctcactgcaacttccgctcccgggttcaagcgattctcctgcctcagcctcccaagtagctgggattacaggcatgcgccaccacacccggctaattttttctatttttagtagagaccgggtttcaccatgttggtcaggctggtctcgaactcctgacctcaagtaatccaaccgcgtcggcctcctgaagtgctgggaggacaggcaggagccactgcacctggcgacaaattgtaggttttgagatgaagactcagccagtttgccacacactggataagagacccagagaggcatccaggaagccagggaagttccctcaccacccacccaagctgttagctgcagtgacgggaaagtgtgaggtggggaggcaagagatgcagaaatgacaggaggtgacagtgggagaaagagaaacagtgacagaggagcgtgagaggtgtggagtctggttctgccactgatggctgccaccctctgtttccctatctatgccagcctcagtttccccatctatgatagtggcggggctggggattcagcccacactgggctaaagctccttgtctccccaggcacgttcccaggctcgcagccccaggcacctgctagccccgttctgcccgccaggccacctccgccacccctgccccgccgacccagcacacctaggcagggccctgtggggagtgggcgccgggagtgctactttgacacagcggccccggatgcatgtgacaacatcctggctcggaatgtgacatggcaggagtgctgctgtactgtgggtgagggctggggcagcggctgccgcatccagcagtgcccgggcaccgagacaggtgggcatgggctgatggggacacagggctgagggcttgggtggaaatactgggtggggtgtgggcctgggacaggggacacttttggacagggccttgaggtactagtactgtcagggcaagggcgagctgccaggcaggtgggcatgggcagacataaggctgagaggtgggcactaacaggcacagggccagagggacttttgtgacaagtgggcacgagcaggtcagggctggggctggggctctggtgtcctggctcaggcttgtctctgtgtgtagctgagtaccagtcattgtgccctcacggccggggctacctggcgcccagtggagacctgagcctccggagaggtgaggccagcctttgaccctccaccccactcagctctgaggcccagcttcgtctcttcctgttttctttgcctctgtctctcaccctttctgtttctctgtatctgtctccccgaccccacccatactctgtctctttctttcttttctttcttttttttttttttcttaagatagagttttgttcttgtcgcccaggctggagagcaatggcgagatcttggctcactgcaacctttgtctcctgggttcaagcgattctcttgcctcagcctctggcgtagctggctacagacactagccactacgcctggctaatttttttgtatttttagtagagacagggtttcaccatgttggccagattggtctcgaactcctgacctcaagtgatccgcccaccttagcctcctgaagtgctgggatttcaggcatgagccaccgctcctggcctctccatctttctttccctgtctctacttcttggtctatcaccagctctgtctctgtcttcccacgtcatgccctcacacactccacccatccagcccgcccccatctctctctctgcttttcgcacagacgtggacgaatgtcagctcttccgagaccaggtgtgcaagagtggcgtgtgtgtgaacacggccccgggctactcatgctattgcagcaacggctactactaccacacacagcggctggagtgcatcggtacaagccccacctcccccaacccccggcaactctctccaacccctagccttgccagctcccctctggaatgtggccaccaccagcgggaagtctttcctggagtctagactccatccatcacactgccaatgtgctgggaagagaaatgggaaagggtggggagagttgaaggggatgcctcttaatcatcctctccctagacaatgacgagtgcgccgatgaggaaccggcctgtgagggcggccgctgtgtcaacactgtgggctcttatcactgtacctgcgagcccccactggtgctggatggctcgcagcgccgctgcgtctccaacgagagccagagcctcggtaaccccgcccacgccatccaggccctccttcccttggctcggcctcacacccgcacccgggccacacctttgcgacggccacgccctccgaaggccacgccccatgctcctggctcgaccacgccccactgagccctcactcagtctctgtcccactgtctgtctctctgaggcgagctggctaggtggttaaaggcaaaagttttagggcaacctttgcatgttgcctcttggactccaggtttctttctgcacactgggtgaatagcccctaccttatagggtggctgtgaggaattttatttaattttatttatttattttttgagacggagtttcgctcttgttgcccaggctagagcgcagtggcgccatctcagctcactgcaacctccacctccggggttcaaacgattctcctgcctcaggctcccgagtagctgggattacaggcatgtgctaccacgcccagctaattttgtatttttttctttagtagagacagggtttctccatgttggtcaggctggtctcgaactcccgacctcaggtgatccgcctgccttggcctcccaaagtgctaggattacaggtgtgagccaccacacctggctgatgaattttattttattttattttatttttaatttttaatttttagttttattatttattttttactaagtaccacatgagtgctgcctgttattatttatctgcatctctaggtctctgtctctttccagctgtttgtggatttctgtctttggggttttctctgaatttctgacaccctctggatctttgttttcaggtccctttctcctgcctctgtatctttgttttcctgttttgagtctttgactctttggatgtgtttctctctctctctttgggtcttttttctcccttttcgtttctgactattttcctatctctaggcccctaacaacttctgctgaagctctgtctcttgaacactctacttgtcgttgtttgttttcatttttgagacaagatctcgctctgtcatccaagctgaagtacagtggcacaatcacagctcactgcagcttccacctctcatgcccaaatgatcctcccacctcagacttgcagtagctgggagtccaggagcccgccaccaagcctggctaatttttgtatttatatatatatatatatatatatatatatatatatatatatatatatatatatatatatatatatttttttttttaaagatgggtttttgccatgttgcccaggctggtcttgaactcatgggctcaagcaacccccccacctcagcctcccaaagtgctgggattacaggctccaacacactctctctgtgcttcttgccacctctctttttgcccactgtcccaaccactcttctctcatttcctgtgccttcagcacttacccccatacagtgagatgtcagacaatgctcagagaagcaaagcaactgccccgaggccacacagccctccagaggccagacttgggtagacccctctcaggccctacctcccagtcattggacaccttcttctgccctctcctcctatatgacagtctccttgttcctcaatccagaaccctggagtgacctcagagaacttccagagttagatcacagctgatgagaaggatttgctgataggcagagggtgcctgggctgctcagcaggggaagggtccagcccctgggaggacctgagtgccaggcccactctgacacatgctgtctccacctacagatgacaatctgggagtgtgctggcaggaagtgggggctgacctcgtgtgcagccaccctcggctggaccgtcaggccacctacacagagtgctgctgcctgtatggagaggcctggggcatggactgcgccctctgccctgcgcaggactcaggtgctggcactggcctaggctgaactcagaggccttgccccatgggctccaaatctaggccctcagatccccagtcgcagaacccccagactctatccaaactctgtcccctagaccaacccctatgtcgcagcccatcccaaaatcttggtccccgattcacactccaaagacttccaagtctcagccacagacatcccaaggcctgacccagcagatcccatagtaccagacccacaggcccctgaggtctggtctctcatatgctcagctcctggtctctagaaccaccagacacagcctatgagatgtcctcccctaaatcctgggcccttagacctgaaatgccagttgctcagacctcaccatcctggccccagaccccctggtcacagccccacagacctccaagtcccattgccttagacaccctccaagtcccattgccttacacaccacatccgggtgcctaagaccccaacacacagccccagagattcccaagtcttggtttctacaacctctgagtccctcagtcctcagcccttaggaacccagttccaaagccccagtcctgggtcctcagacctccaggtcccagtgcctcagactgtctcccatgcatcctgccccctcaggtccccagcagcaatccctgggattccccagtcctggtccacagaacacccccatctaatttcttcaggtccctagtcctagctcccatgggtcgctccaattccagcctctcagaccctgattcttagcaggcttcattacccttgatctcagcacgtccgaatcccagtctcagccttcagattctcagcgctggctccagaaaccccggggccacccaggaccctccccatccagtcctctgcctcctctcccaaggggggtatgtgagtggtgggtgtgggggccagcaggggctgattgtttgccttggctcctgttcccagatgacttcgaggccctgtgcaatgtgctacgcccccccgcatatagccccccgcgaccaggtggctttggactcccctacgagtacggcccagacttaggtccaccttaccagggcctcccatatgggcctgagttgtacccaccacctgcgctaccctacgacccctacccaccgccacctgggcccttcgcccgccgggaggctccttatggggcaccccgcttcgacatgccagactttgaggacgatggtggcccctatggcgaatctgaggctcctgcgccacctggcccgggcacccgctggccctatcggtcccgggacacccgccgctccttcccagagcccgaggagcctcctgaaggtggaagctatgctggtgagcactgccagcgcatgatgagactgagatgaggggtgaggtgtgcacggagagaggagggagggaaacagaaggcgggaggagagacggaacacaggtgcaactggagagagccacagaaagggacagagaagtgtctatagcccggcaaagaaagagaaggtggcagagggaaagctggcgagagaatgaggtaagcttactggccccgcagcacccgccacagccctggagcgggatggacagtttacagcgagaaagatggagccaaggacgcgcacccaccgttgtgggtaaggggtgaaggcagggacctcaagtcatagggtccccgcatttcccacaggttccctggctgagccctacgaggagctggaggcggaggagtgcgggatcctggacggctgcaccaacggccgctgcgtgcgcgtccccgaaggcttcacctgccgttgcttcgacggctaccgcctggacatgacccgcatggcctgcgttggtgagggcgggcccggggccagcatgcgcagggagaggcgaggcttgtccagggagggtggaagccctgactagggggtgctggtcagggacgggaaaggacctcactacaggggacgggccagcgcaaaagggaggagtaattcttccacctgggtggggcttgactgaagaaggcggagtcagggtgccagcagggcagggcttaaccacggggctggagccgggccttgaagcaggatagaggaatagaatagtgctggtgtgacttgcagtgctaccttgggcagtctgcaggacctctttggagagcctcagtcttcccacctgtaaaatgggaatattaatcaagtctgcctaatttggatggcagtaaagccaagtgattaaaatcaagaacatagccgggcgcagtggctcacgcctgtaatcccagcactttgggaggccgaggcgggcggatcattaggtcaggagtttgagaccagcctggccaatatggtgaaaccccgtctctaaaaatacaaaattagccgggtgtggtggtgcatgcgtgtaatcccagctactcgggaggaacccaggaggcagaggttgtggtgagccaagatcgcgccattgcactccagcctgggcaataagagcaaaactccgtctcaaaaaacaaacaaaactcgaggaggtcacatagacctcagactcagtccagcaacttgctgtgtgacgctggacaggtcactgtcccttacctaatttttctgatatgaaaaatggctacagtcaaagatcccatttcatagaattgcgaatattattaacactgatttacaataacattgagagtcatgtgcaaatggaggcacatgcgtaaaacgaattacagtacctacctaataggggtattagaaggacaaagttaatacttgtaatgtgcttaaaacaatgcatgaacatttattgttgttgacaccatcatcagtatttttttcttcttttttttttcttttcttggcgacagagactcactctgtcgcccaggctggagtgcagtggcctgatctcggctcacagcaacctcctcctcccaggttcaagcgattctcctgcctcagcctctcgagtagctgggattacaggcgcccgccaccatgcctggctaatttttgtattcttagtagagacggggtctcaccatgttggccaggttcgtctcgaactccggcctcaagtgatccacccgcctcagcctcccaaagtgctgagattacaggcatgagccaccgcgcccggccattattattttcttaacaaaatcctagtgcggtatgggccaccatatccatcttacagaacacgaaactgaagcacagtgaggttaagccacctggccgggctcacacagttagcagatggcagaggccagattggactccaaactgctcagcatctgtgctcctctgttccaagaacttaaggggccaaggaggcgagcttctggggccccagccttcagcagcgatcgttgtctcccctccgcagacatcaacgagtgtgatgaggccgaggctgcctccccgctgtgcgtcaacgcgcgttgcctcaacacggatggctccttccgctgcatctgccgcccgggattcgcacccacgcaccagccgcaccactgtgcgcccgcacggccccgggcctgagccctggcacccgctggccgcccacccgcgcccgccactcggggcccctgccgcgcatcctgcagcccgcttatgcgtatgtgcacggggccgcccgcctggacctggagaagggacctacggacgcctggaagctgcgacgccctgcactgctcccgcctccaccagcgcctcccactgatgtcgtggtcccgggcctggcccaggggcccctttacatgccctctcccttttataaaattttccattaaaaaccacctattttctatc

SEQ ID NO: 2705 - DNA, 79780 bp, Homo sapiens
cggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgtgggcagactgctttgtatagtgcttgaacctaacaagtatccagtaattaggaataatgatctgacatgctgtttgtttgtttgtgtgtttttgcgagacgagtcttgctgtgatgcccagactggagtgcaatggcgcaatctccgcacactgcaacctccgcttcccgggctcaagtgattctcctgcctcagcctctgaagtagctgggattacaggcacgcaccaccacgcctggctaagttttgttttgttttttttttgagacggagtttagctcttgttgcccaggctggagtgcaatggcgtgatcttggctcactgcaacctctgcctcccaggttcaagcaattctcctgcctcaatctcccgagtagctgggattacaggcatgcaacaccatgcctggctaatttaacgtttttagtagagaccgggtttctccatgttggtcaagctggtcttgaactccgacctcaggtgatcctcccacctcggcctcccaaagtgctgggattgcaggcgtgagccaccgcacccggccatgcctggctaagttttgttatttttagtagagatggggtttcaccatattggccaggttggtctcgaactcctgacctcaggtgatccgctggcctcggcctcccaaagtgcggtgattacaggtgtgagctaccatcccctgctgacataatgctgtttgattaatattataatggtagagcccaactccaatgtagctttctctgaccaggctcatcttcaaggtgaaaataagtgctgctctctctacattcccatgcctcagtgacattttatttattttatttatttattttgagacaaagacttactctgtcgcccaggctggagtacagtgacacaacctcagctcactgcaacctctgcctcccgggttcaagcacttctcctgcctcagcttccctagtagctgggattacataattacttcatctggttgtaagaatccaacattggaggccaatcacagaacagtgcgattctgacaccacaggtgtgaggccactgcacccatcttagagcgtattatgtagtttacattcaacaagcatctgagagcacctactgggtgccctgaagtctgctaggtgctggtgatagaaagatgctcacggtttggttcccattctcaaggtttttttttttttttttttccggaaaccatagcaggctccctgactgaggttgtggtacatgaaagatttcctggagtcctgatctgagctaagtcttaaagaacaaggagggttgtcaagataagagcctgtgttttaggcaggggacatagcagtgtcacaaaggcaccctacagtgtggtagaaatggaagctaaaagtagtttggtgtttttagagtgtgagacccaaagtggtgggtagggacaggttgctggtgaagtccaagtcaggaggggctcctaggaagccccactgtaagcttttacttaatcctctgggtggtgcagactcactgaagagtttcaaatgacaggaagggtgacatggttagctttgggctttatgtgtagatcagtaattactgtataaactatggttggcacaaaatacagggcagaagaccacttagaaggcagtttttagtagtttaggtgagaggtgaaagtggccttgctgatagggatggcaggaagcacacagatgtgagaaatagatttaggtggtagaattgggaggtctgtgtatgggagcttaaggaaagccaggaataaccagagcagctgacactgaaggggctaggcactgttctcagagctgcagttgtattatctcattgagtcctcacaacacatctgagatcaaggacccattaccatccctgttttacagatgggaaaactgagtaaaaggaagaaaagtactggcccatccaaggccccagtagttagtggtacggccgggacccaggcatctgactccagagcccatgttctcagccacctcactatggaccactctcatggaaatagcaaggatatgaagatgaggcttctggcttgagtgactgggtgggtggctggtggactccggagacagcacacagaagcaggcagacatgtagggtttatggatatctgagagaaaacggctggtgggcagtacagtagagaagactcaggtggatcaggaagaaatctgcaccagaaagagtgatttgaaaaataacagcagattttggtagaaactgaaagaggcattgagttggtttatggagctatacagagtggaaagataagtaattctgagatggaagcttggggacagccacacctaagagggcccaaattgagactagaatgtgtagcacgagaggagagcaaagcaaggaaggtgtgatctgtggactgatagtgatgaaatgataattgtatgtgtatgggttttttttttttttttttttttttttttgaggcagtctcactgttacccttgccggaatgcagtgggcatgatcatggctcactgtagccttaacttcctgggctcagggtattctcccacttaagcctcccagtagttgggactacaggtgcacgccaccacacctggctaattttttgtattttttgtagagactgggtttcatgattgttgctcaggctggtcttgaactttctgggctcaattatatgttttttttgtttgtttttttgagatggagtctcacttgtcgcccaggccggagtgcagtggtgagatcttggctcactgcaacctccgcctcctgggttcaagtgattctcctgtctcagcctcccaagtagctaggattacaggcgtgtgccaccacacccggctaatttttgtatttttagtagagatggggtttcaccatgttggctaggctggtctcgaacttctgacctcaagtgatccacccacctcagcctcccaagctgctgggtttacaggtgtgagccaccgtgcccagcctcaactgtatttttttttttttttgagacagagtctcgctctgttgcccaggctggagtgcagtggcgcgatcttggctcactgcaagctctgcctcccgggttcacaccattctcctgcctcagcctccctagtagctgggactacaggcgcccaccaccacgcctggctaatttttttgtattttttagtagagatggggtttcaccgtattagccaggatggtctcgatctcctgacctcgtgatctgcctgccttggcctcccaaagtgctgggattacaggcgtgagccaccacgcgtggccctcaactgtacgtttttatccatgtcctcgttttatatgggattcccacattcttgctgaggttcacacagttgttgagccaggatttgaatcaaagattgaatccagcctgaattatttcagagccttactgttaaccattgtgtggtacagcttctcagcacataatgagatccctgaagaagcaggatggaatgggtcaaggatacagggttagcctagaatgggaagtgggccagctcattttcttggaggagaaggtagtaagatagagagtgtgctgtggatggttggtaggaggtgttgaggggagattacttctgttgtacctagtcttggtgaaggtggcaaggttatttgcagagattaatggttaaattagatgtttgatgtgtgaagaaatactttgagagcagtatggaatctgtaatcttactggtggctattaggggattatattatcctgtctttgaggctctgctctgctgatgttcagccttaggggtgaaataattcctctgttccagtccccactcatctctccacctctctgagttctttttttttttttttgagacagagtctcactctgttgcccaggctggagtgcagtggcacgacctgggctcaatgcagcgtctgcctcccaggttcaagcgattctcctgcctcagcctcccgagtagctggaattacaggcgtgtgccaccacgtccggctaattttgtatttttagtagagatggggtttcaccatgttggtcaggctggttttgaactctggacctcaggtgatctgcctgcctcggcctcccaaagtgctgggattacaagcgtgagccaccgcacctggccatagtctatctatgttttttaaaagttcatttcaagcattcttaattgtgtctgatttttgcacaagtttgattttttttttaagttttctcatgaggttgcaatttttgttgttttttgagagagggcctctctgtgttgtccaggctagtcttgagctcctggcctcaagcagtgatcctcctgctttggcgtcccaaattgctgggattacagatgtgagctactgtgccaggctgcactggtctactttttttttttttttttttttttttgagacggagtcttgctctgttgcccaggctggagtacagtggtgcaatcgcagctcactgcaacctccgcctcccctgttgaagtgattctcctgcctcagcctcctgggtagctgggattacaggcacacaccaccacacctggcttatttttgtatttttagtagagatggcatttcaccatgttggccaggttggtctcaaactcctgacctcaggtgatcctcctgcctcggcctcccaaagtgctgggattacaggtgtgagccaccgtgccctgcccacactggtctagttttaaaccactggaagacagagatttaatcctttaaactacttgtgtatttccccaaatgcttatagttgggcacatgctaagtatttagtcaattcttgccactgttaatcagtcatttgttagcagttacaaatttgcatagaagaagaaagcatggatttttttgttgacagtgaattttctttataaacacaagggggtgctctttaaccatcaatgaccagtttaaaaaaagtttaaagtcattttaaagccttagaaggaagcctgcataaggcaaattgctacaggaacagtaatacattttagggctgtgcacagtgtttcatgcctgtaatctcagcactttgggaggctgaggcaggcggatcacgaggtcaagagattgagaccatcctggcaaacgtggtgaaaccctgtctctactaaaaatacaaaaattagctgttgtggtggtgcgtgcttgtagtcccagctacttgggaggctgaggcaggaggagaatcatttgaacccaggaggcggaggttgcaatgagccgagatcatgccactgcactccagcctggtgacagagcaagactgtctcaaaaaaaaaaaaaaaaaaaaatttaggtggtaggtattttagctatcctttaaaatttaaagattctttttaagatttattttccctaaaaatacaagacttaaaaaaatatgtgtattattcctaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtaagtttcttattataaaatctgctgtgggaattaaacaaattaaggtgctagttgtatatactttcaaatcccaaagcaatctgagagcattcaaatatcaaattctgagctttttcccaagaaaatgtataagctgttctattgtttaggcttagtatattgtgtgaatgtgttgctagagaggtccagtctgttgcatctgctgtagttgttggtgacttgctgtctgctggcttcttctctgggcatatgttccctcagccaggtttcgtctttggtgttttgtcttccttccagaatctttgcacataactttaatccatgttattgcaaatgttttcttccgaaaacttaacaagttggtgattaatttctgtggcagcggcatttttttgttagaaatatcaaactacagcttgtgttttgtcttaagaaaagcacacctgatcttgatctatgtctgtctgtctgtttctcacagtcacattgaccatgttgccatggataactagagaaaaatcactgtagtcgtaagtcaaatgaggcatatccagcctcatttagtttcactgccaaatctatgcggaggtgaaaggataaattctttgtcaatatctgcaacctttcagacatagttccctgcattctggaaaagcttaacaaatcttgataaatgtgaaatagtcatagatgagctactagttttttaaatgaaaggccccagtatgttacatgagaggttagaatttgggttgggtagttttttttttttgcacctttttttatttgagatggagttttgctcttgtcgcccaggctggagtgcaattgtgcgatcttggctcatggcaacctctgcctcctgggttcaagtgattctcctgcctcagcctcccaagtagctaggattacaggcactcaccaccatgctgggctaattttttgtatttttagtagagatggggtttcaccatgttggtcaggctggtcttgaacccctgacctcaggtaatccacctgcctcggcctcccaaagtggtgggattacaggtgtgagccactgcacctggcctgttttttacacttttctttctttctttctttcttttttgagatggagtctcactctgtcgcccaggctggagtgcagtggcatgatcttggctcactgcaacctccgcctccctggtttaagcagttttctgcctcagcctcccgtttttacacttttctatttcatatgtgcatctgttcaaatatgggcttggaaggatggatcatctgtgcatttgtcctgttttctttttcctagtcccttctattttttaacttgaggtattgggacactttccatttggacataagtcttcattttcttatctgtagtaaccacatttattttatgccaggtgtcccttgaacttgtagagttagagggtttgttaaaactgaagtgtgaggccagttgattgtgtaatgcgtgtgcatggggccatgttgaccgccttgcaggccgtgtttggctggtccttgcaggttttatagttactttagactctgcagggttccatttgatcaattggttgcatgttcacctgtggatttcttactttttagatgggatttttccttgggtggctgcattctttgaaacaccaaaggaacacatttctctgtgagtgttatttcggtattcaggctgctagacaacagcaaagagggtctatcaagtgaaaatgtccttttgttcaggagaaagcatgtgcaatttggaagttgtcttttgaccatgatcacaaagcttctcccgaaaagatggtattttgtgcagtagaacttagccatttccaatacctcaacttactggaatacaacctggaggccccagagcaacactgataattccactgagtggatcaccagttcattgtctaagcctgaatggaaggtcacttggtctgtaaccttttcttttgtccttaaattcagataaagtttcacaccgcaatctgtggaaaaatgatctcaacaggacttgtttatcttctttatcttaacatatcaatcaaaaggaggggggtaaaaagcccttgtatttaaacatgacctttgggtcaatttaaaaaactggttttgcttgtccctgtagcttatttggattttaatagatttagcagtatagaaacaacttgctaagttattttttttatgagaactatgaaatgtgtatatgttcgtggattacagaaaacatttgttgaatggcttttactttttagctaaacacattttattttggctgcagaacgtgacggtctcataacttatattttctacacattgaaacctgcaacttttcttttgtcttctagccatagggcccaaagaacctgttgtaccagtttgaaacatgctttgagcatgcccagagagactgttcattaagatttatttagacatcagggcagtgattcacagtttgcaaaactcaaacccagccaatttctttctttctgcaggtgtgtctgacttgctgctccagggatgtcatagttaaagttgaccagatctgtcacaaaaatagcatcaagttctttacaggagatgtttttggctaccatggatacacatttgccaatctaggagagcatgagtttgtagagtaagtgttgggagaggaggggagaacataacattttctcctttttatactttttttttttaaattatgtatttatttatgtgtagagacaggatctatgctatgttgttcaagctggtcttgaactcctgggctcaagtgatcctcccaccttggcctcccaaagtgctgggattataggcatgatccactgcgcctggtctgctgacatgttttcaagttgagagatagtaaaatgattacaaaatagttgggcgattctggaggcatattcaaccaaagtctaccttggaaaaggtgtccaatatccagagagactcctctggtagaacaaacagacctcatcctctcattttgaacactgaggctgcagaacttggtaattcttacatgacaggacttgccgtgttttgactttgtagtctctaggtgaaagatggcagatgatacattattgtaaaactatatgagttaggtattttggctgcagtttctgaccaccccctccaaaaccctccaacttgctaattgagagggaaagacaggctctgtgagataggagcttcctaccaagagactgagaactcttctcttgttcagcctctcaggcaagtcactgaaatttctctggtctccaagtttcttgcctgtaaaatcaagatgggggaaggacagtcatgttccagacatctcctaactctagtgttttatggctttaggataatctagttctttgggcatattattattattattattttattttttgagacggagttttgctgttgttgcccaggctggagtgcaatggcaccatctcagttcagaacaatctctgcctcctgggttcaagccattctcctgcctcagcctccggagtagctgagattacaggcatgcgtcaccatgcctggctaattttgtatttttagtagagacagggtttttccatgttggtcaggctggtcttgaactccggacctcaggtgatccacccacctcggcctcccaaagtgctgggattacacaggcgtgagccaccgcacccggctattattattatttttgagacggagttttgcttttgtcacccaggctggagtgccatggcacgatcttggctcactgcaacctccacctcctggattcaagtggttctcctgcttcagcttcctgagtagctgggactgcaggcacccgccaccatgcccggcaaatttttgtatttttagcagagacggggtttcactatgttggctatgctggtcttgaactcctgacctcaggtggtccacccacctcagcttcacaaagtactaggattacagccaccatgcctggcttctttgggtatattataaagaagttatagtagtgggaagcaatccagattattttaacataagctgcccacagcagaggggcagaattaagtttggcttttttttttttttttttttttttttttttctgagacagactttcactcagttgcccaggctggagtacagtggcgtgatctcagctcattgcaacctcctcctcctggggtcaaccaattctcctgcctcagcctcccaagtagctgggattacaggcgcccaccaccacgcccggctagttttttgtatttttagtagagacggggttttgctatgttggccaggatggtctcaaacccttgacctcaggtgacacgcccgccttggcctcccacagtgctgggattacaggcgtgagccactgcacccagccaagtttggctatttatttcatgattcaagtagagtgtttacaaagtaatcactttgatttattgagagcagctgtgtgcccagcagtgtgctgagcaacttacgctgctctgtttttcccacaataatttcctgagtgcccaacagtgtaccagactcatcatgttatcaatggcagagctcgatttgaaccgagatctgactccaaagcttttgcccttaaccaccatcccgatctgtgacctggagaggctttttttgattccaataacatgattcctagggtaaaattacattctctccccttgtcaccctctagggagaaaactaaagttgccaaagttagccaaggagtagaagatgggcccgacaccaagagagcaaaacttgattcttctgagacaacgatggtcaaaaaggtatgtgtaacgtgggggcagaggtcagaaaccctggggccttggaggggtcaggcaatgacgattgaaaaggataagagcaagcacttcttgaaggggtggggcgggtgcttgtcccatctaaagggaggctgccacagcttagtgtcagccagctgttgctgtgagggaatgtgggcccagtgattccagatgggatttttcaagacaatgagaaatgcaaacttttgtaggctctgtcccaaacttttttttttgtgtgtgtgagatggaattttttcttgtcgctcaggctggagtgcaatggcatgatctcggctcactacagcctccacctcctgggttcaagcaattctcctgcctcatcctcccaagtagcacccctggctaatttttttttgtatttttagtagagacggggtttcaccatgttggccaggctggtctcgaactcctgacctcaggtgatccacccgcctcagcctcccaaagtgctgggattacaggcgtgagccaccatgcccggccccataccctttttttttttttttttgagatggagtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagacggggttccaccatgttggccaggatggtatttatctcttgacctcgtggtccacctgcctcagccccacaaagtgctgggattacaggcatgagccaccatgcccgaccagaaaacttttttttttaaagcagcaaaacaccagccctgggttacagtagcaagaccccgtgtctacaaaaaaaatgtaaaaatttgtctggcgtgatggtgagcacctgtaggcccagctactcataggctgagctgggaggattgtttgagcctgggaggtggaggctgcagtgagccatggtcacaccactgcaccccaacctgggccacctagcaagatcctgtctaaaaaaaaaaaaagcaaaacaaaaaattttttgtattttctctactaacaatacaaaaattagctgggcaaggtggtgcgttgcttgtagtcccagctacttgggaggctgaggcaggagaatagcttgaactggggaggcggatgttgcagtgagccgagacggcaacactgcactccagcctggcgacagaacgagactctgtctccaaaaaaaaaagttttctttgcctgtttttttccttttgccaaataacctttaataagaaaaatccttcaatgttgtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagatggggttccaccatgttggccaggatggtatgaatcctcagattcatatttgttaatgtagtttatattaggggctcagcctctatttggattaggtgcaataattacatttatagaaaggagtggagaagggatcagaagacgatggtttctgtagctagtgctggaatctgagatgggaaccatgcgatggggaaagcaagatgaaggggccagaattggtttcattgaactgagaggaaagacatgaccaagcccatatttactctttgctttgtagatttaaatgttgagaaagaaaaacagctggtcagaatgttgagttaaattacgctaacgaggggattctaaagagtgcagaaaccacaaaagagactgcagaaaaccacaaaagtggaactctcagactctccagcaaggcggcgttggagattttctttctcattttgtgtttgtgttggagtagtttggtgctgtaagtgtgatacagaggaattaagccctaattttagtgtctattcacagaaccataattatccagagtgaaccttggtgttttggccaaaacttgggtgcctttctttctttttgaggcccagtcaagatttatctgaatagctccgtgaatttggtggggggagataaattgttaacaaacggaggagtacaaaagctgctttgtgggtgctgtcagtttataaatcacaccctcttacaagtgtgacacttggccttggtgtgaagggttttatggcttaagggccttctctgattgaggcaggtctttcacattcaaatggagagagtgcctagctttgttagccattcacagctggaagtttccctggagtcagttctgatggtgcccactggggtggatctggaaacctcttttgggaaccactttatctcgctatgaggagaatgtgggcagcccaggcctttgcccaccattccggagggccctacaggcacagaggtttttgtgcagcctcttcctacgtggagctgagctggaaggtatcaaaatattccccagctgacattgttagtcagctgttacacttgaacaatgcaggctcggattccaaccccaagcccttaaggttacgaggcattcagtgcattcctgctgacaatccctgggattccaaaccttgcctttgtgcagcctcaccaagggccctgcggaccgactgggctggactgggttttggccatggctttgtcaccttgcaataacatgcctccttccgttttggcacagatggccctgtgatttcaaggttctcttccaacaccaaagattccttgattcagatgctgcccttttgcctaattgtacagaataactagttgggttgtgctcagagagtgcagggtgggggtggggaagcagctacttcctgtttcctgtgaaaggttttctggttagggttcccttcccctccccgctttccctaggtttaaccaaaggttgtaaagccacttttgcttcaaggtacactttgtgctcctaaattagtaacgttgaaaaacaaaaaggaaaaacagcctgtggttttcacaccctctaggaagctggtgggcctttctagcacctgtgccattctgataaataagggcttaggaaaatgcctagcccagaaataggtgctcagtagtttgtttgcttcctttggtgctcaggagaagatttgagacggatttcgtcacaatcaggtctcgggcacaagcctcacatggacactgacatgcaggagccagaggagacagcaatgaggtggtggtaaggaagtgcccaaaaaggtttcccagaggaagagttgtttgtgttggcatgtgagggacaagctttccaggcaccagagccaagagcagtgctctgtccgaggaagtaggataaaccgaaagacggacgtaggggcagagttgctgtggctgccctcactgccgcagccagctccttccatgagttgcagaatgcctactgtgtgcaaggcactgtgttgagtgcagggaatcacatccagtcttgttgtccccatctatagctgataaagaagctatgagaaattaagtgacctgaccaaggccacacagctgtggaagaaggggcgagagcatagacagtgggtaagggcataggctcaccctatgatttacaaagagggatacccctgaagttgctagggtaacgtgacatattaggaggatggtgggataaaatatgtgaacatcgggatcattctggaaaacctttaggataaaaggccactgtcatgctcccatgttcacgtttctttattgtgagttatctgtgttaggtgctgccagagatgatgagatgcctgacagtggttactctgtaatagctctttaaaaattaaagacaaagtagggtttgttcctgactgtactagaaatacagatttaattttacctctgctcctgaaataggtgactaatttggagtactattaatactcttttcatgaattagttgagaaattccacagttgaggagtgattcattcttttgactccctctttctgagcaatttgttgacagccttctcatcctctcttacacccgtcattaaagaaacagtcgagttctttttctttcatgtggtaccttggtttccactgctggtggcccttaggttgcttgtctctgtctccccgcttccattttaagctccatagggggaaggtagtcttgttcactgctagactcctagtccagtgtgtagcacagtcatatccacggaatatttgttcagtgtactggtggctgttaactgcagcataatccagcaaccctggagattattttcttcctttttttttttttttctttgaagcagggtctgactactctgtcacctaggctgaagtgcagtggttcaaacactgctcactgcagcctcccaagtagctggaattacagacatccactacacctggctaatttttaatttttaaaaattattattatttctgagatggagtcttgctgtgtcacccaggctggagtgcagtggcacaatctcagctcactgcagcctctgcctcctgggttcaagcaattctcctgcctcagcttccggagtagctggaactgccagtgtgtgccaccacactcgactggtttttgtatttttagtagagacggtatttctccatattggccaggctggtctcgaactcctggcctcaagtgatccgcccactttggcctcccaaagtactgggattataggcgtgagccacagcttccagcctgattgtttccattttaaaaaagagtaattgaagtaacctttgttaccaatgaaatgaattaaccttctagtatattaattctcacggtttaggttatttgaactaagctgagagaacagaataccaaagaagacaatagacttgcccagaaatatttagaagtaagtcactcagttgcctggattggaaccctcaggccagagaggttcaaaatcctgcatttttttttttttttttttttttttgagacagagtctcactctatcacccaagctggagtgcaatggtgcgatctcggctcactgcaacctccgcctcccgggtttaagcgattctcctgcgttagccttccgagtagctggaactacaggtgcgcgccaccacgcccagctaattttttttttttttttttttttttgagatggactctcgctctgtcgcccaggctggagtgcagtggtgcgatctcagctcactgcaagctccacctcctgggttcatgccgttctcctgcctcagcctcccgagtagctgggactacagatgcccgccgccatgcccgactaatttttttgtatttctagtagagatggggtttcaccgtgttagccaggatggtctcgatctcctgacctcgtgatccgcccacctcggcctcccaaagtgctgggattacaggcgtgagccaccgtgcccagcctaatttttgtatttttagtagaaacggggtttcaccatgttgaccaggatggtctcaatctcctgaccttgtgatccacccgcctcagcctcccaaagtgctgggattacaggcgtgagccaccactcctggccaatcctgctaattattaatatcagaactacttggttcaaaggagtggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtggcacaaacacagctcactgcagccttgaactcctgggctaaagggatcctcccacccacctcagtctccaaggtagctgggaccacaggcatgtgccaccatgctctgctaattttttcgggtttttttttttttttgagatctcttgctgtgttgcccaggctgatctcaaactcctggcctcaagtgatcctcttgccttggcctctcaaagtgctgagattataggcatgagccaccgtacccagcctatattttttttattgtgacatttaatgcacaaaagaagatatgcagcatcaatgcagataatggaacaaaacaaacactatccgccttaaaaacacaaatatttttggtacttttgtaccaatctgtatgctgtttctctatcttctacttcttctccctgtaccctcaccaggtaagtaaccccagagctgctggtacatttgtgtggattaaaaaagacacctggaaggggcagatacagccctgcttgacttcctgttttatcacgtgtttataaatctaaacaatgacatggaacttattatacaatattttaggcataaattaagaatgatttcgctcaccatcatagacctaccactcaatttgaagcatcaaacattactggtatggtgaggccctctggctgtccctccaacagaagttaccaccctcctcagttgggtttctcattcctatgcatttcttcttactacttatgtatgtatttccaagcaacacatagaattgctttgcatgctttttatcttcttaaaaattggttttatattgtatgcatggtgccacctgcttttaaggagaagcaacacgtttgtgaggccatctgtttatatgttgttctagggctttgctgtccattttggtagccactagccacagctggctgtttaaattaattaaaatcaaatcaaatcaaatatttagttcctcagtctcactggtcacatttcaagtggccagtaagcacatgtggccattggcatctgtattgcatagcacagattacattctgttccatcatcacagctagttctcttggacagccctgcagggcatttctttttggtttttgttttgtttttatttttgttttttgctagagtctttgttgtgtaaatacattactattttatatccatttttctatttataagcatttgggtatgctcataatttgctgttacaaattgtgctgcataagcattttgtttgtgtgtgtatagatgatctccttgggcaattgtgttaatttctcttgggtatatacctgggagtaaaattaagataagggcattttcagctttaccagaccccgttaagttactctcaagtggttttatcaatttatattctagaaccaacattatgtatcagtaacatttggtaacttcaggcgttttttttccattctgctgagtgtgaaaaatgtgttttgattatggttgtcatttgttagaatactttgttaaagctttttaaagattcttggtccctctaccctccccaccccctaccccaggaattttgattgggtaggacctggggattatattcatctttatatgcagaattatattacttgttactgttaggcctgatttaagaagtaaaataaggctgggtgcagtggctcatgcctgtaatcccagcactttgggaagccaaagtgggcacatcacttgagcccaggagtttgagaccagcctgggcaatgtggctaaaaccccttctctaccaaaaatacaaaaattagctgggcgtggtagcacgtgccagtggtctcagctactggggaagctgaggcgggaggattgcctgagcctggcaagtgtaggcagcagtgagctgagattgtgccactgtagtacatcctgggtgacagagcaacacactgtctcaaaaaaaaatttttttttaagtaaaataagttcataattccaaatgtggaaaatgcagaacaagttaatgaaatgttaatcctactaccaaatgataactataaccttcctttcagtatttttctatgtatatacaacaaaattggggcactgtttaatacagataatatatatagttagctctccttattaatgggcttcacattcatggattcaaccaactgtggatcaaaaatctttagtgtgcttggagtacatccaaaaaaaaaaaaagaaaattgaaattatgttaataataaaatatttgggaaaaaacattgcgtctatctgtaccaaacatgtacagactttttttcttgtcattattccctaagcaatacaatataacaactgtttacatagcaattccattaggtattataagtaatctagagatgatttaaagtatatgggaggccaggcgcagtgcctcacgcctgaaatcccagcactttgggaggccaaggcgggtggatcacttgaggtcaggagttggagaccagcctggccaacatggtgaaaccccatctctaacagaaatacaaaattagctgggcatggtggctcacacctgtaatcccagctactcaggaggctgaggcaggagaatcacttgaacttgggaggcagaggttgcagtgagccaagatcgcaccgttgcactccagcctgggcgacagagcaagactctatctcaaaaataaataaataaataaagtatatgggaggatgcacgtagagtatatgcaagtactgtgccatttatttatttagagacagagtcttgctttattgcccaggctggagcgcagtggcgtgatctccgtctcccaggttcaagtgatcctctggcctcagcctcccgagtagctgggattacaggcttgtgctaccacacccggctaagttttgtattttaagtagagggcgttttcaccttgttcgccaggctggtctcgaactcctgacctcaggtgatccgcccacatcggcctcccaaagttttgggattacaggcgtgagccattgcacctggcttgtatatgtgtatatatatgtacatggttttgtcttttgcttttttcactcaataagcattccccaaatctgctttggagcacatgattttattttatttttatttttttatttttttgagacgaagtctcgatctgtcgcccaggctggagtgcagtggcgcaatctcggctcactgcaagctctgcctcctgggttcacgccattctcctgcctcagcctcccgagtagctgggactacagacacccgccaccacacccggctaattttttgtatttttagtagagacgggtttcaccgtgttagctaggatggtctccatctgctgacctcgtgatccgcccgccttggcctcccaaagtgctgggattacaggcatgagccaccacgtctggcctggagcgcgtgattttaaatgtctgtgtcatttttcctcttcttgcctagccataatctattttaccagtcacctattgtattgaggttattgaggttattgcagtttcctactatgctaaatggctcctgacaacaaatttgatggttgatgggctatgtggagaattcacctttttttttttttttttttttttttttgagacagagtctttctctgtcacccaggcgggagtgcagtggcatgatctcagctcactgcaacctctgcctcccaggttcaagcgattctcctgcctcagcctcctgagtagatggaactacaggcacctgccaccacgcccagctaattttatttttgtatttttagtagagagggggtttcaccgtgttagccaggatggtctcgatctcctgacctcgtgatccgcctgcctcagcctcccaaagtgctgggattacaggcgtgagccacagtgcccggctaatttttgtatttttagtagagacggagtttcaccatattggccaggctggtctcgaactccagaccttgtgatccactcaccttggcctcccaaagtgctgggattacaggcatgagccaagtctttttttttttttttttttttttttgagacggagtcttgctctcttgcccaggctggagtacagtggtttgattgtgatctcggctcactgcaacctcagcctcctgggttcaagcgattctcctgtctcagcctcccaagtagctgggattacaggcacatgccaccatgtccggctaatttttatatttttagtggagacggggtttcaccatgttggccaggctggtctcgaactcctgacctcaggtggtctacccaccttggcctcccaaagtgctgggattataggtgtgagccaccgcacccggccttgttattagtcttaactagattgttgattgaagtccttaagcccagaaatgtatgtgaaggatggtggagaagagtggctcaggcattctaggcagaggtattcttgagctgaggaagtggaggagaggaggtatgtaagttacctgttttcaggggttcattccagtggatagtggatgccactccctggcagacactgtgggtgcctcacctgaaagactcctgattccctgaaggcattgtcgggtgtattttttctttataagcgtaatgccagtggagtgggtaagacaggtaccaccttttgcatctgctgctacagattaggcagcttggttaagttttgttttgtttttaattgttatgagttagtttgaaccaaaaggattgttaagtggagtgtaagaagcactgaataactactgttatctgagaggagtagtaaagaccagggccactgggcaatcccagaggcattaggaatttgtggcctttccctttagagcattgtcattatgtgtatctgcatctctgcattccaactttcacattttcagttcccaggagagagaatctgattggcctggttggggtcctgtgcccacttctggctgtcacctgtggctttcttccctcagttgtagaccacactctggatacctgggacccctgaaatctcctgcccagacaaccccaagcttctcaggactttttgtgggctgcttccctgttctgcctgtgcagtgcaggccttgtcacaatgtctgaatgcttaggccagagacgtgggggtttggtgagaaaggatgagctgggtagctacactcaagtgcagagccaccagtattgtgggacagagccaggcatgggaagagaagtgggcacggatgggggccagctttcccgatgtgccttaatctggcacagaactcctaaggagtgtgaaaatttcaaatttgatccaggccttccaggtggttatgaagaaggcgagtttgtcaagacaggataatacaatatacttcatttaatagcttgttagtgtgatttataactaaatatgtagacatcatatatgggtcttcattcatactcttgccccaggccctgaaagtgttagctaacaggcaagacctgcctgggactgagattctaaaacacaacctccacccccaactccgtttcatcatatagtagcctaacatattagttggttcgttgcttatagtcaggcaaacaacaaagactccgaattgagctcttggtaatttttgaaacctgcctggtaatactgtgtttcctcattctgatggcattcccagaccatattgcaaatgacttgatgtgtattttcagacttgttgagaagggcctggtggtctatatagcaggcataaaatgtcaccaggccgacttcatgacttatcttttgaggtcaaacagacccattgaccaaaagatttgagggcagtgaaaacatcttgtatactatctttaacaatggatttaactcctaaaggaaagccacctaaacatgactgtttaatcttcactagcaatttgaacttttttttttttgagacggcgtctcaccttgttgcccaggctggagtgtagtggtgtgaccttggctcgctgcaacctccacctcctgggtccaagtgattctgctccctcagcttcctgagcagctgggattacaggtgcctgccaccacacccagctaatttttttgtatttttagtagagacagggtttcaccgtgttggccaggctggtctccaattcctgacctctagtgatccacccgccttggcctcccaaaatgctaggattacaggtgtgagccaccacacccggcctgcgcccagataatttttgtattttttttttttttgagagtctcgctctgtcccccaggctggggtgtagtggcacgatgggttcacgccattctcctgcctcagcctcccgagtagctgggactgcaggtgcctgccaccacgcctggctaatttttttgtatttttagtagagacggagtttcgccatgttagccaggatggtctcgatctcctgaccttgtgatctgcccgccttggcctcccaaagtgctgggattacaggtgtgagccactgcgcccagccaacaatttgaacttttatctgtcaaatctatatgcatccttagcaagctttgtaaactgcctggtaactgatagatcttggttcacttagcttcccaaattatgctgttatcatcttgtctctctgttctttaaatatctggttgggagggtatggagagagagggaggaagaaagacacctctgtaagtttgaaattatttgcatcccccccaccgcccaccaccaacctttttaaaatatagagacacagagtctataccacgcctggcctaaaataattttttttagagacgggatctaacagtgttcccccagcttggctatcttaaacttcttaagggtagctagttctaagaactgcttttttctggctaggcacagtggctcacgcctataatcccaacactttgggagaccgaggcaggcagatcacctaaggtcaggagtttgagactagcctgggcaatatagtgaaatcctgtctctactaaaaatacaaaaattagctgggcgtggtggcatgcatctgtaatcccagctactgggggcgctgaggcacgagaattgcttgaacccaggacacggaggttgcagcgagctgagatcatgcactgcactccagcctgggtgacagagggggagactgtctggaaaaaaaaaatgtttaaaacaaaaaactgtttttttgtatgtgtgtttatatgcgaaccatttgtgaaagtggtcccagcatgatgccacatgtgtcatttccaaatatttcagtctgtatttttttctctctctctctgttttttctgtcacccaggctggagtgcagtggtacgatctggctcactgcagcctcgacctcctgtgctaaaacagttctcttgcctcagcctcctgtgaagctggtaccacaggtgcatgccactgcacccagctaacttgtagagattggggtctcactttgttgcccaggctgttatttgactcctggactcaggtgatcatgccactttggcctgccagagtgctgagattacaaaagtgagccaccacactcagccataaatgtgttgttgttgttgtttttgagacagagtttcgctcttgttgctgaggctggagtgcaatggcgcgatctcagctcactgcaacctcccccctcctaggttcaagcgattctcctgcctcagcctcccaggtagttgggattacaggtgcctgccaccacgtccaactaatttttgtatttttaatagagacggggtttcactatgttggtcaggctggtcttgaactcctgacctcaggcgatccacccgcctcggcctcccaaagtgctaggatcacaggcgtgagccactgtgcctggacttgtaaatggtatttcaaagtaaaatatatgtcattgcatttatcaagataatttgattgagctttgtaggtcctagccatccttctgcctattactgggctttttgcaaatgctgttcctgtttccacaacctggagcattgtcccatcccttttattgtttctcttgctgttatttattatgtcatccatcatcattataccattcctctgccaagaaacatttaatttttgtttttgtttactattacaaaaatgttttatagaatattgttagacttacattcttgcccctcattgtggaagtattcctgtagtatgaatacagccagaggttttttagttttgttttggtttttttgaggagtcttactccttcatccagaggctggagtgcagtgacgcgatcttggctcgctgcaaactccacctcctgggttcaagcgattctcctgcctcagcctcccaagtatctgggactacaggcggccgccagcatgcctagctaatttttgtatatttgtagagacgggggtttcaccatgttggccaggctggtctcgaactcctgacctcatgtgatccgcctgcctcggtctccaaagtgttgggattacaggtgtgacccaccgcgcctggcccagtgagagttaaagggccagagtggaagcaggtctttggaagcttggctctgtcttccttcagtgcagggagtttgtgttgtccatccccagcctctacagaagcacacagtgagtgttcaataagcatttcttggatcaaatggcccctgcttcttttaatggtcagtaaactttaaataatgagatttttctgcaatagagaagagcaactgccttgtgattggaagccagcatatgttattcctaagcagttctgccttttttccacagaaggtggtcttctgccctgttaaagaagccctggaggtggactggagcagtgagaaagcaaaggctgctctgaagcgcacgacctccgactactttctccttcaaggtgaggtctcaaagcacaacttaccccgggagagcttttggctctgatttctgcaaatgtggttgcaaggtccagatggttttgtgatgtttgccttgggtggcattcttcattggctagttctcagtgatcacttgagaaaggggtggtcacttgaagggggtgaggtctaccattgagctctgggttctaatgacttctcctttttttacttgttgaaatgacctccctgtcaagttgaccttatggtaatagtgttacaggtcacagattgagaaacctctttttttttcttttttctttttttgagacagagtcttgctctgtcacccagactggagtgcagtggggtgcaatcttggctcactgcaacctccacctcctgggttgaagcgattctggtgtcttagtgtccccagaagctgggatgacaggcatgcaccactgcgcccggctaatttttgtattttgagtagagatggggtttcaccatgatgcccaggccctgaagttctgagattataggcatgagccaccatgtgaagcctgatcaaccaacttctcttcaccgccccccgcctttttttttttttttttttttgagacagagtcttgctctgtcacccaggctggaatgcagtagcgctatcatggttcactgtagcctctacttcctgggcttaagtgctccccatgcctcaggctcctgagtagctggtactacaagcacacgccactgtgcccagctagtttttgtatttttttgtagaagcgaagtttctccatgtagccaggctggacttgaactcctgagctctagtgaaatccccgcgttggccttccaaagtgctggagttaaaggcgtaagccaccagtgcttgttcccctcttcagaattctttctctgcctcaaaaccatcctcacgcttatgaaaggtggggttgtttttcctcttgctattaatgaactacttatcagtccatctttgctggtggtcaagagactgttagtaagtattggttggcttttcagtgttcttcctgtacctggcacttttttgtttgtttttgagatggagtctcgctctgtccccaggctggagtgcagtggtgtgatcttggctcactgtaacctctgcctcctgggttcaagcgattcttctgcctcagcctcccgagtagctgggactgcaggcgcgtgccaccacacccagctaatttttatatttttagtagagacagggtttcaccatgttggccaggttgggctcactctcttgacctcgtgatccgcccacctcagccccccaaagtgctgtgattacaggtgtgagccaccgcgcctggcaaacctggcacttttaatttttattttaattttttttttggagacggagtctagctctgtcgcccaggctggagtgcagtggcacgatcttggcacactgcaacctctgcctcccaggctcaagcaattctcctgcctcagcctcccgagtagctgaaatacaggcgggcaccaccatgcccagctaattttctttttttttgagatggagtctcactctgttgcccaggagagcagtggcgtgatcttggctcactgcaacctccacctcccaggttcaagcgattctcctgcctcagcatcctgagtagctgggatcacaggcacctgccaccacgcttggctaattttttgtatttttagtatttttgtattttttttgtattttcaccatcttggccaggctggtctcgaactcctgacctcaggtgatctgcccacctcagtctcccaaagtgttgggattacagacgtgagccactgcacctggctgcgctaatttttgtattttagtagagacagggtttcaccatgttggccaggctggtcttgaactcctgaccccaggtgatctgcccacctcagcctcccaaagtgctgggattacaggcatggtagttttttaaaaagtattttttttaatgttatttatgcatttatttttttgagacggagtctcactctgtcacccaggctggagtgcagtggtgcaatcttggctcactgcaacctccacctcccggttcaaacagtttccccgcctcagcctcccgagtagctgggattacaggtgcccaccagcacacccagctaatttttgtatttttagtagaaacggggtttcaccatgttggccaggctggcctcaaactcccaacctcagatgatccacctgcctcggcctcccgaagtgctgggattacaggcgtgagccaccacgctcagctggatgaactatttgaaagtcccgaatatccatttgtgtagaaataaatgggttgagcaggaatgagtgttgcatgtgagtgggctgcactcagaaaatgcctcctcttgatagtgggatcaggtgtggaagaggcaccagcagtaagagcagagtcttttccatgtgggaacagtgcctgggccctttgggagaagcttgttgctcactgcctcgcacatagaaagccctcaggaaacaatggcgctaatttgccaaggtttgggtttgacttgagcatctctaactgctgcttatgaaaggagtcaactgggctgggctactaaaaatacaaaaattagccggatgaggtggtgtgcgcctgtaatcccagctactcgggaggctgaggcagaagcacttaaacctaggaggcaaaagttgcagaatccgagatcatgccaaagcactccagcctgggtgacagagctgaactccatctccaaaaaaaagggggagaaacagagtcaatcacagatcatctactccagagttgaaaagtgtacacgccaaaaaaaaaaaagagaaaagaaaaaaagcacatatcttcacggatgacagagttctctaggacttgctctgtgccgggcgttttccatgtatatcaccttcatctcacaaaggccctcaggcaagtgctattaacaccaccagctacagaggggaatctgaggctcagggaatttaaagtcagtggctcaagatcacccatctaaaacaaaatggcagtgcccactggaagccaggtctgttttgattccaaaggtcttgttctttttctttttccccagagacagagtcttgctctatcacccaggtaggagtgcagtggggcgatcttggctcactgcaacttctgcctcctgggttcgagcgattctacaggcacgcaccaccacacccagctaatttttgtattcttagtagaggcagggttccaccgtgttggccaggctggtctcgaactcttgacctcgtgaaccgcctgcctcggcctcccaaagtgctgggattagaggcgtgagccaccgcgcccggcccaaagtcttgttcggaacaaccatgcaccactgcctgccacagaagtcatatagctactgtttcttcctcaaccacctgtccacccctccaaccccgtaacttctgatgctgatgtccagtagcacctgcactgaatattcactttgctcctagatatcagttttgtcccctcagttcaatgacccctgtgatgttgagatggatgagaaaatactctggaaactgcagaggataaaatcaggatttcctcacttcagcacactactgacattctgtgctggataacactgtcacgggggactgtcctgtgcactgtgggatatttagtaacacccctatcctctactcactagatgccagtaatatctccccacccagctctaacatcaaaaaatgtttccagacaccactgccacatgtccccagttgagaaccactggattatgctaaactcaaaggccagttgactcctttcttttctttcttttcttttttttttttttttgagacggagtctctctctgtcacccaggctggagtgcagtggtgcaatctcagctcactgcaagctcagcctcctgggttcacgccattctcctgcctcagcctcccgactagctgggactacaggcgcctgccactatgcctggctaattttttgtatttttagtagagacggggtttcaccgcgttagccaggatggtctcgaactcctgacctcgtgatccacccgcctcggcctcccaaagtgctgggattacagacgtgagccacttcgcccagcctgtttacccttaattccatccctcagtgggtattatggcaacagtctcatgagtgcctatgaccctttgctggataatatatcctatcatgtttaccactctctcccagatggcattaattatctgtctttttcagttttgagttccagggctttggatatggtaatcaaaacattaaaactatgtgcagtaaatttcttttcttttttctttttctttttttttttttttggtgtggtgaaaagcacataacataaaatttaccattataacttaagcgtataggtcagtaataatcatacaatgttttattttattttgtttttttctgagatggagtttcgctcttgttgaccaggctggagtgcaatggtgcgatctcggttcaccacaacctccacctcccaggtttaagcaattctcctgcctcagccttctgagtagctgggattacaggcatatgtcaccacgcctggcaaatttttttttttttttttttttttttgtgagacggagtctcgctctgtctcccagcctggagtgcagtggcatgatctcagctcactgcaagctctgcctcccgggttcacgccattctcctgcctcagcctcccgagtagctgggactacaggtgcccgccaccatgcccggctaatttttttgtatttttagtagagacggggtttcaccatgttagccaggatggtctcgatgttctgacctcgtgatccgcctgcctcagcctcccaaagtgctgggattacaggcgtgagccaccgcgcctggccacatttttgtatttttagtagagacggggtttcaccatgttggccaggctggtctcaaactcctgacctcaggtgatcctcctgcctcggtctcccaaagtgctgagattacaggcgtgaggcaccgtgcccggcagtgagaacatttacaatcacatattgtgtagcatcaggaaggatttttaagatcaaagttagcacattagaagtggaaataatttaaaagtggccttgattttttttttttttttttttttttgcctactgtaaagtcaagcctcagtaacattctgatttcaggatgcagggtggctttgggggatatccaagttgagtggtaaactttgtaggcactactcttgtttccatgttcctggcacctaagttgatatattttctcacagtcttgtgacaatctttgaagtatagttgttatcccattttcctataaggagaccaaggttgagcatggttgtgattgccgaaagtcatatccgtggttttatagacagtcagaatttagaccatgaggtttgttttacctgtggacttagttttcaacatatttaagatatatctgtagtctgggcgcggtggcttatgcctgtaatcccagcacattgtgaggctgaggtgggcagatcatttgaagtcaggagttcgagggcagcctggccaagatggtgaaatcccgtctctactaaaaaacacaaaaattagccaggcatggtggcacatgcctgtagtcccagctacttgggaggctgaggtgagagaatctcttgaacctaggaggcaaggttgcagtgagccgagatcgtgccactgcactccagcctgggcaacagaacgagactctgtctcaaaataaaataaataaaatatctctaaactaatatatctcattaaatttcagatctggagttctgtgagttagggaaacaggatcaccaccatagtagaaaaaactctggtgcagatagttttagacacaaagattatctgaattcaggcccagataattgtcttctttttccccaagaaacatttgaattgtatttctgttagataagcatcatagtaaaaagtcttcaaagtttttgaaggcagaaaaagttttctttgttaaacccttcccatttttttgtcttctaaatttctaggagaactactgttaagttttttagtatcttgttgaacaatggttaacaattataatcatttgtgtttatgtaatcaaactgtgaaacaccggttgggaacttgcttgtgtacacttgatggcgtaaatggtaggggaagagcatacatacaaaagtggcctcttttgctttcttggcagcatgatgttatattcctttggatgtaccgtcatctatgaccagtctcatcttgaaaggcatgcttattttccatttttcccagtgcttggaatttgtttccaaaattgtttctaggaacatgactaatgtgactgacgatgccttaggaattcctagtggggacaaggtgcttggctgggatgcatacctaagaatatctcacaaagaaacctgattttgtttcactattgcctaatggcgcacatagtaggtgctcaataaataaatattttttgcatgagtggtttttgcttgtctggtcatttgccctattgtagagggagagtagtgtgcccactggagtccccacagggtccttttgcctgcatgcctacccctgtggcacccatcaggcttttgattccaatgttgccctgggctctcactcacaggtagatgttttttattgccccattcacaattcagccacctgctgtccgcatgcatgtgcttgccatgtttagatattgggtgtttttccagtttacttaataagttagtggccagactgtacgcttcctgctgcatttttccactgtcttgagagttggcctcgccatctgtgagcaaaaggtctcttctttttattattctcccatggcatgttgcaaaacagtaagcgtgagctggtttcctgtggcaaaaaaatgactttgatttgttctttttgaggttactgtgagtttatcataacaggagtgctaaaaataccgagtctggtatggaaacagcattcacttaccagcatgaacaataacatacaggtttagcctagagcaggaagaaatggacttcatctcaagatgagaatacttatcagagaattcttggcaatcttaacttgctcagtctctgttctgatgagttatggaaaagtacttagaccatctttgagccacagaattgaagctgaaaatattcttagaccaaacattttgtgagcacctgctatgtaccagatctcatagctgggactaatcagaggaagaggaatagaataagtgttcttgccaatgtgaaagacaaacaaataattctactccttgtgaggacagctataacagagggctatagaaactatcatgtgttgttcctggtttttgtttgttttttttcccccccaaaacagggtcttgctctgctttccaggctggagtgtggtggcacaatcataactcactatagccttgaactcctgggctcaagttatcctctcacctcgacctgcaaagtagctgggactacaggcgtgtgccaccatgtccagctattttaaaaaatctgtttgtacagattggggcagggaggtcttgctatgttgcccaggctggccttgaactcctggcctcaagaaatcctctcacctcagtttcccaaagagggactataggaaagcaccaccctgcctggctcgttgttctgtttttaaatacatttgcattattccataataatcaaagtaatttattatgggaacttaggaaactgaaggtctgaccatctttggggagttgtgaagtcttgacagaggaggggagatctgagctgtatttctcggaacaggtatttgccaggtgggaaagagggaagaatattgcagagcaacacatgcacagggccagcaggatagaggctgagcctcggaggggactggagcttggagagagcaggctagtggtttccctattgatagaatatcagaatctggccaggcgcggtggctcacgcctgtaatcccagcactttgagagactgaggtgggcagatcatgaggtcaagagatcgagaccatcctggccaacatagtgaaaccccatctctactaaaaatacaaaaattagctgggcatggtggtgtgcgcctgtagtcccagctactcgggagggggaggcaggagaatcgcttgaaaacctggaaggcagaggttgcagtgagctgaggtcgcgccactgcactccagcctgacgacagggcaagactccatctccaaaaaaaaaaaagaaatctatctatctatcagtcagaatcactgaggaaaccgttgaaaaatgcggagtgcctgcttgtagctcacattactgaatccagatagctaggagtgacttgcatgtctgcatttttctatagcacccaggtttctcaaatcagccaagttaggggaaagtactgtcataggaaagggaagcccatttcccaggtcaaagcctttgcttactcgtttatgtttattttatttttgagacagagtctagctttgttgcccaggctggagttgcaggtgcaatctcagctcattgcaacctccgccttttggattcgtgcaattctcctgcctcagcctccaagtagtggggatcacaggcacacgccaccatgcctggctaatttttgtatttttagtggagacagggtttcgccatgttggccaggctggtctcgaactcttgacctcaagtgatccatgcacctcggccttccaggtgctgagtttataggcatgagccatcgtgcatagcctgcgtttttcttttaaaatgtgttaagcactgtatttcaaattacatttgtgcactgaagcagggaggaaaaaggagctaacccaagtagctgttcaatatagtattttgactgcataccctcaaagtaaagaaaaatctcacctggcgcggtggcttatgcctgtaatcccagcactttgggaggctgaggtgggtggctcacagggtcaggagatcgagaccatcctggctgacacggtgaaacctcgtctctactaaaaatacaaaaattagccgggcgtggtggcgggcgtctgtagtctcagctacttgggaggctgaggcaggagaatggtgtgaacccgggaggcagagcttgcagtgagccgagatctcaccactgcactccagcatgggcgacagaacaaggctctgtctccaaaaaaaaaaaaaaaagaaagaaaaatctctagccggtcgcgatggctcacgcctgtaatcctagcactttgggaggctgaagcaggtggattgcctgagctcagaagtttgagaccagcctgggcaacatggtgaaaccctgtctctactaaagtacaaaaaaattagccagacatggtggcacactcctataatcctagctacttgggaggctgaggcaggagaattgcttgaaccctggaggcagaggttgcagtgagccgaggttgctccattgcactccagcctgggtgacagagcatcttaagaaaaaaaaaaaaagaaaaactctaaataaatattgaactctgcttagtagggattttgttttcagatgaggtcttgctctgtaccccaggctggagtgcagtgtcacgatcataacttactgcagcttctccctcccagctcaagcaatcctcacatcacagcctcccaagtagctgggattataggcaagtagcagggattacaggcatgcaataccacacccagctgattttggtattatttgtagagacggggtttcactgtgttgcccagggtagtctctgtctcctgggctgaagtgagcctcctgcccaaagtgttgggattacaggtgtgagccactttgcctggcctagtaggtttgtttttcacagtgataggggttagcaattctgaaactacttactgttcttctaagattgagcagataggtaagtatagtgttaatagtgagaatcaagttttcttattgtcagaaaagggtgttcctatgaatgtggacagtgggaaaggctagaaggagccatgtggtattggattggaattgaagttatctggatgaactcatggtttcttatacgtagatgtagtaatagatgtatgtgtgtatgcatatccacttttacacgtgtttatttcctagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacaggtgagcttggaatatcctgctatgccagaaagtaaggaagtgctctaagaatgataggggcatgtcaaaagaacaagaagaataatcaattaatgtaaacaaggaattatgaagataacaaagtctatctttgactatcaccatagtagtaacaattgtttcaatcaagaatcaaagtgctaaaatcaatggggaacagtttgcggtgaaacagtgtagatgtttccttatcagatgcttttatgctatgcctggtggctcacccctataaatcccaagaggctgaggcaaattgatcacttgcacccaggagttttgagaccagcctgggcaacaaaacgagaccccatctctacaaaaaataaaaaagttagccagatacagtggtgcatgcatgtagtcctagctactcaggaggatgagatgggaggatcggttgagcgcaggaggtcgaagctgcagtgagttgtgattgcaccactgcactccagcctgggagcaagactttgtctcccccgaaaaagaagatgcttttaaatgaattacatagagagacattggagaaccctggcaggttgtacctcagctgagtgatgaaattaacaatctagggatggacagttagacctcatgcctcttggaatatgtaaccctgggttggatctgagaatagaggaaggttttttttcttttgctctaaaggatgttagtggaacaattggtaaaaagaggccccggcgtggtggctcacgcctataatcccagcactttgggaagccgaggcaggtggatcacctgaggtcgggagttcgagaccagcctgcccaacatggagaaaccccatctctactaaaaatacaaaattagccaggcgtggtggtgcatgcctgtaatcccagctacttgggaagctgaggcaggagaatcgcttgaacccaggaggcggaggttgtggtgagccgagatcgcgccattgcactccagcttgggcaacaagagcgaaactctatctcaaaatagtaataataataataaaataaaaaacaaataaaaaggtctgtaggttagatagcagtactgtttccatgttatttatttttacagttatgataattgtctcatggttatttaagagaatggtttttgttttgtttttcttgttttttcttttccttttttttttttttttttttgagatggagtctcactctgtcgcccatgctggagtgcagtggcatcatctcggctcactgcaagctccacctcataggtttacgccattctcctgcctccccctcccaggtagctgggactacaggtgcccgccaccacacctggctaatttttgtatttttggtagagatggggtttcgccatgttagccaggctggtctcgaactcctagcctcaggtgatcctcccacctcagcctcctgaagtgctgggattataagtgtgagccagtgcacctggcctctttttttttttttttttttttaattttacagaattttttttttttttaagacagagtcttgctctaaggctgtagtgcagtggtatgatcacagcttgctgcagcctcagcctcctggactcaagcgatcctcccacatcacccttctgagtaggtgggattattgtaggctaaatttttaattttattgtagagaggcctcactccatggcctaggctggtcttgaactcctgggctcaagtgatcctcccacttctgcctcccaaagcattgggataacagacgtgagccactgcacccagcctgttagataatttagaaaattttctttcctcattcttcaatttcccctcattcacactcccaactttcctgttttgtgatttttaaatgacgttgtctttggatgccggctggatttggtgattagttctcttcagaagaaacttcttattttagaacttgtaacctttgcaaagcaggccataggcagccatcgctatttgggtatgacattccccagtgggtttttggtgtccagtaatgacaaaaactgctgagaaagagacagccacagggaaatgggttccgataatggggcagcagctgagtgcttgttgatttgctgctgtcatgaccacagatgtttaaaaataatttgtaaggaaaaagaaaaaagcgtagtgtgtgtgtgtgtgtgtgtgtgtgtgtgtgtgcgcgcacgcacgcgcgcgcgcacaccactgccttatcagtggtagagaatgcagaccacagtcattcagaaaggaagaaggcaccaccatggaaacaggagaggtgaggagaagggcagaggtgacccacaaatgcggctcagtgccttacagcagagagctcatgagagaacagaactggttagtcaccgactctgctcctcggtctgcaagagaggttcagcaccaagtctatactacacagtactggaaggattagatgaaggcctggcacacattgtgaattaatagttactggttacaggcggggtgtggtggctcaggcttgtaatcccagccctttgggaggccaaagtgggaggattgcttgaggccaatagtccaagaccaacatgggcaacatagcaacaccctgtctctttttttgactgtttttttgaaacagtctcgttctgtcagccaggctggagtgcagtggcacaatcttggctcactgcaacctctgcctcccaggttcaagcaattctcctgcctctgcctcccgagtagctgggattacaggtgcctaccaccacgtccggctaatttttgtatttttagtggagatgggctttcaccatgttggccaggctggtctcaaactcttgacctcaggtgatccacccaccttggcctcccaaagtgctgggattacaggcgtgagccactgtgcctgaccggttcacgtactttacatgcattgtgatcatattaaatcttcatgacagccttactagatcaggtcttgtcctgttttcacatgaggaaattgaatcttggaagggctaagtcatttgtccagggtcatcacacgcagtaagtgttagagtctaaacgagccagagctgtcacactgtcatccccagggccttgtgtttaagcatcgcccaacaaagtgctcagtcagactttaattattagcattactaataataccattatgatgattattttgtctaaacttcacaggcacctcgtgacattttcttattccacttttgcagatgggaaactgaggcccaccaagatcagattacaataatgggcaacattgtcagcaacctgccttgctttttttcttagcaggcccacatctcccccactcccccacccacttggcagtagcctgtgtttgagctgctcacaggccccaaggcccagctgcaattcttgtttaaagcctcacatcttttctctgactgtcagacaacagtcacgggaatgtcctgtgccatcttccctcggcaagaggggttggcagagagcagcagatgcctagagtcaaggtcatgtgctgctcaagtgctgggctggagacaagaccctctctccctgctgcttgtgaccaggcagggtggctctgaatgtagagggctctgtcagaacagttctgtgaccagagggtgtggttggcaaagcaatgcattaggggcccatggaagtttattcttgttgtccacattatttccctgtgacttttagatttttttttcctttttgtaaattagttttttcatactagttagaatgtttcaccttaaaggtgagagtcaagctctggaatcgcctgacatttttaaggaaaggaatagaatattgggctggggctagtctgaaatggtggtttgtattattttaaattgatgggctctgggttaggggagccaaatccattttaaagtgatttttgtaaaaattggcatgtcttctgtttcttctcttttccaaaggtgacactataacgtagaggttaagaatgtggtgacttttaaatccgtcgtgaccataagcctctcctaagccccagttttcctaccactaaaatgggggtggtaacagttgtacctacctcattctgtcttttttgttttttgcttgtttgtttgttttttagatggagtcttgctcttgtcgcccaggctggagtgcaatggtgtgattttggctcattgcaacctccacctcctgggttcaagcgattctcctgcctcaacttcccgagtagctgggatgacaggcacccgccaccatgcccatttagtttttgtatttttagtagagatggggtttcaccacgttggccaggctactcttgaactcctgacctcaggtgatccacccacctcagcctcccaaagtgctgggattacaggcgtgagccaccactgccggcctcgttctgtcgtatttttttacgtaggagagctcagtctgaatgtaggatatgacatggttgtggggttttttttgtttttgttttgtttttgttttgttttgttttgttttgttttgttttgttttgtttttgagacagtctcactctgtcccccaggctggagtgcagtggtgtgatagctcactgaaacctctacctcccaagttcaagcgattctcctgcctcagcccccaagtagctggaattacaggtgcccaccaccatgcccagctaatttttgtagttttagtagagatgaggtttcaccatgttggccaggctgctctcgaactcctgacctcgggtgatccacccgcctcggccttccaagtactgggattataggcgtacttggaaggtaccatgcccggccattatatgctttttaaaaaaacctaaatgttgcaaaaaacatgtgtctaaaatctctgtttcaacatagttttttaatagccatgtaatattccattctgtcaatatgtctttatatgtggtacagactgagtgtctaaatccaagaacccaaaatctgaatttttttttatttttcatttttatttgtttacttatttttgagacagagtcttgctctgtcacccaggttggagtgcggtggtgtgtcggctcactgcgacctccacctcccaggttcaagtgattttcctgcctcagcttcccaagtagctgggattacaggtgcccgccaccatgcctggctaattttttgtatttttagtggacacgaggtttcaccgtgttggccaggctgatcctgaactcctgacctcaagtaatcctcccacctctgtctaccaaagtgctgggattacaggctgagctactgcgcccagcctatttttgtttttttgagacagagtctcactgtgtctcccaggctagagtacagtagccccatctctgctcactgcaacctccgcctcctgggttcaagtgattctcctgccttagtctcctgagtacctgggattacagacgtgtgccaccacacccggctaatttttgtatttttagtagagacagggtttcactatgttggccagcctgatcttgaactactgacctcaagtgatccacccatctcagcctcccaaagtgctgggattacaggcatgagccaccgcaccaagcccccaaaatctgaaatgttttgagtgccgacataacactcaaaaaaatgcttattggccccgggcgtggtggctcatgcctgtaatcccagcactttgggaggcctaggtgggtggatcacctgaggtcaggagttcaagaccagcctggctaacatggtgaaaccccgtctctactaaaaatacaaaaattgaccaggtgtagtggtgggtgcctgtagtcccagctactagggaggctgaagcaggagaatcacttgaacccaggaggcacagcttgcggtgagccgagatcccgccactgcattccagcctgggcaacagagagagactctgtctcaaaaataaaaataaaaaaaaaataataaaagctcattggagcattttggatttgggattcttagatttggggtgctctattggtaagtacaatgcaaatatttcaaaatctgaaaatacccaaaattcaaacacttctgctccctgacatcctgtgtaaacaacactgcagtgaacatttataggtaattcattcagcgggtaagggtcaggaccttttatagggatccttaataccacatttttacatggttcattgagcattcgtgctcccctctgctgtgggtgagggtgcaggtccctcagccttcttgcttgggttgagtcatcctggtctttaatttggtaagcaaaaaatggcatcttgtttttgagctcgtttctgagaaagtgcatgctccttttccccatcaacaactttcatccggcgcctcggaacctcttcagtagagagtgagatgcaaatagcgaggcacagcttctttccctcttctgagctgatgcctggtgaggtcatagactgggtttcattgcaaagacgaaagcgtgggcaggacttttggagcacaaaaaggggcatttcagagtagtcttcatgggcggccactccagaggtgaagttttctagagaaagacatgaaagtactgtgtggctgtggcgacagacagaggcttacgagcctgccctctagagactgtgagctccgcgtgtgagggcaaggcctggggctgtctgggtcgcttctgggtccccaccacagctagcatagggtaggggtggagggggggtgctcaggaagtgatttttgaagagtggatgactgaatacatgcacacacatacttttaagtttctgggttaaagaggaaaacagaatgaggtaaacaaaggaaagtaatgtggaggtgaactgagcagatggcaagatgccgtgaatggttagaggccaggagagccagaatcagagtggcttccgtgaagtgtccctacctcctcccccagcccagctatgtcactcctctgagcttcacacctatggactgttctgcaccctagccctcagatgcaacggtgaaagtgggactcctattgggtttccctgttgaggacagacatggtgccctgtgtatctgctgctgcttttttctttttttcttgctgagtattccatgtgtagcatgtttgtaacacttgataagaaacagaaccatcccagatagcttgaacacttttcaattcagtcagtaacagaccaggtctgctttggatttccaggagcttgtgtcactttattttttttctgagccagggtctcgctttgtcacccagctggagtgcagtggtgcaatgtcagctcaccacagcctctgcctcctgggttcaagcaattctcgtacctcagcctcccaagtagctgggactacaggtgcctgccacaacacccggctcatttttgtgtttttagcagagacggggtttcaccatgttggccaggctggtctcaaactcctgacctcagttgatctgcttgccttggcctctcaaagtgctgggattacaggcgtgagccactgcacccggcctctggattgcccggcctgtgtcactttgtcatgagcccttctcccctagttatcctttattcttcaaacaggcttcctgtgtgacatattttttgagtgcctgctatggggcaagccctgtgccaggtgttcagtatagagtagtgacatcgcctttgccccacagagcataaaaatctaatggaggagacaagccagtccttgtgctagttcatttccacaggtgaatataaaaccacaaactgggcagggcatggtggctcacgcctgtaatcccagcactttcagaggacaaggcaggtggacaacttgagctcaggagtttgagaccagcctgggcaacatggtgagacctcgtctctacaaaaaataaaaaatgaaccaccaggcatggtggtgcatgcctgtagtcccagctatttgggaggctgaggcaggaggatcacttgagttcaggaggtccaggcagcaatgagctgagattgtgctgctcattccagcctgggtgacagactgaggccatgtctcaaaaaaaaaaaagaaaaaaataatcacaaactgtgagtaaggtatctaagggaaaaaactgtgctgggagtgaatgtcaggagacagggagatctgaggcagtatcgtgtccagagcccacagctgaattaatggtaatgcaggtaaatgagctactgtgtgacacaggttaccacagcaagtgtatcggcttttctagggcgagtgtgagctgggtttctggactttgcttaagagcagtgacagacctggaagatactgccccaggcactcttgggtgctttacatgtattggttcatttaatctttaaaccccacaagtgcccttgggattcccattttgcagaggaggctcagggtccttgtcacttgcccaaggtcacagtaagtggaagaatagggagtctagagctgtgctcttcgctgctgccctccagttggaaagctgtccaggccagggacaggctttgcagagagaaggtacagaggacgggacaggcaaatattcagagactatgaggactgaggtggttctgccaactgtggagggcctggtcacttgacaaggcacctcattgcacccccctgaggctctctcaaagccccttttcgagttaggacattgttatctcctgtgtagtttttgttgattgccctctgaaatgctgtgagagggtagaccatccattctgccctcgcctgcccagcccagcacctggcacagtcattgctcagtgtatatttattgaatgaacaattgactgaatgtcaggcccagggctttgccttaggaaacaggctgttggataagaggtagtactaccatactttgcaatttttctggaaatttatgtcacctgggagtggagcagattaccaggctgtttccagagatagcgactctccataaagtgagccaacctgggggctgggcgcagtggctcacgcctgtaaccccagcgctttgggaggctgaggcaggcggatcacgaggtcaggaatttgagaccagcctgaccaacatggtgaaaccccatctctactaaaaaatatgtatataaatgagccgggcgtagtggtgcgtgcctgtaatcccagctactcaggaggctgaggcagtagaatcgcttgcacctgggaggcggaggttgcagtgagcaaagatcgcgccactgcactccagcctgggtgacagagcgagactctgtcttaaaacgaacaaacaaaaaaaacaaaagtgagccaaccctggggaggagtctacgttcagctgcagggagccagggaattggggccgaggtgtctggcacagaaaagctttgggcctgtctcaggtaaatgaagttttgatatagattcaactcccctgccccccacaattgaactgtttttgggggccagcaattaggggctaatttgtgacagtgactttattttcttcctactaaagtactggtttattcggtggccttggtgattagatttaggcataatagttaaatgtaatagaagtttatgtaacaaacagtgattaataatgttgctgtccagattcccgttatagcgctaacctgatgttatgaactgagattaaatttgaatttgagtgcttacattattttgtaaaggtggttgtatattcacatatccacagttttttctataaataacgtgaaaccgtgcttggtttctcttttccaaagtttgccttttccattacatgggcaagtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcctgcccccctccactgctgctaactggagtctgaccttcgagaaagagtgaaaaaagacagcttctgtttgttttgctgcaagtaagtggctggactgattggcccccttcccagaggccctgcaaggacttcagatgtggtcagcgaggtatgtggatggtgccagcctgccggccctcgtccagccaaactgcaccaggaacaggcaagggtcccagagaaacagcggggtcagctgctgccgcctttgctcctgctcttaatgctgtcctatttcttcctaagaggaagctggtttactctctcaagattgatgggcaaagttttatatgaccacggtctccacttctcacccactgaacttacagcttgaaattaacagaggcgaggcccatctggaaaaatgcatttgacaaaaacttgatcaaatgggggatcccctgaggtgggtggcaaagaaccagaccacttggaatcctaggtgctgtgtccctgtatggacctgctgtttcttttggattccattagggttaagaagcacaaattctgaagctagatttgagtttacatttctgctccagtacttgggagttacagtgaccaagtcatttaatgtttctgaacttcagtttcctgatctgtaaagtaggatgggtaggttgggcgtagtgggtcatgcctataatcccagcactttgggaggctgaggcaggaggatcacttaaggtcagaagttcgagaccagcctggccaacatagtgaagccccgtcactagtaaaaatacaaaagttatttgggcgtggttgtgggcgtctccagcctgggtgacagagtgagactccatctcaaaaaaaaagaagaaaaacaaaaacaagtaaataaatgaataaaaataaaggaatccagccatctgttagtatagccaaagcagaggatattgcatcaaatgttaaacgctagtcctgtcagtcactcctgagagaacagggcaacaagacccagaaagggtatcaacactgcctgagcagatggaggcaaagctgtgcatgggctgcttatagggcacagtctgaggccttgcagcagtcacgtggaaactgaggctgcctgctttccaggtgcaaggtgatggacagtggcaggaaccctgtgctagatgactcttgtgcgatcttatttctttgttactgggacacaagcaccaactgtcacaagggaccaacaagaggaggtgattttttttttcagctgttaccacaaagcttttcatcttttggtttgaaaacatagctgtgggaataggccgggcgcggtggctcacacctgtaatcccagcactttgggaggccaaggcgggccgatcacaaggtcaggagatcgagaccatcctggctaacacggtgaaaccccgtctatactaaaaatacaaaaattagccgggcgtggtgatggccgcctgtagtcccagctactcgggaggctgaggcaggagaatggcgtgaacccgggaggcggagcttgcagtgagccgagatcgcgccaccgcactccagcctgggcaacagagcgagactctgtctcaaaaaaaaaaaaagaaaaaagagagagaaagaaaatatagctttgggagcaccaaagcccaaagcgttatagtgcctactatgtgtcaggcactatactaaacatttcacatggcttagcactcatgtgatcttcacgataacctggtgagcgggtaattattatcacccttcctactggtttgttgttgttgttgttgtcgtcgttgttgttttgagacagagtctcgctctgtcacccaggctagattgcagtggcacgataccggctcactgcaacctctgcctcctgggtttgagcgactcctgcctcaggctcccgagtagctgggattaaaagcgtccgccaccatgcccagctaatttttgtatttttaatagagatggggttttatcatcttggccaggctggtcttgaacccctgacctcgtgatccacccgccttggcctcccaaagtgctgggattacaggcatcagccaccatgcccggctacttaatttattttttgagacagcctctctctgtagcccagactggagtgcagcggtgtgatttcggctcaccgcaacctctgaatcctgggttcaagcaattctactgcctcagcctcccaagtacttgattataggcacccaccacactttcggctaattttcctatttttagtagagatggggtttcaccatgttggccaggctggtctcaaactcctgacctcaagtgatctgcccaccttagcctcccaaagtgctggggttacaggtgtgagccactgcacctggcctcctttattttatgggacattttttgaaaagaggcttggtccaaacaggcagtacttgccacttctgcagtcatttctctaccctgccccaaaatggttactcagttgcatttatttactacaatcggaataccagcaggacatctacaaaagtagaagtattgggtggtagcagatcagtgctctctggcatccagatcgtctagatggtcacagcctttttttttttttttttggagacagagtcttgctctgtcgcccaggctggagtgcagtggcacaatctcggctcactgcaacctccacctcccgggttcaagagattctcctgcctcagcctcccgagtagctgagattacaggcacccaccaccatgcacggctaatttttttggtatttttagtagagatggggtttcgctgtgttggccaggctggtcttgaactcctgacctcaggtgatccacctgcctcagcctctgaaagtgctgggattacaggcatgagccaccacacctggccaattgttacagctttgagttgactgccaagtgttgaggtagcattgagggttgcagaagctgtgttcttgaaaaagagaagagagtaacattctcagaaagcaaacagtattcagaagagtcaatgggtgttctggagcttttttcttttctttcctttttttttttaaagaaattaccagctgggtgctgtggctcacgcctgtaattccagcactttggggggccaaggtgggaggatcacctgaggtcaggaacttgagaccaggaatttttctatttttagtgaaaccccatctctactaaaaatacaaaaaattagctgggtgtggctgcaggcacctgtaatccccagttacttggcaggttgaggcaggagaatggcttgaacccgggaggtggaggttgcattgagccgagatcacgccattgcactccagcctgggcaacagagcaagattgtctcaaaaaaaaaaaaaaagaaagaaaagaaaaagaaaaagaaattacctcttctctgatatgcagagccccgtctatactggacaggtggaagttaccagagaaatacaggccaggggcctttgtctgacattggcactgagaaaagcatagcccagaagcagggtgtgtcttttttttttacctgggcatctgtggtttgagatcttcttggaacactttataacccatttctgaacgtctcccaggcttcagtggagccacctgttgtagcttctaaaactgtgtcctcctcagttgttctcccacccattgccttcacagatgcagagaccaagattcactcactcgccattggacctttagcacccaggtctgtctggcacaaagtaagtgccaggctggtggagtgaatgaattctacttagagaatggccctcaacacaggctgctcattaccaaaactatttggtctttaaaaagtgtgactctgatgcttcagtctggggtgggtaccaaatacttgtattttttaaagagcctcacagcaacttgaatttaccttaatttttatgtaggaacccttgtcctggtagagagtataatttgctgaataagtctactttttcaatcaacatatacggaagagatatcaatgaaagaactgacaaactgtaaagccccctctccaggtgtaaagcactcagggcttgggcctagaagctgatccatgtctctgtgtctgttctgaaatagcctgtgtgatgtgggagaaagagtattgtccttagagacaaggctcgagactggctgtgccctttccttgggcagtatgtagggaacaagaatgcctgcccgcccgcaggcaggttacctgtggacaaggtgtagtgggcagttagaaggtgttggtatgttaatcagtcttttttttttttttttttttgagatggagttacgctctatcgcacaggcaaagtgcagtggcgcgatctcagctcactgcaacctcccaggttcaagtgattcttctgcttcagcctcccaagtacctgggactacaggcgtgcgccaccacgcctggctaatttatgtatttttttagtagagacggggtttcaccatgttggccaggctggtctctaacttctgacctcgtgatctgcctgcctcggcctcccaaagtgctgggattacagacgttacagacgtgagccaccacacctggccagtctttttttttttttttctgagatgaagtctcactctgttgcccaggctggagttcagtggcacgatctcggctcactgcaacctctgcctcccgggttcaagcgattctcctgcctcagcctcctgactaagtgggactacaggtgcctgccaccacgcctggctaatttttgtatttttagtagagaccgggtttcaccatgttggccaggttggtctcgaactcctgacctcagatgatccacccgccttggcctcccaaaatgcttggattacaggcgtgagccactgcacccagcctaattagtcttttgctcctatttgtctttatttgggataaaagttatagccttgttggggtcttcttacacagtagttctgactcacagccatcatctgaacctttcctctggttcacaaccaaaattaaacatccatttatggggattgagatagttttcatagtaaaggaagttttgtttgtaatgaccttcctgtttgatgggtctaagtatatggctggcccttctggctaaagcaggctttaaactggtcctgcctagaatgtgtacctcccactccttatcatctctcttctaggtcccttcccctttccctttcccttccccttccccttcgcttcttccttccctttgttccttttcctttcctttttttcttctttttttttttttttttttgacagggtctcactctgtcacccaggctggagtgcagtgatgagatctctgctcatgtagccttgaccttctgggctcaagtgatcttctgccttggcctccttagtagctgggactacaggcaccaccatacttggctaaattttttttttttttttggtagcagtgaggtctcactatgttgcccaggattatctcaaactcctgggctcaagcgatcctcacgccttggccccccaaagtgttgggattgcagatgtgtgccatcacactctgcctcttccgggtctttttttttttttttttcccagacggagtctcgctctgttgcccaggctggagtgcagtggcacgatcttggctcactgcaacctctgcctcctgggttcaagcgattctcctgcctcagccttccgagtagctgggattataggtgcctggctaattttttttatatttttagtagagacggggtttcaccatgttggtcaggctggtctcaaactcctgacctcgtgatcctcccacctcggcctcccaaagtgctgggattacaggcgtgagccaccgcgcctggcttttttttttttttttttttttttttttttttttaattttacttttttgagacggagtctcactctgtcacccaggctagattgcagtggcacaatcttggttcactgcaacttccgcctgctggattcaagtgattctcctgcttcagtctcccaagtagctgggactacaggcacgtgtcaccacacctggctaatttttgtatttttagtagagacagggtttcactatgttggccaggctggtctcgaactcctgaccttgtgatccacctgcctcggcctcccaaagtgctggggttacagctgtgagccaccgcacccggctcttccaggtcttaatagagcctttttcctctactgaaagcttccactgctttctgcccccttcaaactcatatatacttcattgaattgtttcctcggggaagccttcctgataccaccctacagagggtgtcagacgccctattatgctgtcacagcacttttcacagtaaggtaaattgcttttataattattggattgcctctctgactatgtttgttgaataaataaaaaaaggtggccaggtgccgtggctcacacctgtaatcccagcactttgggaggccgaggcgggcggatcacgaggtcaggagtttgagacaagcctgaccaacatggtgaaaacccgtctctactaaatatacaaaaattagccaggcatggtggttcgtgcctgtagtcctagctactcaggaggctgaggcagaagaatcacttgaacccgggaggcagaggttgcagtgagccaagattgtgccattgcactccagcctgggcgacagtgtgagcctccatctccaaaaaaaaaaaaaagtggctttataacctgccttctttttcttattcccagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggttggtgtcagtatttatcactgtttagtctggacagataaagtttgttttcaggatttgccttaatttgacaagctcttttattagaaacccttcagagagcaccctgccacattctgctcgctcctgtagacttctgcctctccactagaatagcaatatataaaaaataaagaggggacagattctgatttttacaataagtatcttatattcacgtggttcaaaattcaaggcaatgtaagatctgtaaacattattctctaccttttttcactttatgtgatcttgttatctcttggggacatctccagatcagtacatagtttgctccctcttttccacagctccttagtattctagagtgtgaagcgatggagtttattgaaccagttgcctgctcactcaagttgtgttcaggcttttctaactgcgtaacactgcagtgtgtgaccttgtgtcgtacgtgtgcaggtacaactgcaggataattaggaggaagggagttgctgggtcagaaggttgtaatttatcatttggtcagcattgccaccttgcctccattggtatcctatcaattcatacccccagcagcaaaaccacccatgttcccagcatcctctcacttggacactccatgctttcaccttacgtgactacctttttgctctcataaacaggcttaggatttgattggagaagaccacatagtgactaggtcacaatctctctctctcttttttttttttgagacagagttttgctcttgttgcccaggctggagtgcaatggcacaatctcaactcaccgcaacttctgccgcctgggtccaagcgattctcctaactcagccttttgagtagctgggattacaggtgcctgccaccacgcccagctaattttttttgtatttttagtagagatggggttttccatgttggccaggcaggtcttgaactcttgacctcaggtgatccgcctaccttggcctcccaaagtgctgagattacaggcatgagccaccacgcgctccatccacatctccttccaagcagctctgggatcatgtacacaccctaattccctttccatgtcttgagaggcttcctaaactcggctttgcagtgcctccagcttgtagcagtgataatgatggctgcagtttactgagcagctgttatgtactaggcatcaggtagtaagtagccaacccagatcccaccccaggtatcattacagtgcttgctctagtagcagcatgctaccttggtttcttatcaacagtaaggtctgccagagtccctagtcctttctttgttgacttcctgctgggaacttcaggtgagcaacagcaaaccccactccatttagggccagcagtggtctttgaagcacctgtggtgccctgacccaaaaagccatgattgtcctggtacagtggctcacacctataatcccagcactttgggaggttgaggcaggcagattgctttgagcttaggagtttgaggccaaccttgacaacatggtgaaaccctgtctctacaaaaaatagaaaaattaactgggcatcgatgactggtgcttgtagtctcagctactctggaggctgaggctagagcatcgcttgagcccaggaaagcagaggttgcagtgaaccaagattgcaccactgcattccagcctgggtgacagagagagaccgtgtctcaatacatatagcgtaaggctgggcgcggtggctcacgcctgtaatcccagcactttgggaggccgagacaggcagatcatgaggtcaggagattgagaccatcgtggctaacatggtgaaaccccatctctactaaaaatacaaaaaattagccaggtgtggtggtgggtgcctaagtcccagctactcgggaggctgaggcaggagaatggcgtgaacccgggaggcagaggttgcagtgagctgagatcacgccactgcactccagcctgggcgacagagcgagagggagactccttctcaaaaaaaaaaaaaaaaaaaaaaaggcagcaatagagtggcagtgcctgagcacacgagactgagacatggaaaagcggtttccccaaagagggtgggcagggaaggaaccactttggagagaaaaccagccagcagctcgttaggctgtggctttcctcttctaggaagcagggccttcaactctgctggccggtgatgcagagccagaccgttcatcactttgaatgcccaagtagtcacttggctgcacactcacggcccagcacacagccccaggtatgctcagtggctgccgcttgccactggctgactggctgggattattggaactgaagccctgcatgacccagtccttcttcctgctgcgaagcacagcagaggaaacacttgcttctcacaaactggtcattcctccaccaagagatgagtgccccagtgagttaccatgagatccaagcctgtacagtgtcatcagccgctgacctcacggtgctgatgttacaaaggcaccttgtaaactgctgcctatgtttagatgatggctttttttttttttggagacagagtctcgctctgtcccccaggctggagtgcgatggcatgatcttggctcactgcaagttccgcctcccgggttcacgccattctcctgcctcagcctccccagtagctgggataacaggcgcccgccaccacgcccagctaattttttttgtattttttagtagagatgtggtttcgctgtgttagccaggatggtcttgatctcctgacctcatgatccacctgcctcggcctcccaaagtgttgggattacaagtgtgagccaccacgcccagcctctttttttttttttttttaagatagggtctctctctgttgcctaggctagagtgcagtggcacatcatagctcactgcagcatcaacctcctgggctcaggcaacactctcatctcggcctcttgcgtagctgggactataggcgtgtactaccaagcctgcctaattttttttttttttttttttttttgtattgacagggtctcactatgttcaccaggctgtttcctattttttaaagttatgaaccgcataacaagagagtatacaaagcacatctgcctgagttaaatgataattaatacttatttatttttgttgtagagacgggggtctcactctgctgcccaggctgttctcagactcctggattcaagccatccttctgccttggctttccaaaacttctgggatagacaggcgtcagccacttgtatctcttttaatttggaatagcccttggcaaactggcttgccacctctttttgtaaataaagttttattggcacacttactcatttatatattatctgtggcagcttttgtgccacagcagggttaaatagttataacaaagaccatatggcccataaagctgaaaatattttattatctggttcttttgtttgtttgtttgtttttgagacaaagtttcactttgtcacctaggctagagtgcagtggcatgatctcggctcactgcaacctccacctcccgggttcaagtgaatctcctgcctcagcctcctgagtagctgggattacgggcatacgccaccatgcccagctatttttttttatttttttattttttttatttttttttgagatggagtcttactctgtcacccaagctagagtgcaatggcccgatcttggctcactgcaacctccgcctctgtgctctgtggttcaagtgattcttctgtctcaacctcctgagtagctgggactacaggcgcgtgccaccacgcccggctaatttttgtatttttagtagagatggggtttcaccatattggccagactgatctcaaactcctgacctcatgatccacccagcttggcctccgaaagtgctgggattacaggcatgagccactgcacctggcctgttatctggttcctttttttttttttttttttttttttttttgaatcagagtcttgctgtgtcacccaggctggagtgcagtggcgtgatctcggcttattgcaacctctgcctcccagctttaagtgattcttttgcctcagcctctggagtagctgggactataggcacgtgccaccacgcccagctaatttctgtatttttagtagagacggggtttcaccatattggccagactgaactattcctccaatacggccaaaatgagattctaccagcaatgggaggagtttttttaattattattattgggagtctctctctcacccaggctggagtgcagtggcaccatctcggctcactgcaacctccacctcctgggttcatgcaattcttccacctcagcctcccgagtatctggcattacagctgcccgccaccacacccggctaacttttgtattttagtagagacggggtttcactatgtaggtcaagctggtcttgaactcctgacctcaaatgatccacccgccttggcctcccaaagtgctgggattacagatgtgagccaccgcacccagccctagttctccatgtattttagagctctgtagtggaccttgataagcaggaagatgttacccctggatgaacaaaatgggaatgtgctggtcctggccagggcgtaaggagccggaggtgcctttggacacagctcttgggattggaatggatacagccttttgggagggcattttggcaatacatatgaaaaactagcattgctatatttagaaatttgtcttaaggaattatttcgacgcctgtgtctttgtcaagatgtatgattacagtgttgaacagcttaaatgtccctcaataggttatagaacagaagagtaatagttgataatatttgggtttaaaattatacctatttatttatttatttattttttgagacagtcttgccctgtcaccaggctggagtgtagttgtgcgatctcagctcactgcaacctatgcctcccaggttcaagcgattctcctgcctcaacctcctgagtagctgggactacaggctcaccccaccacaccaagctaatttttgtatttttagtagaaacggggtttcaccatgtgggccaggatgatctcgatctcttgactttgtgatccgcccacctcgacctcccaaagtgctgggattacaggcatcagccactgagcccgccctaattatacccgtttagattgtgcacttttaaaaatgtctagaaggggctgggcgcagtggctcacacctgtaatcccagcgctttgggaggccgaggcgggcggatcacgaggtcaagagattgagaccatcctggccaacatggtgaaaccccgtctctactaaaaattcagagtagccgggcgtggtggcgggtgcctgtagtctcagctactcaggaggctgaggcaggaaaatgacatgaatccgggaggcggagcttgcagtaagccaagatcgcgccactgcactccagcctgggtgacagagcgagactccgtctcaaaaaaagtctagaaggatgtgcaccacactggggagattggaggtagttctgtagggaggctttccctttcacttgtctgtgttccagtttgcttggtgagcacacagcattgtgttcaggagtaggagctggcagagcacacttcctttggggaagtggtggaattaagtgatttgcttactaggatgggtaacttggaggggcaggtgactgtgtcatctaaaatttgtcctctagatgccccatcctggcccagaagggctggtttctatgtgggttgtgaagactttttctgccctcatactttaatttcacgcctcaaatttcccttgcttcctacatgttaacacaggcctgctccctgacatttgtctgggaatagcatatagaacccactggccattatgggtaagaagagaattgcgagaatgtgaccagggcactgaaacatctgatatctctaggacagatataggaagcacagatatagtctttcctttaacttataaaggtaaaaataaaagtattgtgaaagaatttctgcttgccaaagttcaaaggtcttttccaaccacttatgaatcccttgctcagatttcattttcacgcctagatgccagcattaacactgctatctgaatcgggccctcctgctagaagttgtttttattcaggagagcctactactgaatttctccagatgtcatggtcacagttctgttcccagtgctccattttccttgtcttcctctcttttaggtactgcttctccgagatggccccagtgtgtgcggtggttggagggattttggcacaggaaattgtgaaggtaaaacatcactgtggagcagaaaattgttaaccatgactttgtatatgtgctgacagagagaatggaaactgtcttagacagctgcctgctttctctcaccccattcatctttgtttcatgccctccccatttccacctcatcccattttctctggcccatccaggtgccattcagcaaatgaccttggagtgcctgctctgtgcttagctcacagttggccatagtgcctcgaaggtgtgatctgctctcccctaactgtattagttatccagtgcctgttgtattggtcagggattctgcttctcatagctctataagtgagtactatcatgatccccacttaagaggaagacacttgggcccatgaaagggactccagaacctgtgctcttaacctctgtacagtttatctctattcatcaccatgacatcaaagccctcccttttttttttttttttttttttttttttgagatggagtctcgctctgtcccccaggctggagtgcagtagcacgatctcagatcactgcaagctccacctcccgggttcacgccattctcctaccttagccttccaagtagctgggactacaggcgcctgccaccacgcccagctaatttttttgtatttttagtagagacagggtttcactgtgttagccaggatggtctggatctcctgacatcgtgatctgcccacctcagcctctcaaagtgctgggattacaggcatgagccactgtacccagccgcaccccccccctttttttttttttttgagacagaatctcactttgtctctcagactggagtgcagtggcatgatcttgactcactgcaacctccgcctcctgggttcaagcgattctcctgcctcagcctcccgagcagctgagagtacaggttcccaccaccacaccaggctaatttttgtatttttagtagttcaccatattggccaggctggtctcgaactcctgaccttgtgatcctcccacctcagcctcccaaagtgctgggattataggtgtgagccaccgcacccggccaagcccccgtctttttaaccacacactgtaggtatttgtagagaaatcagtttctgtgtccccatgaacacaccaggagcccctcaaggctctgtacaggatgacccgtgaccctgttaggtaggtgttagtgtgtctctcagaagggaagcatcttatacagggtcacataaccagtaactagcacagccttttgagggtcttctggaacatttgggttgctaaaactataccatacccccaaatatattgtacattctttgcagactttgctatttgcccgaagatgttaaatttgccttttgcaggttcttggctgccttcgtggactccggtgaggctttttccttctttcttatggagcagagtcgtgcctggttaaatgattggccatgtccatgtacatgtcaagtttgagcttgggaggacagtttggaggccagcccttaacactttgtcttggggtctgtacattctggaggcgtttggctcaatttgttagtcacaccgttttcctaaggctactttttttttttttttttgtctattttttctgatccttctctctggtctaaattcttcctttgatcaaatctaactttcttctatgtaatgggcaccgaggagatatttggagggggaagaaaagtgtgcaatggccatacctctttccttgctcacattttatacatagcccagagtgatgtgaaaattacagtttatatgcccaatctgagaagagggtaatggccacccagaggactgttcgagcaggattctgaggctccctgtagacaaactgcaggaaagagtgcagcaatgggaatgttctaagtggggaatgggaatgtacatatttttgtagcctaaaatgacgacaccaccaataatagacaagacttactgaaagcccactgtctgccacacaaagacagtgttttttacgtggatactcatttcatctcccaccggccctatgaggtaggaactcctgtgatccctggtttataaaagagagactaaggtgcaggaaagaagatgcttgcccaggctagtgagtgtggtgccaggatgtgggcccaggcagtctggtttctgagcctgtcctcttcaccacggggcagtcatgcatcaggtgttgccttcaatggcaccatcatgtagagactgcatggaccccagggccgctgcccttgcattgtcagccttacttctgcacatcccattgaggggctccccctaaatttttcatgtgggatggagactggaggttggggcaggtagccttgaccccattgttggtggtagtttctcacatccccatcctcacacagccccctccttcctgcctgctggagacagctggtgcccagcatcttgtttctgtttatcccagatagccagagtactctgcattcttcgttgctgggtgtgtttggaatctcctcctaccccatcttgcttgggaagcactttaccttttgccccatgtcaccccatgccctgctctcatccccagtactccttcatacttattactggtcagccttcagccagctggcaggcggggcctgcagtccaagggcctcagactcacctttctctcctgaggcactgtctgagcgcctatggaaagcttacactaggagatgggtcaagcgcaagtctgctcctttggaatcatcttttgcgtctttcctttcttacgtccttctagataccctattttatatccatgtctacttccttgggtttaaagcagttttcctttctctccatccccaccgtccacggcaggtctccctgtctatggtaagagaggtgatagtgaaagcagcagccatcccaggttcatggtaaaacacataccatctcctgtatcttgggtttgagggtctaagagttccacctgtgtactgttggacccttccacctggctaggttggtggcatccccagtattggtaaaggactcctggccctattattattaatagcagctcctacttactaagaatttactacgtgctcggcactttacaagcctagtcacatttcattctcaccaaaactctagcaggcaggtgctttttatttgcctatttgcccagagaagcaaacttctttctgatccaagctccatgtggacagagacctcagaatccttaatgtctagctgaatacctggcatagagtagatgcttaataaatgttcccttgactgggtgcagtagctcatgcctgtaattccagcactttgggaggattgcttgaacctagaagttcaagactagcttgggcaacatgaggagacctcatctctacaaaagtcccagctactcaagagggtatgggaggatatctggagctggggagacggaggttgcagtaagccgagaatgtgcctcccacctgggtagcagaacaagatcctatctcaaaaaattaaaaacatttacaaataaataaaatttccctggaaaaatggctgactaacactatttgtatatggtagatgtgattgtccctgttttatggatgaggaaaagggtttggtgctgagtttgaagaggagcagttcaggatgtgtagccccaccttcctcatgaatgatgggacggtgctcctgggaaccgttaaaccctgccctggcagcttgcctaggtgatgtcttcctctttaaatggtagcttgtggtgaaatttcaatcctttctgggttaaggacctgtttgaaaatttgtgacaattgtgaaccctttctcagaaagatgtatgtgcatacaagactcagtatgttgtttcgggggctgaccctgcctcaaaagacagggccacgtgctcactctccttcccacccctctctctcgctctctgttgcccaggctggagtacagtggtgccatcacagctcactgcagacttgatttccctggacttaagtgatcctcccacctcagcttcctgaggcactgagactataagcacacgccaccacatccaactaattttttttattttttgtagatatggggttttgccatgttgcccaggctggtctcgaactcctgggctcaagtgattctcccgcctcggcctccctaagtgctgggattacagatgtgagacattaagcccagccctgttcttgtattttaaagtgctctgtctggtaaccccacaagataatcaccattgccattgctaaatagcattgtccaggccctctggatcccagccctgaccccctgtggaagcctagcgactctatgtcctcatggaatagcccccgcttctgcatcagtgtgttccttgattaaatgtgtccccttaggtgataaaggccacagcctaagaactgccacctttctcagttgaatagtcatgaataattatttctgctgtttgcccaatggtggtgcaacacagtgttagtcattgttttagttttaaggtgtttttttgtttgtttgttttttgttttgagacagggtctcactctgttccccaggctggagtatagtggcactattacagctcactgcagcctcaatgtcccaggctcaagcgatcctcccacctcagcctcccgagtagctggcaccttgggcatgcatcaccatacctggctaatttatgtcatttttctttttctctttttttttgagacagagtctcactgtgtcgcccaggctggagtgcggtggcgcaatctcagtttactgcaacctctgcctcctgggttcaagcaattctcctgcctcagcctcccgagtagcatgccaccatactcggctaatttctgtatttttagtagagacaggtttcaccgtgttggccaggctggtctccaactcccaacctcaggtgatccgcccacttcagcctcccagagtgctgggattacaggcgtgagccactgcgccccacctattttagttttcatatagacgggatctcaccatgttgcacagactggtcttgaattcctgggctcaagtgattctcccacctcagcctcccaaagtgctgggattacaggtgtgaatgtgcctggccctggcctgttttacatttttgagatacatagtttaacccaggcaaatacatttcttaatctcatgttaggaaaataaggtaatgtttggagaggttaaataatctccccatggacacacagcttgtaagggacagagcaaggagataggacaatcaaaattgtctccagacattgccaaatagccctttgggagcaaaatcgaccccagttaagaaccactgccctagactgcttttagaatttttttttccctctattcctcttaaagcacttgagctaaaccctcttttcatttttctccccaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctattctga

SEQ ID NO: 2706 - DNA, 79815 bp, Homo sapiens
catgcgcagaagcactccgggcgtgctgccggcggcggtaggtggcgcgcgggtccggcgggcggttggcttgagcgggaccggagctgaggcaggaagagccggcgccatggtggagaaggaggaggctggcggcggcattagcgaggaggaggcggcacagtatgaccggcagatccgcctgtggggactggaggcccagaaacggtcagggccggcgcggcttgaggccgctagggtctggagggggcgtctattctgaggcgtttgcggcccggaaggagcgggaaggtgtgatttgaagggaggaggcgggaattctgtgctctgggatcgtctctctcttggggggactggaggagttgattggggatgtttctggaaggtctgggaagtggttgggagggccgttccgaaggatgggagctctgaagggggcgttggggagtcctgagagagcgggagaattcaaactcaggaaatccgaggcccgaaagcggtgattgtggggtttgatcgcggttaggggataagaggggctggggatacgtggaaagggtgaggtgagggacgcagttcattcattcgagggtatgggacctggttccgtgctgcacacaggggagactggactggccaaccggacagacgggagcttacactcttgtgggagctcacgggcgggccagtctgagagaatgcgggttttgaggagttttggagcaagttatctcaaatgggaatcttgagaggctcggagaggctggagggggacggccgtaggctcccgaaaaggttgcttgtgtttggtatggggctgtgtcttgataggacaggagacgtagtttgggcattgtggagtagcttagggaattctttttttttttttttttttttttgagatagtctctctctgtcgcccaggctggagggcagtggcgcgatctcggctcactgcaacctctgcctcccggattcaagcgattctcctaactcagcctcccgagtagctgggattataggggcccgccagcacgcccggctaatttttgtatttttagtagacacggggtttcgccatattgacgagactggtctcgatctccttacctcaagtgatccacccgcctcggcctcctgaagtgctgggattacaggagtgagccaccgcgccaggacgtcttttgttttgtgcagttgggtgacctcggttcactgcagcctctggcctcccgggttcaagacttcctctcacctcagtcttctgagtagctgggattacaggctcgcgccaccatgcctggctaatttttgtatttttagtagacatgggttttcaccatgttggccaggctggtctcaaactccggacctcaagtgatctgcccgccacagcctcccaaagtggttggattacagacgtgagccactgtgcccagcttgttttttttttttttctttctctgtggcccagtggagtgcagtggtgggatcacagctcactgtagcctcaacctccaaggctcaagggatattccctcttcagcctcccaagtagctgggactacaggcgtgccccaccacatcatccgactaatttttgtttttttttttttttgtaggatggggttttgccatgttgcccagactggtcttgaactcccaagctcaagcgatcctcggcctcaagagatctccccccatctcagactcctaaaatgctgggattacaggcatgagctaccatgcctggcctcattgatcaatatttttacttagcctggacgcagtgactcacacctgtaatcccagcactttgggaagctgagttggggggaggggacctcttgagcccaggagtttgagactagcctgggtaatgttgccaaacccagtctctacaaaaaaatacaaaaattagccaggcatggtgacataagtttatagtcccagcttgtcaggagactgaggtgggagcatcacctgagcccctgggaggtggaggttgcagtgagccatgatcacaccactacaccccagcctgggtgacagagtgaggccccgtctcaaaaaaaaaaaaaaaatccacaagcgtgtgtatatgtgtcagttattaaaggatggtgaagtgagagggttgttttgataggttggccagggaagggctctgaagaggtaacattgagcctcagacttatatgggaaagagccctgtggtcatctgggagaactttcctagctaagagaacagcaagtgcaaattcccagaggcccaggcatgattgtcaaattagagaaataaggtggcaggaaccaaatgatttgaggagtagcttttattctaagtgtgtgggaaaacctgttggagtgttttgagtgtgggagtaacatgatctgttttttgtttgttttttgagacggagtcttgctctgtggcccaggctggagtgcaatggcacgatctcggctcactgccattgcagtgaatccgcctcccaggttcaagcgattctcctgcctcaccttcctgagtagctgggactatcggcatgtgccacaacacccggctaatcttgagtatttttagtagagacggggtttcaccatgttagacaggatagtctcgatctcctgacctcgtgatccgcctgccttgggctcccaaagtgctgtgattacaggcgtgagccactgcggcctggcctggtttgtgttttaaaatgatcgctccagaataggttaaagtggtcagaaatggaagtaaagattctggctggactgttgcagtaatccagttgagataaaaatattggtggcttgaaactcaagagaaggggtcaaataaatatattctggatatattttgaaggtagaagagggaacagaatttggggcagaagtccaggatgacaccactgtttttggcttgagcacctacctggaacgatggaattgccattttgaaagatatggagagctgtaggtttggtggggtcggggaagagtcagttctcttttaggtttcagatttgttttttttgtttgttttttttttttttgagacggagtctcactctgtcgcccaggctggagtgcagtggcatggtctcggctcactgcaacctctgcctcccaggttcaagcaattctcctgcctcagcctcccgagtagctgggattacaggcgcccgccaccatgcccagctaatttttgtatttttagtagagacggagtttcaccgtgttggtcaggctggtgttgaacccctgacctcgtgatccacctgcctcggcctcccaaagtgctgggattacaggtgtgagccaccatgcccggcctcagatttgtttttttatacaactaagtagaaatatgtgaggggttgagttcagaggtaaaatttgggtgatggtgggtattgtgtgagtacagagtatagaattaatggaggggttggggaggcagacacgtcaggagaatttagtttgagggggtgggagctttcagaaggttttagagggtgcagtggtgggatgggaattacctcaggctcatttcagatctgtggggtcttctttgatggggtggggggatgtcatcatgaggcattaacattggtgggagggttgaaggcacctggaatagattgggaattaagtgatgagaatgtgcctctggacataggtggactgcattgattttagggactgctattttctggatggagtggaaagaggatttatgtgagttggaggaaactttgaggaagcttggtgtgttctgagatcctaaagggttggggaggggattctaaggtactggaagggttaatcgaaggggtttgcggcagcagatagctttgtttgaagtggggcaaagttggtgaggtttaaactggaatgtagttagggaactttcagagggatggggatgatttttctgagaagcagtgaagaatggatgggggcctctgagtgggagatgacctaagggacaagtcagggtcagggcatggaatttgtgggaggtaggaattattctgagggagtggagctgtaccaaatttggtggagaacatgaaaaggattggctgggggttgcaggagggagggaagaggttgtttgtaatttgtactctatttttagacagtcttagagagtttattaaagtgttttttgtccattttcagccgaggtttttagaaattaaaaatttttttgtgtgagtacatagtaggtgtatacattttgggggtatgtgagatactttgatacaggcatacaatgggtaataatcacatcagggtaaatggggtatccaccaccttaagcacttatcctttgtgttacaaacaatccaattatattcttttagttgctttgaaatgtacaacaaattattgttgactgtagtcaccctgttatgctatcaaatactgtatcttattcattgtatttaattatatttttgtatccattagtcatccctccttcccctccaccccccactacccttcctagcctctggtaaccctcagtctactatctgcatgagttcaattgttttaatttttttagttcccacaaataagtgacagcgtgcaaagttttctttctgtgcctgatttatttcacttaacataataacatccagtgccctccctgttgttgtaaatgacaggatctcattcccttttttttgtagacagggtctctctgtcgcgcagactagagtgcagtggtgtgatcacaactcacttcagccttgacttcttgggctcaggtgatcctcccacctcagcctcccggtagttgtgactatagcacgtgtcacaagcccagctaatattttagtacaggtggggtttcaccaggctagtctccaactcctgggctcaaataatcctcctgcctccctgcaaagtgctgggattagaggcgtgaacagcaatgcccagcctttgtaccacaatttctatttttttttttgaaacggagtctcgccgtgtcgcctaggctggagtaggctggagtgcagtggcgcagtcttggttcactgcaagctccgcctcccaggttcacgccattctcctgcctcagcctccctagtagctgggactacaggtgcccgccaccacgcccggctaatttctgtatttttagtagagacggggtttcaccttgttggccaggatggtctcaatctcctgacctcgtgtaccacaatttctttatccatttgtctgttgatagacatatgggttgctttcaaatcttggctattgtgaagagtgctgcaataaacatgggatttattgcagttttttttcttttgagaccgagcctcgctctgttgcccaggctagaggacagtggcacgatctcagcccagtacaatctccacctcccaggttcaagcgattctcctgcctaagcctcccaagtagctgagattacaggcacctgccaccacgcccggctaatctttgtattttttagtagagatggggttgctgtgttggccaggctggtctcaaactcctggcttcaggtgattggccctccttggccccccaaagtgttgcaattacaggcgtgagccaccacacccagcctgatttattttcatttgggtatatacctagcagtgggattgcatttttacccgagtcttttttttttttttttttgagacggagtttcgctcttgttacccagactggagtatggtggcgtgatctcagctcaccgcaacccttgcctcccaggttcaagcaattcttctggttcagcctcccaagtagctgggattacaggcgtgtgccaccatgcccggctaattttgtattttagtagagacgggattcctccatgttggtcaggctgtgaactcctgacctcaggtgatccgcccgccttggcctcccaaagtgctgggattacaggcatgagccacagcccccggccttcacctgagtcttatagcagctctctggagtcggaagggcagtgatttccttctctgttcagatgaggaaggaggctccacagagcaaattgacttgcctctaagagggctctaggtgggataggagggttctaggtgggataggagaactctggagactggagttcctttatgaaacagaagccctggaaatgggcaggctgataaaatgtacaaattgtggggcattttataagacagttatcctacttctcttccaaaagtcagtttcatgggaaaaataagtgaagggactgttgtggattaaaagagagtaaaggccgtcacagtgactcagcctgtaatcccaggactttgagaggccgaggtgggtggatcacctgaggtcaggagttcgagactagcctggccaacatggtgaccgtctctactaaaaatacaaaaaaaattagccaggtgtggtggtgggtgcttgtaatcccaactacttgggaggctgaggcaggagaattgtttgaatccaggaggcagaggttttagtgagccaaggtcacactatcgcactccagcctgggtgacaagagcgaaactctgtctcaaaaataaataaataaaataaaataaagtaaagaagcagcttcctagagcagatttggttgcttaaattgaggccaagtttctggagtttttattgatagttgacaattacaactaaaatttttttttctcgctctgttacccaggctggagtgcagtgacgcagtgacgtgatcttcagctcactgcaacctccacctcccgggttcaagggattctcccgcctcagcccccaagtagctgggaccacaggcgtatgccatatcactcagctaattttgtgtgtgcatggcgtatgccgtaacactcagctgattgtgtgtgtgtgtgtgtgtgtgtgttgttttttttttttttttgtgatggactctcactctgtcgcccaggctggagtgcagtggcacaatcttggctcactgcaacctccgcctcctgagttcaagcgattctcctgccttagcctctggagtagctcggattacaggcgcgtgccaccacacctggctgatttttatatttttagtagagacggggttttaccatgttggccaggctggtctcaaactcctcacttcaagtgatctgcccacctcggcctcccaaagtgctgggattacaggcgtgagccactacacccggcctatgtgtgtgtattttatttttttatttttttgagacggaatttctctcttgttgcccaggctggagtgcaatggcgtgatctagactcactgcaacctctgcctcccgggttcaggcaattctcctgcctcagcctcctaagtagctgggattacaggcgcctgctaccgcgcccagctaatgtttgtatttttagtagagaccaggtttcgccatgttggccagggtggtcttgaactcctgacctcaggtgatctacccgcctcagcctccttaagtgctgggattacaggcatgagccactgcgcctggccagaagttaccttctttgtgcctgttttctcagctgcaaaagaggggtaacaaagtgccagcccattagattgtcatgggaattaaatgacataatacatacaaagagcttagtagaacagtgcttggcacatagtaagtgttagataaatgttggccattattattttattatgtaccagatttctataattctgctgatggacacaggtttgttttggtgtgtctattaattcacagccatttgagtaacagtatgtcctaaatgccaaggaagttactggttctagtgatacagtggtttctggagtttacattctaatggaggagggggcagtaaacatataaacaagtagtgtagcttagcacagtggtgtgtggctgtgatcccagctactggggaggctgaggttggaggatcacttgagccaggcaattgagactagcttgggcaacttagtgaggccccatttcaatcaaaacagtgggcaacacagaccccatcttaatcaaaacaaaaacaagtagcataattcgagatagaagaggatgtggacctattttaaattaggtggccagtatggacttctctaaggaggtgacaattgagctgagacctaaagaatgtgtcccttaagaagttgagggaagaagcaatgggaagcactaatgccaaggtcctaaggtgggagcaaggatgggagcaaggatgatgttctctaggatcagcctcccgagtagctgggactacaggcacgtgccaccacgcctggctaatttttgtattttgagtagagatggagtttcaccatattggccaggctggtctcgaactcctgacctcaagtgatccgaccgcctcggctaattttgtgtatttttagtagagacggggtttcaccgtgttagccacgatggtctccatctcctgaactcatggtcctcccaccttggcctcccaaagtgctgggattacaggcgtgagtcgccgcgcctggcacacccagctaatttttttttgttttgtacagatggagtcttactttgttgcccaggctggtttcgaactcatgggctcaagtgatcctcatgccttgccctcctaaagtgctgggattacaggtgtgacccactgcgtccagcctgctgtagttttgtcggagagaaacgatggtggctcagactagagtggtgtttgtggaacttgagggaagtagatggacaatgctgctgtgaatgtgtatctttttttttttttttttttgagacagagtctcactcttgtcacccaggctggagtgcagtggcgcgatctcggctcactgcaagctacaccttccgggttcacaccattctcctgtctcagcctcccgagtagctgggactacaggcacccgccaccactcccggccaatttttttttttttttttttgtatttttagtagaaacggggttttaccatgttagccaggatgatctcaatctcctgacctcgtgatctgcccgccttggcctcccaaagtgttgggattataggcgtgaggcaccgtgccctgctgaatgtgtatcatttttgtgcccacttgggtatttctttttttttttttttttttgagacggagtctcgctctttcgtccaggctgaagtgcaatggtgcggtctcggctcactgcaacctccgcctcccgggttcaagcgattctcctgcctcagcttcccgagtagctgagattacaggcgcctgccaccactcccggctaattttttttttttttctttttgaaacagacccttgttctgttgcccaggatggaatgcagtggcgccatctcggctcactgcaaactccacctcccgggttcacgccattctcttgccttagcctcccgagtagctgggactacaggcgcccgccaccatgcccagctaattttttatatttttagtagagatagggtttcaccttgttagccaggatggtctcggtcttctgacctcgtgatctgcctgtctcggcctcccaaagtgctgggattacaggtgtgagccaccgtgcccagcccacgcccggctaatttttgtaattttagtagagatggggtttcaccatgttggccaggctggtctcgaactcctgacttcaggtgatctacccaccttggcctcccaaagtgatgggatttgtaaacccagcactttgagggaggcagaggcaggaagattgcttgagcccaggagctggagatgagcctgggcaacatagtgagaccctgtgtctacaaaaaaaaaaaaaaacccataaatcagccaggtgcagtggtgtgcacctatagtcccaggactcaataggccgaggtggcgggatcacttgaacctgggaggttgaggctgcagcgagccctgatcttgccactgcccttcaatctgggttcacagaatgagaccctgtttcaataaaacaaaacgtaaacatggtatttggtgttgatggcagttgagtatttaatttaatttaatttaattttttttgagacggagtctgtcacctgggatggagtgcagcggcacagtcttggctcattgaaacctctgcctctcaggttcaagcgattctcctgcctcagcctcccaaatagctaggattacaggtgcccgccaccaacatgcccagctaattttttttttttaaacagagtctcgctgtgtcacccagactggcatgatctccgcttactgcaacctccgcctcccaggtttgagtgattctcctgcctcactgtcccgagtaactgggactacaggcgcctgccaccacgcctggctaatttttgtattttctgtagagacacggttttgccatgttagccaggctggtctcgaacccctggactcaagtgatctgcccgccttggcctcccaaagtgctgggattacaggcgtgagcccccacgcctggccataattttttttgtatttttagtagagagggtgtttcaccatgttggacaggctggtctcgaactcctgacctcaggtgatccacccatctcagcctcccaaagtgctgggattacaggcatgagtcaccgggcccggctgaataatgaattttaaacaactgcagagcagtctgtagagctatgtaggaatgtaggtcgtggagagcagatttattgtcagggactttttatatgtagctgttgctggaagagttcggggagggggagtgcttgctggtattgactcagccatgataaaaaagcctttttttgaggaaatggcattggagttgggttttgaaggggaaaggcgtaggtaggcattgagaggaagaaatggtgcattttgcgagggtggaatgttgtgattaaattttatttaatttttaattaaattaatagcaaactcttaccagcagaacttaaattgtgtgaaaattattcttagttattactaaatccttttcagtatgaataatacatttgctgcagaattattaatgagtttggttacatgatgcagcccaagatcttgatgagttgtttcataatacatgatgtaaagtctgtatttcctttttgaaatctgaaaaaattgtgactctgaaatacttctggttcaagagatttcagataagatatagttgacctattctgcttcctactgacctcagagaagtcttgggatggcctgacctctgattgccttttttcagcctcatcttctgtcactttacagatttaaaaagctaaaaacaaggctgggcacggtggctcatgcctgtaatcccagcactttgggaggctgaggcaggtggatcacttgaggtcaggggttcgagaccagcctgaacaacatggtgaaactccgtctgtaccaaaaatacaaaaactagccaggcgtgacagtaggcgcctgtaatcccagctactcgggaggctgaggcaggagaattgcttggacctgggaggcggaggttgtagtgagctgagatcacgccactgcactccagcctgggcaacagagcgagactctgtctttaaaaaaaaaaaaaaaaaggtaaaagcaattcctgtgtacatgctcttttcatgccaccatgtgttttgcttgtgtgttatacttaactagtgcctcttctcagcacctcttctgctgtcatgctagtttgagccaccatcatcctccctcaccttaactgtgacatcttcctacccccatggctttccatcatgcctcgaagaaaatccagaatccttccattgcatgtaagagccttcatgatgtggccccttgttccaacttttcagcctctctgtcattcctgtccctagaacatgccaagcactcctgcttcagggcttttgcatttgctgttttctctatctggaatgttctgctgccaaatatctgtgtgtttgtcctttatttcattttgatttttgctcatatggcatctcctcagaaaggcttgtatgatttctgtctcaaatagcgttctccatcattcttgattcttgtcacacttgattttcatcactttttcacatattatgtatctatttgtttatctgtctcctactttttcatgagggcagggactatgtctgattcaccgccttatttccacaccatagaaggatgcctggcatagttggtactcaataaatatttgttgaatgaattgttttgtgcagtatggattagagcctgtctctttcctagattcgaggtgtgatgcctcaatgcagttagaaccaaaatgatttttttttttttgagacggagtctcactcttgttgcccaagttgaagtgcagtggcatgatctcggctcactgcaacctccgcctcatggtttcaagtgattctcctgcctcagcctcccaagtagctgagattacaggcgcctgccactacgcccagctagtttttgtattttagtagagacggggtttcaccgtgttggtcaggctggtctcgaactcctgacctcaagtgatccgcctatctcagcctcctaaagtgctgggattacaggcatgagccaccgtgcctggcaaaccaaaatgatttgtgtattttttgttcttctgtgattctgcaagctcactgttctgtatcatcaggttaacaatgtttgtcttacaggctgcgggcctctcgggtgcttcttgtcggcttgaaaggacttggggctgaaattgccaagaatctcatcttggcaggagtgaaaggactgaccatgctggatcacgaacaggtgcgctgttgtgagctcattcctcccctgctctggctcccctttccagcatgaagatctgcagattttgtgagttcctccttgtgccttaagggctgtgaaaggagggctaacattaataaaccattgcctctggagactgaaggtgctattgttgggtttgaattctagctccaccacatctagctggatgagcagtagagactcacaccccctcattgagcttgcctgcctgtaaaatggggttagtaatatctcccttggtggttgcttgtgaggaggtgtagagaagtgtttttccaatttgtgcctaaaaatgacctgagtgactaactgaaaatgcagagtggcctggaggcttcgtggtgccctagctttcacccctagtgattctcatttaggtctgaggcgagctcaggagtatgtgcatttaaaaggtgttttagggctggacgcagtggctcatgcctgtaatcccaacactttggaaggctgaggcaggcggatcatctgaggtcaggagtttgagactagcctggccaacatggcaaaactctgtctgtactcagtatacaaaaattagccaggcatgttggtgtgcacctgtaatcccagctactcgggaggctgaggcacaagaatcgcttgaatctgggaggtggagtttgcagtgagctgagatggcaccactgcactccagcctgggcaacagagtgagactttgccttaaaaagaaataaattaatgaaaggtgtttcaggagattatgatttagatggtccacagacatcactttaaaaaacactggatcaggccaggcacagtggctcatgcctgtaatcccagcactttgggaggctgaggcgggcagatcatgaggtcaggagatcgagaccatcctggctagcacggtgaaaccccatcactactaaagacacaaaaaattagcagggcttggtggcgggcgcctgtggtcccagctactcgggaggctgaggcaagagaatggcgtgaacctgggaggcggagcttgcaacgagccgagatcatgccactgcactccagccttggcaacagagtgagactccgtttcaacaacaacaacaacaaaaacaaacaaaaacaaacaacactggatcagagagaatgtgggcagactgctttgtatagtgcttgaacctaacaagtatccagtaattaggaataatgatctgacatgctgtttgtttgtttgtgtgtttttgcgagacgagtcttgctgtgatgcccagactggagtgcaatggcgcaatctccgcacactgcaacctccgcttcccgggctcaagtgattctcctgcctcagcctctgaagtagctgggattacaggcacgcaccaccacgcctggctaagttttgttttgttttttttttgagacggagtttagctcttgttgcccaggctggagtgcaatggcgtgatcttggctcactgcaacctctgcctcccaggttcaagcaattctcctgcctcaatctcccgagtagctgggattacaggcatgcaacaccatgcctggctaatttaacgtttttagtagagaccgggtttctccatgttggtcaagctggtcttgaactccgacctcaggtgatcctcccacctcggcctcccaaagtgctgggattgcaggcgtgagccaccgcacccggccatgcctggctaagttttgttatttttagtagagatggggtttcaccatattggccaggttggtctcgaactcctgacctcaggtgatccgctggcctcggcctcccaaagtgcggtgattacaggtgtgagctaccatcccctgctgacataatgctgtttgattaatattataatggtagagcccaactccaatgtagctttctctgaccaggctcatcttcaaggtgaaaataagtgctgctctctctacattcccatgcctcagtgacattttatttattttatttatttattttgagacaaagacttactctgtcgcccaggctggagtacagtgacacaacctcagctcactgcaacctctgcctcccgggttcaagcacttctcctgcctcagcttccctagtagctgggattacataattacttcatctggttgtaagaatccaacattggaggccaatcacagaacagtgcgattctgacaccacaggtgtgaggccactgcacccatcttagagcgtattatgtagtttacattcaacaagcatctgagagcacctactgggtgccctgaagtctgctaggtgctggtgatagaaagatgctcacggtttggttcccattctcaaggtttttttttttttttttttccggaaaccatagcaggctccctgactgaggttgtggtacatgaaagatttcctggagtcctgatctgagctaagtcttaaagaacaaggagggttgtcaagataagagcctgtgttttaggcaggggacatagcagtgtcacaaaggcaccctacagtgtggtagaaatggaagctaaaagtagtttggtgtttttagagtgtgagacccaaagtggtgggtagggacaggttgctggtgaagtccaagtcaggaggggctcctaggaagccccactgtaagcttttacttaatcctctgggtggtgcagactcactgaagagtttcaaatgacaggaagggtgacatggttagctttgggctttatgtgtagatcagtaattactgtataaactatggttggcacaaaatacagggcagaagaccacttagaaggcagtttttagtagtttaggtgagaggtgaaagtggccttgctgatagggatggcaggaagcacacagatgtgagaaatagatttaggtggtagaattgggaggtctgtgtatgggagcttaaggaaagccaggaataaccagagcagctgacactgaaggggctaggcactgttctcagagctgcagttgtattatctcattgagtcctcacaacacatctgagatcaaggacccattaccatccctgttttacagatgggaaaactgagtaaaaggaagaaaagtactggcccatccaaggccccagtagttagtggtacggccgggacccaggcatctgactccagagcccatgttctcagccacctcactatggaccactctcatggaaatagcaaggatatgaagatgaggcttctggcttgagtgactgggtgggtggctggtggactccggagacagcacacagaagcaggcagacatgtagggtttatggatatctgagagaaaacggctggtgggcagtacagtagagaagactcaggtggatcaggaagaaatctgcaccagaaagagtgatttgaaaaataacagcagattttggtagaaactgaaagaggcattgagttggtttatggagctatacagagtggaaagataagtaattctgagatggaagcttggggacagccacacctaagagggcccaaattgagactagaatgtgtagcacgagaggagagcaaagcaaggaaggtgtgatctgtggactgatagtgatgaaatgataattgtatgtgtatgggttttttttttttttttttttttttttttgaggcagtctcactgttacccttgccggaatgcagtgggcatgatcatggctcactgtagccttaacttcctgggctcagggtattctcccacttaagcctcccagtagttgggactacaggtgcacgccaccacacctggctaattttttgtattttttgtagagactgggtttcatgattgttgctcaggctggtcttgaactttctgggctcaattatatgttttttttgtttgtttttttgagatggagtctcacttgtcgcccaggccggagtgcagtggtgagatcttggctcactgcaacctccgcctcctgggttcaagtgattctcctgtctcagcctcccaagtagctaggattacaggcgtgtgccaccacacccggctaatttttgtatttttagtagagatggggtttcaccatgttggctaggctggtctcgaacttctgacctcaagtgatccacccacctcagcctcccaagctgctgggtttacaggtgtgagccaccgtgcccagcctcaactgtatttttttttttttttgagacagagtctcgctctgttgcccaggctggagtgcagtggcgcgatcttggctcactgcaagctctgcctcccgggttcacaccattctcctgcctcagcctccctagtagctgggactacaggcgcccaccaccacgcctggctaatttttttgtattttttagtagagatggggtttcaccgtattagccaggatggtctcgatctcctgacctcgtgatctgcctgccttggcctcccaaagtgctgggattacaggcgtgagccaccacgcgtggccctcaactgtacgtttttatccatgtcctcgttttatatgggattcccacattcttgctgaggttcacacagttgttgagccaggatttgaatcaaagattgaatccagcctgaattatttcagagccttactgttaaccattgtgtggtacagcttctcagcacataatgagatccctgaagaagcaggatggaatgggtcaaggatacagggttagcctagaatgggaagtgggccagctcattttcttggaggagaaggtagtaagatagagagtgtgctgtggatggttggtaggaggtgttgaggggagattacttctgttgtacctagtcttggtgaaggtggcaaggttatttgcagagattaatggttaaattagatgtttgatgtgtgaagaaatactttgagagcagtatggaatctgtaatcttactggtggctattaggggattatattatcctgtctttgaggctctgctctgctgatgttcagccttaggggtgaaataattcctctgttccagtccccactcatctctccacctctctgagttctttttttttttttttgagacagagtctcactctgttgcccaggctggagtgcagtggcacgacctgggctcaatgcagcgtctgcctcccaggttcaagcgattctcctgcctcagcctcccgagtagctggaattacaggcgtgtgccaccacgtccggctaattttgtatttttagtagagatggggtttcaccatgttggtcaggctggttttgaactctggacctcaggtgatctgcctgcctcggcctcccaaagtgctgggattacaagcgtgagccaccgcacctggccatagtctatctatgttttttaaaagttcatttcaagcattcttaattgtgtctgatttttgcacaagtttgattttttttttaagttttctcatgaggttgcaatttttgttgttttttgagagagggcctctctgtgttgtccaggctagtcttgagctcctggcctcaagcagtgatcctcctgctttggcgtcccaaattgctgggattacagatgtgagctactgtgccaggctgcactggtctactttttttttttttttttttttttttgagacggagtcttgctctgttgcccaggctggagtacagtggtgcaatcgcagctcactgcaacctccgcctcccctgttgaagtgattctcctgcctcagcctcctgggtagctgggattacaggcacacaccaccacacctggcttatttttgtatttttagtagagatggcatttcaccatgttggccaggttggtctcaaactcctgacctcaggtgatcctcctgcctcggcctcccaaagtgctgggattacaggtgtgagccaccgtgccctgcccacactggtctagttttaaaccactggaagacagagatttaatcctttaaactacttgtgtatttccccaaatgcttatagttgggcacatgctaagtatttagtcaattcttgccactgttaatcagtcatttgttagcagttacaaatttgcatagaagaagaaagcatggatttttttgttgacagtgaattttctttataaacacaagggggtgctctttaaccatcaatgaccagtttaaaaaaagtttaaagtcattttaaagccttagaaggaagcctgcataaggcaaattgctacaggaacagtaatacattttagggctgtgcacagtgtttcatgcctgtaatctcagcactttgggaggctgaggcaggcggatcacgaggtcaagagattgagaccatcctggcaaacgtggtgaaaccctgtctctactaaaaatacaaaaattagctgttgtggtggtgcgtgcttgtagtcccagctacttgggaggctgaggcaggaggagaatcatttgaacccaggaggcggaggttgcaatgagccgagatcatgccactgcactccagcctggtgacagagcaagactgtctcaaaaaaaaaaaaaaaaaaaaatttaggtggtaggtattttagctatcctttaaaatttaaagattctttttaagatttattttccctaaaaatacaagacttaaaaaaatatgtgtattattcctaggtaactccagaagatcccggagctcagttcttgattcgtactgggtctgttggccgaaatagggctgaagcctctttggagcgagctcagaatctcaaccccatggtggatgtgaaggtggacactgaggatatagagaagaaaccagagtcatttttcactcaattcgatgctgtaagtttcttattataaaatctgctgtgggaattaaacaaattaaggtgctagttgtatatactttcaaatcccaaagcaatctgagagcattcaaatatcaaattctgagctttttcccaagaaaatgtataagctgttctattgtttaggcttagtatattgtgtgaatgtgttgctagagaggtccagtctgttgcatctgctgtagttgttggtgacttgctgtctgctggcttcttctctgggcatatgttccctcagccaggtttcgtctttggtgttttgtcttccttccagaatctttgcacataactttaatccatgttattgcaaatgttttcttccgaaaacttaacaagttggtgattaatttctgtggcagcggcatttttttgttagaaatatcaaactacagcttgtgttttgtcttaagaaaagcacacctgatcttgatctatgtctgtctgtctgtttctcacagtcacattgaccatgttgccatggataactagagaaaaatcactgtagtcgtaagtcaaatgaggcatatccagcctcatttagtttcactgccaaatctatgcggaggtgaaaggataaattctttgtcaatatctgcaacctttcagacatagttccctgcattctggaaaagcttaacaaatcttgataaatgtgaaatagtcatagatgagctactagttttttaaatgaaaggccccagtatgttacatgagaggttagaatttgggttgggtagttttttttttttgcacctttttttatttgagatggagttttgctcttgtcgcccaggctggagtgcaattgtgcgatcttggctcatggcaacctctgcctcctgggttcaagtgattctcctgcctcagcctcccaagtagctaggattacaggcactcaccaccatgctgggctaattttttgtatttttagtagagatggggtttcaccatgttggtcaggctggtcttgaacccctgacctcaggtaatccacctgcctcggcctcccaaagtggtgggattacaggtgtgagccactgcacctggcctgttttttacacttttctttctttctttctttcttttttgagatggagtctcactctgtcgcccaggctggagtgcagtggcatgatcttggctcactgcaacctccgcctccctggtttaagcagttttctgcctcagcctcccgtttttacacttttctatttcatatgtgcatctgttcaaatatgggcttggaaggatggatcatctgtgcatttgtcctgttttctttttcctagtcccttctattttttaacttgaggtattgggacactttccatttggacataagtcttcattttcttatctgtagtaaccacatttattttatgccaggtgtcccttgaacttgtagagttagagggtttgttaaaactgaagtgtgaggccagttgattgtgtaatgcgtgtgcatggggccatgttgaccgccttgcaggccgtgtttggctggtccttgcaggttttatagttactttagactctgcagggttccatttgatcaattggttgcatgttcacctgtggatttcttactttttagatgggatttttccttgggtggctgcattctttgaaacaccaaaggaacacatttctctgtgagtgttatttcggtattcaggctgctagacaacagcaaagagggtctatcaagtgaaaatgtccttttgttcaggagaaagcatgtgcaatttggaagttgtcttttgaccatgatcacaaagcttctcccgaaaagatggtattttgtgcagtagaacttagccatttccaatacctcaacttactggaatacaacctggaggccccagagcaacactgataattccactgagtggatcaccagttcattgtctaagcctgaatggaaggtcacttggtctgtaaccttttcttttgtccttaaattcagataaagtttcacaccgcaatctgtggaaaaatgatctcaacaggacttgtttatcttctttatcttaacatatcaatcaaaaggaggggggtaaaaagcccttgtatttaaacatgacctttgggtcaatttaaaaaactggttttgcttgtccctgtagcttatttggattttaatagatttagcagtatagaaacaacttgctaagttattttttttatgagaactatgaaatgtgtatatgttcgtggattacagaaaacatttgttgaatggcttttactttttagctaaacacattttattttggctgcagaacgtgacggtctcataacttatattttctacacattgaaacctgcaacttttcttttgtcttctagccatagggcccaaagaacctgttgtaccagtttgaaacatgctttgagcatgcccagagagactgttcattaagatttatttagacatcagggcagtgattcacagtttgcaaaactcaaacccagccaatttctttctttctgcaggtgtgtctgacttgctgctccagggatgtcatagttaaagttgaccagatctgtcacaaaaatagcatcaagttctttacaggagatgtttttggctaccatggatacacatttgccaatctaggagagcatgagtttgtagagtaagtgttgggagaggaggggagaacataacattttctcctttttatactttttttttttaaattatgtatttatttatgtgtagagacaggatctatgctatgttgttcaagctggtcttgaactcctgggctcaagtgatcctcccaccttggcctcccaaagtgctgggattataggcatgatccactgcgcctggtctgctgacatgttttcaagttgagagatagtaaaatgattacaaaatagttgggcgattctggaggcatattcaaccaaagtctaccttggaaaaggtgtccaatatccagagagactcctctggtagaacaaacagacctcatcctctcattttgaacactgaggctgcagaacttggtaattcttacatgacaggacttgccgtgttttgactttgtagtctctaggtgaaagatggcagatgatacattattgtaaaactatatgagttaggtattttggctgcagtttctgaccaccccctccaaaaccctccaacttgctaattgagagggaaagacaggctctgtgagataggagcttcctaccaagagactgagaactcttctcttgttcagcctctcaggcaagtcactgaaatttctctggtctccaagtttcttgcctgtaaaatcaagatgggggaaggacagtcatgttccagacatctcctaactctagtgttttatggctttaggataatctagttctttgggcatattattattattattattttattttttgagacggagttttgctgttgttgcccaggctggagtgcaatggcaccatctcagttcagaacaatctctgcctcctgggttcaagccattctcctgcctcagcctccggagtagctgagattacaggcatgcgtcaccatgcctggctaattttgtatttttagtagagacagggtttttccatgttggtcaggctggtcttgaactccggacctcaggtgatccacccacctcggcctcccaaagtgctgggattacacaggcgtgagccaccgcacccggctattattattatttttgagacggagttttgcttttgtcacccaggctggagtgccatggcacgatcttggctcactgcaacctccacctcctggattcaagtggttctcctgcttcagcttcctgagtagctgggactgcaggcacccgccaccatgcccggcaaatttttgtatttttagcagagacggggtttcactatgttggctatgctggtcttgaactcctgacctcaggtggtccacccacctcagcttcacaaagtactaggattacagccaccatgcctggcttctttgggtatattataaagaagttatagtagtgggaagcaatccagattattttaacataagctgcccacagcagaggggcagaattaagtttggcttttttttttttttttttttttttttttttctgagacagactttcactcagttgcccaggctggagtacagtggcgtgatctcagctcattgcaacctcctcctcctggggtcaaccaattctcctgcctcagcctcccaagtagctgggattacaggcgcccaccaccacgcccggctagttttttgtatttttagtagagacggggttttgctatgttggccaggatggtctcaaacccttgacctcaggtgacacgcccgccttggcctcccacagtgctgggattacaggcgtgagccactgcacccagccaagtttggctatttatttcatgattcaagtagagtgtttacaaagtaatcactttgatttattgagagcagctgtgtgcccagcagtgtgctgagcaacttacgctgctctgtttttcccacaataatttcctgagtgcccaacagtgtaccagactcatcatgttatcaatggcagagctcgatttgaaccgagatctgactccaaagcttttgcccttaaccaccatcccgatctgtgacctggagaggctttttttgattccaataacatgattcctagggtaaaattacattctctccccttgtcaccctctagggagaaaactaaagttgccaaagttagccaaggagtagaagatgggcccgacaccaagagagcaaaacttgattcttctgagacaacgatggtcaaaaaggtatgtgtaacgtgggggcagaggtcagaaaccctggggccttggaggggtcaggcaatgacgattgaaaaggataagagcaagcacttcttgaaggggtggggcgggtgcttgtcccatctaaagggaggctgccacagcttagtgtcagccagctgttgctgtgagggaatgtgggcccagtgattccagatgggatttttcaagacaatgagaaatgcaaacttttgtaggctctgtcccaaacttttttttttgtgtgtgtgagatggaattttttcttgtcgctcaggctggagtgcaatggcatgatctcggctcactacagcctccacctcctgggttcaagcaattctcctgcctcatcctcccaagtagcacccctggctaatttttttttgtatttttagtagagacggggtttcaccatgttggccaggctggtctcgaactcctgacctcaggtgatccacccgcctcagcctcccaaagtgctgggattacaggcgtgagccaccatgcccggccccataccctttttttttttttttttgagatggagtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagacggggttccaccatgttggccaggatggtatttatctcttgacctcgtggtccacctgcctcagccccacaaagtgctgggattacaggcatgagccaccatgcccgaccagaaaacttttttttttaaagcagcaaaacaccagccctgggttacagtagcaagaccccgtgtctacaaaaaaaatgtaaaaatttgtctggcgtgatggtgagcacctgtaggcccagctactcataggctgagctgggaggattgtttgagcctgggaggtggaggctgcagtgagccatggtcacaccactgcaccccaacctgggccacctagcaagatcctgtctaaaaaaaaaaaaagcaaaacaaaaaattttttgtattttctctactaacaatacaaaaattagctgggcaaggtggtgcgttgcttgtagtcccagctacttgggaggctgaggcaggagaatagcttgaactggggaggcggatgttgcagtgagccgagacggcaacactgcactccagcctggcgacagaacgagactctgtctccaaaaaaaaaagttttctttgcctgtttttttccttttgccaaataacctttaataagaaaaatccttcaatgttgtcttgctgtgtccaggctggagtggcacaatctcagctcactgcaacctccacgtcccaggttcaagagattttcctgcctcagcctcccaagtagctgggactacaggtgtgtgccaccacacccagctaatttttgtatttttagtagagatggggttccaccatgttggccaggatggtatgaatcctcagattcatatttgttaatgtagtttatattaggggctcagcctctatttggattaggtgcaataattacatttatagaaaggagtggagaagggatcagaagacgatggtttctgtagctagtgctggaatctgagatgggaaccatgcgatggggaaagcaagatgaaggggccagaattggtttcattgaactgagaggaaagacatgaccaagcccatatttactctttgctttgtagatttaaatgttgagaaagaaaaacagctggtcagaatgttgagttaaattacgctaacgaggggattctaaagagtgcagaaaccacaaaagagactgcagaaaaccacaaaagtggaactctcagactctccagcaaggcggcgttggagattttctttctcattttgtgtttgtgttggagtagtttggtgctgtaagtgtgatacagaggaattaagccctaattttagtgtctattcacagaaccataattatccagagtgaaccttggtgttttggccaaaacttgggtgcctttctttctttttgaggcccagtcaagatttatctgaatagctccgtgaatttggtggggggagataaattgttaacaaacggaggagtacaaaagctgctttgtgggtgctgtcagtttataaatcacaccctcttacaagtgtgacacttggccttggtgtgaagggttttatggcttaagggccttctctgattgaggcaggtctttcacattcaaatggagagagtgcctagctttgttagccattcacagctggaagtttccctggagtcagttctgatggtgcccactggggtggatctggaaacctcttttgggaaccactttatctcgctatgaggagaatgtgggcagcccaggcctttgcccaccattccggagggccctacaggcacagaggtttttgtgcagcctcttcctacgtggagctgagctggaaggtatcaaaatattccccagctgacattgttagtcagctgttacacttgaacaatgcaggctcggattccaaccccaagcccttaaggttacgaggcattcagtgcattcctgctgacaatccctgggattccaaaccttgcctttgtgcagcctcaccaagggccctgcggaccgactgggctggactgggttttggccatggctttgtcaccttgcaataacatgcctccttccgttttggcacagatggccctgtgatttcaaggttctcttccaacaccaaagattccttgattcagatgctgcccttttgcctaattgtacagaataactagttgggttgtgctcagagagtgcagggtgggggtggggaagcagctacttcctgtttcctgtgaaaggttttctggttagggttcccttcccctccccgctttccctaggtttaaccaaaggttgtaaagccacttttgcttcaaggtacactttgtgctcctaaattagtaacgttgaaaaacaaaaaggaaaaacagcctgtggttttcacaccctctaggaagctggtgggcctttctagcacctgtgccattctgataaataagggcttaggaaaatgcctagcccagaaataggtgctcagtagtttgtttgcttcctttggtgctcaggagaagatttgagacggatttcgtcacaatcaggtctcgggcacaagcctcacatggacactgacatgcaggagccagaggagacagcaatgaggtggtggtaaggaagtgcccaaaaaggtttcccagaggaagagttgtttgtgttggcatgtgagggacaagctttccaggcaccagagccaagagcagtgctctgtccgaggaagtaggataaaccgaaagacggacgtaggggcagagttgctgtggctgccctcactgccgcagccagctccttccatgagttgcagaatgcctactgtgtgcaaggcactgtgttgagtgcagggaatcacatccagtcttgttgtccccatctatagctgataaagaagctatgagaaattaagtgacctgaccaaggccacacagctgtggaagaaggggcgagagcatagacagtgggtaagggcataggctcaccctatgatttacaaagagggatacccctgaagttgctagggtaacgtgacatattaggaggatggtgggataaaatatgtgaacatcgggatcattctggaaaacctttaggataaaaggccactgtcatgctcccatgttcacgtttctttattgtgagttatctgtgttaggtgctgccagagatgatgagatgcctgacagtggttactctgtaatagctctttaaaaattaaagacaaagtagggtttgttcctgactgtactagaaatacagatttaattttacctctgctcctgaaataggtgactaatttggagtactattaatactcttttcatgaattagttgagaaattccacagttgaggagtgattcattcttttgactccctctttctgagcaatttgttgacagccttctcatcctctcttacacccgtcattaaagaaacagtcgagttctttttctttcatgtggtaccttggtttccactgctggtggcccttaggttgcttgtctctgtctccccgcttccattttaagctccatagggggaaggtagtcttgttcactgctagactcctagtccagtgtgtagcacagtcatatccacggaatatttgttcagtgtactggtggctgttaactgcagcataatccagcaaccctggagattattttcttcctttttttttttttttctttgaagcagggtctgactactctgtcacctaggctgaagtgcagtggttcaaacactgctcactgcagcctcccaagtagctggaattacagacatccactacacctggctaatttttaatttttaaaaattattattatttctgagatggagtcttgctgtgtcacccaggctggagtgcagtggcacaatctcagctcactgcagcctctgcctcctgggttcaagcaattctcctgcctcagcttccggagtagctggaactgccagtgtgtgccaccacactcgactggtttttgtatttttagtagagacggtatttctccatattggccaggctggtctcgaactcctggcctcaagtgatccgcccactttggcctcccaaagtactgggattataggcgtgagccacagcttccagcctgattgtttccattttaaaaaagagtaattgaagtaacctttgttaccaatgaaatgaattaaccttctagtatattaattctcacggtttaggttatttgaactaagctgagagaacagaataccaaagaagacaatagacttgcccagaaatatttagaagtaagtcactcagttgcctggattggaaccctcaggccagagaggttcaaaatcctgcatttttttttttttttttttttttttgagacagagtctcactctatcacccaagctggagtgcaatggtgcgatctcggctcactgcaacctccgcctcccgggtttaagcgattctcctgcgttagccttccgagtagctggaactacaggtgcgcgccaccacgcccagctaattttttttttttttttttttttttgagatggactctcgctctgtcgcccaggctggagtgcagtggtgcgatctcagctcactgcaagctccacctcctgggttcatgccgttctcctgcctcagcctcccgagtagctgggactacagatgcccgccgccatgcccgactaatttttttgtatttctagtagagatggggtttcaccgtgttagccaggatggtctcgatctcctgacctcgtgatccgcccacctcggcctcccaaagtgctgggattacaggcgtgagccaccgtgcccagcctaatttttgtatttttagtagaaacggggtttcaccatgttgaccaggatggtctcaatctcctgaccttgtgatccacccgcctcagcctcccaaagtgctgggattacaggcgtgagccaccactcctggccaatcctgctaattattaatatcagaactacttggttcaaaggagtggaaatagggcaacgaggggtgtaaatttgcagttaggtggaatgctgatagcaagttttccaggtaggagagttagttggggtgggggatgctaatgttagcttatctctgtatatatatttaattttatatgttatttatttttgagatgggatgtaactctgtagcccaggctggagtgcagtggcacaaacacagctcactgcagccttgaactcctgggctaaagggatcctcccacccacctcagtctccaaggtagctgggaccacaggcatgtgccaccatgctctgctaattttttcgggtttttttttttttttgagatctcttgctgtgttgcccaggctgatctcaaactcctggcctcaagtgatcctcttgccttggcctctcaaagtgctgagattataggcatgagccaccgtacccagcctatattttttttattgtgacatttaatgcacaaaagaagatatgcagcatcaatgcagataatggaacaaaacaaacactatccgccttaaaaacacaaatatttttggtacttttgtaccaatctgtatgctgtttctctatcttctacttcttctccctgtaccctcaccaggtaagtaaccccagagctgctggtacatttgtgtggattaaaaaagacacctggaaggggcagatacagccctgcttgacttcctgttttatcacgtgtttataaatctaaacaatgacatggaacttattatacaatattttaggcataaattaagaatgatttcgctcaccatcatagacctaccactcaatttgaagcatcaaacattactggtatggtgaggccctctggctgtccctccaacagaagttaccaccctcctcagttgggtttctcattcctatgcatttcttcttactacttatgtatgtatttccaagcaacacatagaattgctttgcatgctttttatcttcttaaaaattggttttatattgtatgcatggtgccacctgcttttaaggagaagcaacacgtttgtgaggccatctgtttatatgttgttctagggctttgctgtccattttggtagccactagccacagctggctgtttaaattaattaaaatcaaatcaaatcaaatatttagttcctcagtctcactggtcacatttcaagtggccagtaagcacatgtggccattggcatctgtattgcatagcacagattacattctgttccatcatcacagctagttctcttggacagccctgcagggcatttctttttggtttttgttttgtttttatttttgttttttgctagagtctttgttgtgtaaatacattactattttatatccatttttctatttataagcatttgggtatgctcataatttgctgttacaaattgtgctgcataagcattttgtttgtgtgtgtatagatgatctccttgggcaattgtgttaatttctcttgggtatatacctgggagtaaaattaagataagggcattttcagctttaccagaccccgttaagttactctcaagtggttttatcaatttatattctagaaccaacattatgtatcagtaacatttggtaacttcaggcgttttttttccattctgctgagtgtgaaaaatgtgttttgattatggttgtcatttgttagaatactttgttaaagctttttaaagattcttggtccctctaccctccccaccccctaccccaggaattttgattgggtaggacctggggattatattcatctttatatgcagaattatattacttgttactgttaggcctgatttaagaagtaaaataaggctgggtgcagtggctcatgcctgtaatcccagcactttgggaagccaaagtgggcacatcacttgagcccaggagtttgagaccagcctgggcaatgtggctaaaaccccttctctaccaaaaatacaaaaattagctgggcgtggtagcacgtgccagtggtctcagctactggggaagctgaggcgggaggattgcctgagcctggcaagtgtaggcagcagtgagctgagattgtgccactgtagtacatcctgggtgacagagcaacacactgtctcaaaaaaaaatttttttttaagtaaaataagttcataattccaaatgtggaaaatgcagaacaagttaatgaaatgttaatcctactaccaaatgataactataaccttcctttcagtatttttctatgtatatacaacaaaattggggcactgtttaatacagataatatatatagttagctctccttattaatgggcttcacattcatggattcaaccaactgtggatcaaaaatctttagtgtgcttggagtacatccaaaaaaaaaaaaagaaaattgaaattatgttaataataaaatatttgggaaaaaacattgcgtctatctgtaccaaacatgtacagactttttttcttgtcattattccctaagcaatacaatataacaactgtttacatagcaattccattaggtattataagtaatctagagatgatttaaagtatatgggaggccaggcgcagtgcctcacgcctgaaatcccagcactttgggaggccaaggcgggtggatcacttgaggtcaggagttggagaccagcctggccaacatggtgaaaccccatctctaacagaaatacaaaattagctgggcatggtggctcacacctgtaatcccagctactcaggaggctgaggcaggagaatcacttgaacttgggaggcagaggttgcagtgagccaagatcgcaccgttgcactccagcctgggcgacagagcaagactctatctcaaaaataaataaataaataaagtatatgggaggatgcacgtagagtatatgcaagtactgtgccatttatttatttagagacagagtcttgctttattgcccaggctggagcgcagtggcgtgatctccgtctcccaggttcaagtgatcctctggcctcagcctcccgagtagctgggattacaggcttgtgctaccacacccggctaagttttgtattttaagtagagggcgttttcaccttgttcgccaggctggtctcgaactcctgacctcaggtgatccgcccacatcggcctcccaaagttttgggattacaggcgtgagccattgcacctggcttgtatatgtgtatatatatgtacatggttttgtcttttgcttttttcactcaataagcattccccaaatctgctttggagcacatgattttattttatttttatttttttatttttttgagacgaagtctcgatctgtcgcccaggctggagtgcagtggcgcaatctcggctcactgcaagctctgcctcctgggttcacgccattctcctgcctcagcctcccgagtagctgggactacagacacccgccaccacacccggctaattttttgtatttttagtagagacgggtttcaccgtgttagctaggatggtctccatctgctgacctcgtgatccgcccgccttggcctcccaaagtgctgggattacaggcatgagccaccacgtctggcctggagcgcgtgattttaaatgtctgtgtcatttttcctcttcttgcctagccataatctattttaccagtcacctattgtattgaggttattgaggttattgcagtttcctactatgctaaatggctcctgacaacaaatttgatggttgatgggctatgtggagaattcacctttttttttttttttttttttttttttgagacagagtctttctctgtcacccaggcgggagtgcagtggcatgatctcagctcactgcaacctctgcctcccaggttcaagcgattctcctgcctcagcctcctgagtagatggaactacaggcacctgccaccacgcccagctaattttatttttgtatttttagtagagagggggtttcaccgtgttagccaggatggtctcgatctcctgacctcgtgatccgcctgcctcagcctcccaaagtgctgggattacaggcgtgagccacagtgcccggctaatttttgtatttttagtagagacggagtttcaccatattggccaggctggtctcgaactccagaccttgtgatccactcaccttggcctcccaaagtgctgggattacaggcatgagccaagtctttttttttttttttttttttttttgagacggagtcttgctctcttgcccaggctggagtacagtggtttgattgtgatctcggctcactgcaacctcagcctcctgggttcaagcgattctcctgtctcagcctcccaagtagctgggattacaggcacatgccaccatgtccggctaatttttatatttttagtggagacggggtttcaccatgttggccaggctggtctcgaactcctgacctcaggtggtctacccaccttggcctcccaaagtgctgggattataggtgtgagccaccgcacccggccttgttattagtcttaactagattgttgattgaagtccttaagcccagaaatgtatgtgaaggatggtggagaagagtggctcaggcattctaggcagaggtattcttgagctgaggaagtggaggagaggaggtatgtaagttacctgttttcaggggttcattccagtggatagtggatgccactccctggcagacactgtgggtgcctcacctgaaagactcctgattccctgaaggcattgtcgggtgtattttttctttataagcgtaatgccagtggagtgggtaagacaggtaccaccttttgcatctgctgctacagattaggcagcttggttaagttttgttttgtttttaattgttatgagttagtttgaaccaaaaggattgttaagtggagtgtaagaagcactgaataactactgttatctgagaggagtagtaaagaccagggccactgggcaatcccagaggcattaggaatttgtggcctttccctttagagcattgtcattatgtgtatctgcatctctgcattccaactttcacattttcagttcccaggagagagaatctgattggcctggttggggtcctgtgcccacttctggctgtcacctgtggctttcttccctcagttgtagaccacactctggatacctgggacccctgaaatctcctgcccagacaaccccaagcttctcaggactttttgtgggctgcttccctgttctgcctgtgcagtgcaggccttgtcacaatgtctgaatgcttaggccagagacgtgggggtttggtgagaaaggatgagctgggtagctacactcaagtgcagagccaccagtattgtgggacagagccaggcatgggaagagaagtgggcacggatgggggccagctttcccgatgtgccttaatctggcacagaactcctaaggagtgtgaaaatttcaaatttgatccaggccttccaggtggttatgaagaaggcgagtttgtcaagacaggataatacaatatacttcatttaatagcttgttagtgtgatttataactaaatatgtagacatcatatatgggtcttcattcatactcttgccccaggccctgaaagtgttagctaacaggcaagacctgcctgggactgagattctaaaacacaacctccacccccaactccgtttcatcatatagtagcctaacatattagttggttcgttgcttatagtcaggcaaacaacaaagactccgaattgagctcttggtaatttttgaaacctgcctggtaatactgtgtttcctcattctgatggcattcccagaccatattgcaaatgacttgatgtgtattttcagacttgttgagaagggcctggtggtctatatagcaggcataaaatgtcaccaggccgacttcatgacttatcttttgaggtcaaacagacccattgaccaaaagatttgagggcagtgaaaacatcttgtatactatctttaacaatggatttaactcctaaaggaaagccacctaaacatgactgtttaatcttcactagcaatttgaacttttttttttttgagacggcgtctcaccttgttgcccaggctggagtgtagtggtgtgaccttggctcgctgcaacctccacctcctgggtccaagtgattctgctccctcagcttcctgagcagctgggattacaggtgcctgccaccacacccagctaatttttttgtatttttagtagagacagggtttcaccgtgttggccaggctggtctccaattcctgacctctagtgatccacccgccttggcctcccaaaatgctaggattacaggtgtgagccaccacacccggcctgcgcccagataatttttgtattttttttttttttgagagtctcgctctgtcccccaggctggggtgtagtggcacgatgggttcacgccattctcctgcctcagcctcccgagtagctgggactgcaggtgcctgccaccacgcctggctaatttttttgtatttttagtagagacggagtttcgccatgttagccaggatggtctcgatctcctgaccttgtgatctgcccgccttggcctcccaaagtgctgggattacaggtgtgagccactgcgcccagccaacaatttgaacttttatctgtcaaatctatatgcatccttagcaagctttgtaaactgcctggtaactgatagatcttggttcacttagcttcccaaattatgctgttatcatcttgtctctctgttctttaaatatctggttgggagggtatggagagagagggaggaagaaagacacctctgtaagtttgaaattatttgcatcccccccaccgcccaccaccaacctttttaaaatatagagacacagagtctataccacgcctggcctaaaataattttttttagagacgggatctaacagtgttcccccagcttggctatcttaaacttcttaagggtagctagttctaagaactgcttttttctggctaggcacagtggctcacgcctataatcccaacactttgggagaccgaggcaggcagatcacctaaggtcaggagtttgagactagcctgggcaatatagtgaaatcctgtctctactaaaaatacaaaaattagctgggcgtggtggcatgcatctgtaatcccagctactgggggcgctgaggcacgagaattgcttgaacccaggacacggaggttgcagcgagctgagatcatgcactgcactccagcctgggtgacagagggggagactgtctggaaaaaaaaaatgtttaaaacaaaaaactgtttttttgtatgtgtgtttatatgcgaaccatttgtgaaagtggtcccagcatgatgccacatgtgtcatttccaaatatttcagtctgtatttttttctctctctctctgttttttctgtcacccaggctggagtgcagtggtacgatctggctcactgcagcctcgacctcctgtgctaaaacagttctcttgcctcagcctcctgtgaagctggtaccacaggtgcatgccactgcacccagctaacttgtagagattggggtctcactttgttgcccaggctgttatttgactcctggactcaggtgatcatgccactttggcctgccagagtgctgagattacaaaagtgagccaccacactcagccataaatgtgttgttgttgttgtttttgagacagagtttcgctcttgttgctgaggctggagtgcaatggcgcgatctcagctcactgcaacctcccccctcctaggttcaagcgattctcctgcctcagcctcccaggtagttgggattacaggtgcctgccaccacgtccaactaatttttgtatttttaatagagacggggtttcactatgttggtcaggctggtcttgaactcctgacctcaggcgatccacccgcctcggcctcccaaagtgctaggatcacaggcgtgagccactgtgcctggacttgtaaatggtatttcaaagtaaaatatatgtcattgcatttatcaagataatttgattgagctttgtaggtcctagccatccttctgcctattactgggctttttgcaaatgctgttcctgtttccacaacctggagcattgtcccatcccttttattgtttctcttgctgttatttattatgtcatccatcatcattataccattcctctgccaagaaacatttaatttttgtttttgtttactattacaaaaatgttttatagaatattgttagacttacattcttgcccctcattgtggaagtattcctgtagtatgaatacagccagaggttttttagttttgttttggtttttttgaggagtcttactccttcatccagaggctggagtgcagtgacgcgatcttggctcgctgcaaactccacctcctgggttcaagcgattctcctgcctcagcctcccaagtatctgggactacaggcggccgccagcatgcctagctaatttttgtatatttgtagagacgggggtttcaccatgttggccaggctggtctcgaactcctgacctcatgtgatccgcctgcctcggtctccaaagtgttgggattacaggtgtgacccaccgcgcctggcccagtgagagttaaagggccagagtggaagcaggtctttggaagcttggctctgtcttccttcagtgcagggagtttgtgttgtccatccccagcctctacagaagcacacagtgagtgttcaataagcatttcttggatcaaatggcccctgcttcttttaatggtcagtaaactttaaataatgagatttttctgcaatagagaagagcaactgccttgtgattggaagccagcatatgttattcctaagcagttctgccttttttccacagaaggtggtcttctgccctgttaaagaagccctggaggtggactggagcagtgagaaagcaaaggctgctctgaagcgcacgacctccgactactttctccttcaaggtgaggtctcaaagcacaacttaccccgggagagcttttggctctgatttctgcaaatgtggttgcaaggtccagatggttttgtgatgtttgccttgggtggcattcttcattggctagttctcagtgatcacttgagaaaggggtggtcacttgaagggggtgaggtctaccattgagctctgggttctaatgacttctcctttttttacttgttgaaatgacctccctgtcaagttgaccttatggtaatagtgttacaggtcacagattgagaaacctctttttttttcttttttctttttttgagacagagtcttgctctgtcacccagactggagtgcagtggggtgcaatcttggctcactgcaacctccacctcctgggttgaagcgattctggtgtcttagtgtccccagaagctgggatgacaggcatgcaccactgcgcccggctaatttttgtattttgagtagagatggggtttcaccatgatgcccaggccctgaagttctgagattataggcatgagccaccatgtgaagcctgatcaaccaacttctcttcaccgccccccgcctttttttttttttttttttttgagacagagtcttgctctgtcacccaggctggaatgcagtagcgctatcatggttcactgtagcctctacttcctgggcttaagtgctccccatgcctcaggctcctgagtagctggtactacaagcacacgccactgtgcccagctagtttttgtatttttttgtagaagcgaagtttctccatgtagccaggctggacttgaactcctgagctctagtgaaatccccgcgttggccttccaaagtgctggagttaaaggcgtaagccaccagtgcttgttcccctcttcagaattctttctctgcctcaaaaccatcctcacgcttatgaaaggtggggttgtttttcctcttgctattaatgaactacttatcagtccatctttgctggtggtcaagagactgttagtaagtattggttggcttttcagtgttcttcctgtacctggcacttttttgtttgtttttgagatggagtctcgctctgtccccaggctggagtgcagtggtgtgatcttggctcactgtaacctctgcctcctgggttcaagcgattcttctgcctcagcctcccgagtagctgggactgcaggcgcgtgccaccacacccagctaatttttatatttttagtagagacagggtttcaccatgttggccaggttgggctcactctcttgacctcgtgatccgcccacctcagccccccaaagtgctgtgattacaggtgtgagccaccgcgcctggcaaacctggcacttttaatttttattttaattttttttttggagacggagtctagctctgtcgcccaggctggagtgcagtggcacgatcttggcacactgcaacctctgcctcccaggctcaagcaattctcctgcctcagcctcccgagtagctgaaatacaggcgggcaccaccatgcccagctaattttctttttttttgagatggagtctcactctgttgcccaggagagcagtggcgtgatcttggctcactgcaacctccacctcccaggttcaagcgattctcctgcctcagcatcctgagtagctgggatcacaggcacctgccaccacgcttggctaattttttgtatttttagtatttttgtattttttttgtattttcaccatcttggccaggctggtctcgaactcctgacctcaggtgatctgcccacctcagtctcccaaagtgttgggattacagacgtgagccactgcacctggctgcgctaatttttgtattttagtagagacagggtttcaccatgttggccaggctggtcttgaactcctgaccccaggtgatctgcccacctcagcctcccaaagtgctgggattacaggcatggtagttttttaaaaagtattttttttaatgttatttatgcatttatttttttgagacggagtctcactctgtcacccaggctggagtgcagtggtgcaatcttggctcactgcaacctccacctcccggttcaaacagtttccccgcctcagcctcccgagtagctgggattacaggtgcccaccagcacacccagctaatttttgtatttttagtagaaacggggtttcaccatgttggccaggctggcctcaaactcccaacctcagatgatccacctgcctcggcctcccgaagtgctgggattacaggcgtgagccaccacgctcagctggatgaactatttgaaagtcccgaatatccatttgtgtagaaataaatgggttgagcaggaatgagtgttgcatgtgagtgggctgcactcagaaaatgcctcctcttgatagtgggatcaggtgtggaagaggcaccagcagtaagagcagagtcttttccatgtgggaacagtgcctgggccctttgggagaagcttgttgctcactgcctcgcacatagaaagccctcaggaaacaatggcgctaatttgccaaggtttgggtttgacttgagcatctctaactgctgcttatgaaaggagtcaactgggctgggctactaaaaatacaaaaattagccggatgaggtggtgtgcgcctgtaatcccagctactcgggaggctgaggcagaagcacttaaacctaggaggcaaaagttgcagaatccgagatcatgccaaagcactccagcctgggtgacagagctgaactccatctccaaaaaaaagggggagaaacagagtcaatcacagatcatctactccagagttgaaaagtgtacacgccaaaaaaaaaaaagagaaaagaaaaaaagcacatatcttcacggatgacagagttctctaggacttgctctgtgccgggcgttttccatgtatatcaccttcatctcacaaaggccctcaggcaagtgctattaacaccaccagctacagaggggaatctgaggctcagggaatttaaagtcagtggctcaagatcacccatctaaaacaaaatggcagtgcccactggaagccaggtctgttttgattccaaaggtcttgttctttttctttttccccagagacagagtcttgctctatcacccaggtaggagtgcagtggggcgatcttggctcactgcaacttctgcctcctgggttcgagcgattctacaggcacgcaccaccacacccagctaatttttgtattcttagtagaggcagggttccaccgtgttggccaggctggtctcgaactcttgacctcgtgaaccgcctgcctcggcctcccaaagtgctgggattagaggcgtgagccaccgcgcccggcccaaagtcttgttcggaacaaccatgcaccactgcctgccacagaagtcatatagctactgtttcttcctcaaccacctgtccacccctccaaccccgtaacttctgatgctgatgtccagtagcacctgcactgaatattcactttgctcctagatatcagttttgtcccctcagttcaatgacccctgtgatgttgagatggatgagaaaatactctggaaactgcagaggataaaatcaggatttcctcacttcagcacactactgacattctgtgctggataacactgtcacgggggactgtcctgtgcactgtgggatatttagtaacacccctatcctctactcactagatgccagtaatatctccccacccagctctaacatcaaaaaatgtttccagacaccactgccacatgtccccagttgagaaccactggattatgctaaactcaaaggccagttgactcctttcttttctttcttttcttttttttttttttttgagacggagtctctctctgtcacccaggctggagtgcagtggtgcaatctcagctcactgcaagctcagcctcctgggttcacgccattctcctgcctcagcctcccgactagctgggactacaggcgcctgccactatgcctggctaattttttgtatttttagtagagacggggtttcaccgcgttagccaggatggtctcgaactcctgacctcgtgatccacccgcctcggcctcccaaagtgctgggattacagacgtgagccacttcgcccagcctgtttacccttaattccatccctcagtgggtattatggcaacagtctcatgagtgcctatgaccctttgctggataatatatcctatcatgtttaccactctctcccagatggcattaattatctgtctttttcagttttgagttccagggctttggatatggtaatcaaaacattaaaactatgtgcagtaaatttcttttcttttttctttttctttttttttttttttggtgtggtgaaaagcacataacataaaatttaccattataacttaagcgtataggtcagtaataatcatacaatgttttattttattttgtttttttctgagatggagtttcgctcttgttgaccaggctggagtgcaatggtgcgatctcggttcaccacaacctccacctcccaggtttaagcaattctcctgcctcagccttctgagtagctgggattacaggcatatgtcaccacgcctggcaaatttttttttttttttttttttttttgtgagacggagtctcgctctgtctcccagcctggagtgcagtggcatgatctcagctcactgcaagctctgcctcccgggttcacgccattctcctgcctcagcctcccgagtagctgggactacaggtgcccgccaccatgcccggctaatttttttgtatttttagtagagacggggtttcaccatgttagccaggatggtctcgatgttctgacctcgtgatccgcctgcctcagcctcccaaagtgctgggattacaggcgtgagccaccgcgcctggccacatttttgtatttttagtagagacggggtttcaccatgttggccaggctggtctcaaactcctgacctcaggtgatcctcctgcctcggtctcccaaagtgctgagattacaggcgtgaggcaccgtgcccggcagtgagaacatttacaatcacatattgtgtagcatcaggaaggatttttaagatcaaagttagcacattagaagtggaaataatttaaaagtggccttgattttttttttttttttttttttttgcctactgtaaagtcaagcctcagtaacattctgatttcaggatgcagggtggctttgggggatatccaagttgagtggtaaactttgtaggcactactcttgtttccatgttcctggcacctaagttgatatattttctcacagtcttgtgacaatctttgaagtatagttgttatcccattttcctataaggagaccaaggttgagcatggttgtgattgccgaaagtcatatccgtggttttatagacagtcagaatttagaccatgaggtttgttttacctgtggacttagttttcaacatatttaagatatatctgtagtctgggcgcggtggcttatgcctgtaatcccagcacattgtgaggctgaggtgggcagatcatttgaagtcaggagttcgagggcagcctggccaagatggtgaaatcccgtctctactaaaaaacacaaaaattagccaggcatggtggcacatgcctgtagtcccagctacttgggaggctgaggtgagagaatctcttgaacctaggaggcaaggttgcagtgagccgagatcgtgccactgcactccagcctgggcaacagaacgagactctgtctcaaaataaaataaataaaatatctctaaactaatatatctcattaaatttcagatctggagttctgtgagttagggaaacaggatcaccaccatagtagaaaaaactctggtgcagatagttttagacacaaagattatctgaattcaggcccagataattgtcttctttttccccaagaaacatttgaattgtatttctgttagataagcatcatagtaaaaagtcttcaaagtttttgaaggcagaaaaagttttctttgttaaacccttcccatttttttgtcttctaaatttctaggagaactactgttaagttttttagtatcttgttgaacaatggttaacaattataatcatttgtgtttatgtaatcaaactgtgaaacaccggttgggaacttgcttgtgtacacttgatggcgtaaatggtaggggaagagcatacatacaaaagtggcctcttttgctttcttggcagcatgatgttatattcctttggatgtaccgtcatctatgaccagtctcatcttgaaaggcatgcttattttccatttttcccagtgcttggaatttgtttccaaaattgtttctaggaacatgactaatgtgactgacgatgccttaggaattcctagtggggacaaggtgcttggctgggatgcatacctaagaatatctcacaaagaaacctgattttgtttcactattgcctaatggcgcacatagtaggtgctcaataaataaatattttttgcatgagtggtttttgcttgtctggtcatttgccctattgtagagggagagtagtgtgcccactggagtccccacagggtccttttgcctgcatgcctacccctgtggcacccatcaggcttttgattccaatgttgccctgggctctcactcacaggtagatgttttttattgccccattcacaattcagccacctgctgtccgcatgcatgtgcttgccatgtttagatattgggtgtttttccagtttacttaataagttagtggccagactgtacgcttcctgctgcatttttccactgtcttgagagttggcctcgccatctgtgagcaaaaggtctcttctttttattattctcccatggcatgttgcaaaacagtaagcgtgagctggtttcctgtggcaaaaaaatgactttgatttgttctttttgaggttactgtgagtttatcataacaggagtgctaaaaataccgagtctggtatggaaacagcattcacttaccagcatgaacaataacatacaggtttagcctagagcaggaagaaatggacttcatctcaagatgagaatacttatcagagaattcttggcaatcttaacttgctcagtctctgttctgatgagttatggaaaagtacttagaccatctttgagccacagaattgaagctgaaaatattcttagaccaaacattttgtgagcacctgctatgtaccagatctcatagctgggactaatcagaggaagaggaatagaataagtgttcttgccaatgtgaaagacaaacaaataattctactccttgtgaggacagctataacagagggctatagaaactatcatgtgttgttcctggtttttgtttgttttttttcccccccaaaacagggtcttgctctgctttccaggctggagtgtggtggcacaatcataactcactatagccttgaactcctgggctcaagttatcctctcacctcgacctgcaaagtagctgggactacaggcgtgtgccaccatgtccagctattttaaaaaatctgtttgtacagattggggcagggaggtcttgctatgttgcccaggctggccttgaactcctggcctcaagaaatcctctcacctcagtttcccaaagagggactataggaaagcaccaccctgcctggctcgttgttctgtttttaaatacatttgcattattccataataatcaaagtaatttattatgggaacttaggaaactgaaggtctgaccatctttggggagttgtgaagtcttgacagaggaggggagatctgagctgtatttctcggaacaggtatttgccaggtgggaaagagggaagaatattgcagagcaacacatgcacagggccagcaggatagaggctgagcctcggaggggactggagcttggagagagcaggctagtggtttccctattgatagaatatcagaatctggccaggcgcggtggctcacgcctgtaatcccagcactttgagagactgaggtgggcagatcatgaggtcaagagatcgagaccatcctggccaacatagtgaaaccccatctctactaaaaatacaaaaattagctgggcatggtggtgtgcgcctgtagtcccagctactcgggagggggaggcaggagaatcgcttgaaaacctggaaggcagaggttgcagtgagctgaggtcgcgccactgcactccagcctgacgacagggcaagactccatctccaaaaaaaaaaaagaaatctatctatctatcagtcagaatcactgaggaaaccgttgaaaaatgcggagtgcctgcttgtagctcacattactgaatccagatagctaggagtgacttgcatgtctgcatttttctatagcacccaggtttctcaaatcagccaagttaggggaaagtactgtcataggaaagggaagcccatttcccaggtcaaagcctttgcttactcgtttatgtttattttatttttgagacagagtctagctttgttgcccaggctggagttgcaggtgcaatctcagctcattgcaacctccgccttttggattcgtgcaattctcctgcctcagcctccaagtagtggggatcacaggcacacgccaccatgcctggctaatttttgtatttttagtggagacagggtttcgccatgttggccaggctggtctcgaactcttgacctcaagtgatccatgcacctcggccttccaggtgctgagtttataggcatgagccatcgtgcatagcctgcgtttttcttttaaaatgtgttaagcactgtatttcaaattacatttgtgcactgaagcagggaggaaaaaggagctaacccaagtagctgttcaatatagtattttgactgcataccctcaaagtaaagaaaaatctcacctggcgcggtggcttatgcctgtaatcccagcactttgggaggctgaggtgggtggctcacagggtcaggagatcgagaccatcctggctgacacggtgaaacctcgtctctactaaaaatacaaaaattagccgggcgtggtggcgggcgtctgtagtctcagctacttgggaggctgaggcaggagaatggtgtgaacccgggaggcagagcttgcagtgagccgagatctcaccactgcactccagcatgggcgacagaacaaggctctgtctccaaaaaaaaaaaaaaaagaaagaaaaatctctagccggtcgcgatggctcacgcctgtaatcctagcactttgggaggctgaagcaggtggattgcctgagctcagaagtttgagaccagcctgggcaacatggtgaaaccctgtctctactaaagtacaaaaaaattagccagacatggtggcacactcctataatcctagctacttgggaggctgaggcaggagaattgcttgaaccctggaggcagaggttgcagtgagccgaggttgctccattgcactccagcctgggtgacagagcatcttaagaaaaaaaaaaaaagaaaaactctaaataaatattgaactctgcttagtagggattttgttttcagatgaggtcttgctctgtaccccaggctggagtgcagtgtcacgatcataacttactgcagcttctccctcccagctcaagcaatcctcacatcacagcctcccaagtagctgggattataggcaagtagcagggattacaggcatgcaataccacacccagctgattttggtattatttgtagagacggggtttcactgtgttgcccagggtagtctctgtctcctgggctgaagtgagcctcctgcccaaagtgttgggattacaggtgtgagccactttgcctggcctagtaggtttgtttttcacagtgataggggttagcaattctgaaactacttactgttcttctaagattgagcagataggtaagtatagtgttaatagtgagaatcaagttttcttattgtcagaaaagggtgttcctatgaatgtggacagtgggaaaggctagaaggagccatgtggtattggattggaattgaagttatctggatgaactcatggtttcttatacgtagatgtagtaatagatgtatgtgtgtatgcatatccacttttacacgtgtttatttcctagaattgtttcctagaattgttgagagggtttatgcccagagacatcccagaagcactgaacgcactcatgccaagatgttaatacctttcctcactaaagagaaaccagggttccttggagaaatggctgtttccagatctggggtaggaaaattacaggtgagcttggaatatcctgctatgccagaaagtaaggaagtgctctaagaatgataggggcatgtcaaaagaacaagaagaataatcaattaatgtaaacaaggaattatgaagataacaaagtctatctttgactatcaccatagtagtaacaattgtttcaatcaagaatcaaagtgctaaaatcaatggggaacagtttgcggtgaaacagtgtagatgtttccttatcagatgcttttatgctatgcctggtggctcacccctataaatcccaagaggctgaggcaaattgatcacttgcacccaggagttttgagaccagcctgggcaacaaaacgagaccccatctctacaaaaaataaaaaagttagccagatacagtggtgcatgcatgtagtcctagctactcaggaggatgagatgggaggatcggttgagcgcaggaggtcgaagctgcagtgagttgtgattgcaccactgcactccagcctgggagcaagactttgtctcccccgaaaaagaagatgcttttaaatgaattacatagagagacattggagaaccctggcaggttgtacctcagctgagtgatgaaattaacaatctagggatggacagttagacctcatgcctcttggaatatgtaaccctgggttggatctgagaatagaggaaggttttttttcttttgctctaaaggatgttagtggaacaattggtaaaaagaggccccggcgtggtggctcacgcctataatcccagcactttgggaagccgaggcaggtggatcacctgaggtcgggagttcgagaccagcctgcccaacatggagaaaccccatctctactaaaaatacaaaattagccaggcgtggtggtgcatgcctgtaatcccagctacttgggaagctgaggcaggagaatcgcttgaacccaggaggcggaggttgtggtgagccgagatcgcgccattgcactccagcttgggcaacaagagcgaaactctatctcaaaatagtaataataataataaaataaaaaacaaataaaaaggtctgtaggttagatagcagtactgtttccatgttatttatttttacagttatgataattgtctcatggttatttaagagaatggtttttgttttgtttttcttgttttttcttttccttttttttttttttttttttgagatggagtctcactctgtcgcccatgctggagtgcagtggcatcatctcggctcactgcaagctccacctcataggtttacgccattctcctgcctccccctcccaggtagctgggactacaggtgcccgccaccacacctggctaatttttgtatttttggtagagatggggtttcgccatgttagccaggctggtctcgaactcctagcctcaggtgatcctcccacctcagcctcctgaagtgctgggattataagtgtgagccagtgcacctggcctctttttttttttttttttttttaattttacagaattttttttttttttaagacagagtcttgctctaaggctgtagtgcagtggtatgatcacagcttgctgcagcctcagcctcctggactcaagcgatcctcccacatcacccttctgagtaggtgggattattgtaggctaaatttttaattttattgtagagaggcctcactccatggcctaggctggtcttgaactcctgggctcaagtgatcctcccacttctgcctcccaaagcattgggataacagacgtgagccactgcacccagcctgttagataatttagaaaattttctttcctcattcttcaatttcccctcattcacactcccaactttcctgttttgtgatttttaaatgacgttgtctttggatgccggctggatttggtgattagttctcttcagaagaaacttcttattttagaacttgtaacctttgcaaagcaggccataggcagccatcgctatttgggtatgacattccccagtgggtttttggtgtccagtaatgacaaaaactgctgagaaagagacagccacagggaaatgggttccgataatggggcagcagctgagtgcttgttgatttgctgctgtcatgaccacagatgtttaaaaataatttgtaaggaaaaagaaaaaagcgtagtgtgtgtgtgtgtgtgtgtgtgtgtgtgtgtgcgcgcacgcacgcgcgcgcgcacaccactgccttatcagtggtagagaatgcagaccacagtcattcagaaaggaagaaggcaccaccatggaaacaggagaggtgaggagaagggcagaggtgacccacaaatgcggctcagtgccttacagcagagagctcatgagagaacagaactggttagtcaccgactctgctcctcggtctgcaagagaggttcagcaccaagtctatactacacagtactggaaggattagatgaaggcctggcacacattgtgaattaatagttactggttacaggcggggtgtggtggctcaggcttgtaatcccagccctttgggaggccaaagtgggaggattgcttgaggccaatagtccaagaccaacatgggcaacatagcaacaccctgtctctttttttgactgtttttttgaaacagtctcgttctgtcagccaggctggagtgcagtggcacaatcttggctcactgcaacctctgcctcccaggttcaagcaattctcctgcctctgcctcccgagtagctgggattacaggtgcctaccaccacgtccggctaatttttgtatttttagtggagatgggctttcaccatgttggccaggctggtctcaaactcttgacctcaggtgatccacccaccttggcctcccaaagtgctgggattacaggcgtgagccactgtgcctgaccggttcacgtactttacatgcattgtgatcatattaaatcttcatgacagccttactagatcaggtcttgtcctgttttcacatgaggaaattgaatcttggaagggctaagtcatttgtccagggtcatcacacgcagtaagtgttagagtctaaacgagccagagctgtcacactgtcatccccagggccttgtgtttaagcatcgcccaacaaagtgctcagtcagactttaattattagcattactaataataccattatgatgattattttgtctaaacttcacaggcacctcgtgacattttcttattccacttttgcagatgggaaactgaggcccaccaagatcagattacaataatgggcaacattgtcagcaacctgccttgctttttttcttagcaggcccacatctcccccactcccccacccacttggcagtagcctgtgtttgagctgctcacaggccccaaggcccagctgcaattcttgtttaaagcctcacatcttttctctgactgtcagacaacagtcacgggaatgtcctgtgccatcttccctcggcaagaggggttggcagagagcagcagatgcctagagtcaaggtcatgtgctgctcaagtgctgggctggagacaagaccctctctccctgctgcttgtgaccaggcagggtggctctgaatgtagagggctctgtcagaacagttctgtgaccagagggtgtggttggcaaagcaatgcattaggggcccatggaagtttattcttgttgtccacattatttccctgtgacttttagatttttttttcctttttgtaaattagttttttcatactagttagaatgtttcaccttaaaggtgagagtcaagctctggaatcgcctgacatttttaaggaaaggaatagaatattgggctggggctagtctgaaatggtggtttgtattattttaaattgatgggctctgggttaggggagccaaatccattttaaagtgatttttgtaaaaattggcatgtcttctgtttcttctcttttccaaaggtgacactataacgtagaggttaagaatgtggtgacttttaaatccgtcgtgaccataagcctctcctaagccccagttttcctaccactaaaatgggggtggtaacagttgtacctacctcattctgtcttttttgttttttgcttgtttgtttgttttttagatggagtcttgctcttgtcgcccaggctggagtgcaatggtgtgattttggctcattgcaacctccacctcctgggttcaagcgattctcctgcctcaacttcccgagtagctgggatgacaggcacccgccaccatgcccatttagtttttgtatttttagtagagatggggtttcaccacgttggccaggctactcttgaactcctgacctcaggtgatccacccacctcagcctcccaaagtgctgggattacaggcgtgagccaccactgccggcctcgttctgtcgtatttttttacgtaggagagctcagtctgaatgtaggatatgacatggttgtggggttttttttgtttttgttttgtttttgttttgttttgttttgttttgttttgttttgttttgtttttgagacagtctcactctgtcccccaggctggagtgcagtggtgtgatagctcactgaaacctctacctcccaagttcaagcgattctcctgcctcagcccccaagtagctggaattacaggtgcccaccaccatgcccagctaatttttgtagttttagtagagatgaggtttcaccatgttggccaggctgctctcgaactcctgacctcgggtgatccacccgcctcggccttccaagtactgggattataggcgtacttggaaggtaccatgcccggccattatatgctttttaaaaaaacctaaatgttgcaaaaaacatgtgtctaaaatctctgtttcaacatagttttttaatagccatgtaatattccattctgtcaatatgtctttatatgtggtacagactgagtgtctaaatccaagaacccaaaatctgaatttttttttatttttcatttttatttgtttacttatttttgagacagagtcttgctctgtcacccaggttggagtgcggtggtgtgtcggctcactgcgacctccacctcccaggttcaagtgattttcctgcctcagcttcccaagtagctgggattacaggtgcccgccaccatgcctggctaattttttgtatttttagtggacacgaggtttcaccgtgttggccaggctgatcctgaactcctgacctcaagtaatcctcccacctctgtctaccaaagtgctgggattacaggctgagctactgcgcccagcctatttttgtttttttgagacagagtctcactgtgtctcccaggctagagtacagtagccccatctctgctcactgcaacctccgcctcctgggttcaagtgattctcctgccttagtctcctgagtacctgggattacagacgtgtgccaccacacccggctaatttttgtatttttagtagagacagggtttcactatgttggccagcctgatcttgaactactgacctcaagtgatccacccatctcagcctcccaaagtgctgggattacaggcatgagccaccgcaccaagcccccaaaatctgaaatgttttgagtgccgacataacactcaaaaaaatgcttattggccccgggcgtggtggctcatgcctgtaatcccagcactttgggaggcctaggtgggtggatcacctgaggtcaggagttcaagaccagcctggctaacatggtgaaaccccgtctctactaaaaatacaaaaattgaccaggtgtagtggtgggtgcctgtagtcccagctactagggaggctgaagcaggagaatcacttgaacccaggaggcacagcttgcggtgagccgagatcccgccactgcattccagcctgggcaacagagagagactctgtctcaaaaataaaaataaaaaaaaaataataaaagctcattggagcattttggatttgggattcttagatttggggtgctctattggtaagtacaatgcaaatatttcaaaatctgaaaatacccaaaattcaaacacttctgctccctgacatcctgtgtaaacaacactgcagtgaacatttataggtaattcattcagcgggtaagggtcaggaccttttatagggatccttaataccacatttttacatggttcattgagcattcgtgctcccctctgctgtgggtgagggtgcaggtccctcagccttcttgcttgggttgagtcatcctggtctttaatttggtaagcaaaaaatggcatcttgtttttgagctcgtttctgagaaagtgcatgctccttttccccatcaacaactttcatccggcgcctcggaacctcttcagtagagagtgagatgcaaatagcgaggcacagcttctttccctcttctgagctgatgcctggtgaggtcatagactgggtttcattgcaaagacgaaagcgtgggcaggacttttggagcacaaaaaggggcatttcagagtagtcttcatgggcggccactccagaggtgaagttttctagagaaagacatgaaagtactgtgtggctgtggcgacagacagaggcttacgagcctgccctctagagactgtgagctccgcgtgtgagggcaaggcctggggctgtctgggtcgcttctgggtccccaccacagctagcatagggtaggggtggagggggggtgctcaggaagtgatttttgaagagtggatgactgaatacatgcacacacatacttttaagtttctgggttaaagaggaaaacagaatgaggtaaacaaaggaaagtaatgtggaggtgaactgagcagatggcaagatgccgtgaatggttagaggccaggagagccagaatcagagtggcttccgtgaagtgtccctacctcctcccccagcccagctatgtcactcctctgagcttcacacctatggactgttctgcaccctagccctcagatgcaacggtgaaagtgggactcctattgggtttccctgttgaggacagacatggtgccctgtgtatctgctgctgcttttttctttttttcttgctgagtattccatgtgtagcatgtttgtaacacttgataagaaacagaaccatcccagatagcttgaacacttttcaattcagtcagtaacagaccaggtctgctttggatttccaggagcttgtgtcactttattttttttctgagccagggtctcgctttgtcacccagctggagtgcagtggtgcaatgtcagctcaccacagcctctgcctcctgggttcaagcaattctcgtacctcagcctcccaagtagctgggactacaggtgcctgccacaacacccggctcatttttgtgtttttagcagagacggggtttcaccatgttggccaggctggtctcaaactcctgacctcagttgatctgcttgccttggcctctcaaagtgctgggattacaggcgtgagccactgcacccggcctctggattgcccggcctgtgtcactttgtcatgagcccttctcccctagttatcctttattcttcaaacaggcttcctgtgtgacatattttttgagtgcctgctatggggcaagccctgtgccaggtgttcagtatagagtagtgacatcgcctttgccccacagagcataaaaatctaatggaggagacaagccagtccttgtgctagttcatttccacaggtgaatataaaaccacaaactgggcagggcatggtggctcacgcctgtaatcccagcactttcagaggacaaggcaggtggacaacttgagctcaggagtttgagaccagcctgggcaacatggtgagacctcgtctctacaaaaaataaaaaatgaaccaccaggcatggtggtgcatgcctgtagtcccagctatttgggaggctgaggcaggaggatcacttgagttcaggaggtccaggcagcaatgagctgagattgtgctgctcattccagcctgggtgacagactgaggccatgtctcaaaaaaaaaaaagaaaaaaataatcacaaactgtgagtaaggtatctaagggaaaaaactgtgctgggagtgaatgtcaggagacagggagatctgaggcagtatcgtgtccagagcccacagctgaattaatggtaatgcaggtaaatgagctactgtgtgacacaggttaccacagcaagtgtatcggcttttctagggcgagtgtgagctgggtttctggactttgcttaagagcagtgacagacctggaagatactgccccaggcactcttgggtgctttacatgtattggttcatttaatctttaaaccccacaagtgcccttgggattcccattttgcagaggaggctcagggtccttgtcacttgcccaaggtcacagtaagtggaagaatagggagtctagagctgtgctcttcgctgctgccctccagttggaaagctgtccaggccagggacaggctttgcagagagaaggtacagaggacgggacaggcaaatattcagagactatgaggactgaggtggttctgccaactgtggagggcctggtcacttgacaaggcacctcattgcacccccctgaggctctctcaaagccccttttcgagttaggacattgttatctcctgtgtagtttttgttgattgccctctgaaatgctgtgagagggtagaccatccattctgccctcgcctgcccagcccagcacctggcacagtcattgctcagtgtatatttattgaatgaacaattgactgaatgtcaggcccagggctttgccttaggaaacaggctgttggataagaggtagtactaccatactttgcaatttttctggaaatttatgtcacctgggagtggagcagattaccaggctgtttccagagatagcgactctccataaagtgagccaacctgggggctgggcgcagtggctcacgcctgtaaccccagcgctttgggaggctgaggcaggcggatcacgaggtcaggaatttgagaccagcctgaccaacatggtgaaaccccatctctactaaaaaatatgtatataaatgagccgggcgtagtggtgcgtgcctgtaatcccagctactcaggaggctgaggcagtagaatcgcttgcacctgggaggcggaggttgcagtgagcaaagatcgcgccactgcactccagcctgggtgacagagcgagactctgtcttaaaacgaacaaacaaaaaaaacaaaagtgagccaaccctggggaggagtctacgttcagctgcagggagccagggaattggggccgaggtgtctggcacagaaaagctttgggcctgtctcaggtaaatgaagttttgatatagattcaactcccctgccccccacaattgaactgtttttgggggccagcaattaggggctaatttgtgacagtgactttattttcttcctactaaagtactggtttattcggtggccttggtgattagatttaggcataatagttaaatgtaatagaagtttatgtaacaaacagtgattaataatgttgctgtccagattcccgttatagcgctaacctgatgttatgaactgagattaaatttgaatttgagtgcttacattattttgtaaaggtggttgtatattcacatatccacagttttttctataaataacgtgaaaccgtgcttggtttctcttttccaaagtttgccttttccattacatgggcaagtcctgaacctaagccgagacactagtccatcatctccagcaatgaatgtcatccccccagacttcagcatcctgagttaattaaaaggtgcagatgaagttaatcaagtttggaactctaattttgtgcagtgttttgatacgatttgatgagtcatcttttggtagagcacctctctatccctgacagtgtttgatcttaacggaacagttttataatgtgtaaactggtgggaggtgctcttcagaaatgcagtcaacagtggtatgtgtgcgtgtttggctcttggggcggggcggaaagcagaacaaaggagaatttaataagcgagaacttgtcaggggctagggtcagttctgaggctgctgcctgtcaagaacatggctttcttcctgcccccctccactgctgctaactggagtctgaccttcgagaaagagtgaaaaaagacagcttctgtttgttttgctgcaagtaagtggctggactgattggcccccttcccagaggccctgcaaggacttcagatgtggtcagcgaggtatgtggatggtgccagcctgccggccctcgtccagccaaactgcaccaggaacaggcaagggtcccagagaaacagcggggtcagctgctgccgcctttgctcctgctcttaatgctgtcctatttcttcctaagaggaagctggtttactctctcaagattgatgggcaaagttttatatgaccacggtctccacttctcacccactgaacttacagcttgaaattaacagaggcgaggcccatctggaaaaatgcatttgacaaaaacttgatcaaatgggggatcccctgaggtgggtggcaaagaaccagaccacttggaatcctaggtgctgtgtccctgtatggacctgctgtttcttttggattccattagggttaagaagcacaaattctgaagctagatttgagtttacatttctgctccagtacttgggagttacagtgaccaagtcatttaatgtttctgaacttcagtttcctgatctgtaaagtaggatgggtaggttgggcgtagtgggtcatgcctataatcccagcactttgggaggctgaggcaggaggatcacttaaggtcagaagttcgagaccagcctggccaacatagtgaagccccgtcactagtaaaaatacaaaagttatttgggcgtggttgtgggcgtctccagcctgggtgacagagtgagactccatctcaaaaaaaaagaagaaaaacaaaaacaagtaaataaatgaataaaaataaaggaatccagccatctgttagtatagccaaagcagaggatattgcatcaaatgttaaacgctagtcctgtcagtcactcctgagagaacagggcaacaagacccagaaagggtatcaacactgcctgagcagatggaggcaaagctgtgcatgggctgcttatagggcacagtctgaggccttgcagcagtcacgtggaaactgaggctgcctgctttccaggtgcaaggtgatggacagtggcaggaaccctgtgctagatgactcttgtgcgatcttatttctttgttactgggacacaagcaccaactgtcacaagggaccaacaagaggaggtgattttttttttcagctgttaccacaaagcttttcatcttttggtttgaaaacatagctgtgggaataggccgggcgcggtggctcacacctgtaatcccagcactttgggaggccaaggcgggccgatcacaaggtcaggagatcgagaccatcctggctaacacggtgaaaccccgtctatactaaaaatacaaaaattagccgggcgtggtgatggccgcctgtagtcccagctactcgggaggctgaggcaggagaatggcgtgaacccgggaggcggagcttgcagtgagccgagatcgcgccaccgcactccagcctgggcaacagagcgagactctgtctcaaaaaaaaaaaaagaaaaaagagagagaaagaaaatatagctttgggagcaccaaagcccaaagcgttatagtgcctactatgtgtcaggcactatactaaacatttcacatggcttagcactcatgtgatcttcacgataacctggtgagcgggtaattattatcacccttcctactggtttgttgttgttgttgttgtcgtcgttgttgttttgagacagagtctcgctctgtcacccaggctagattgcagtggcacgataccggctcactgcaacctctgcctcctgggtttgagcgactcctgcctcaggctcccgagtagctgggattaaaagcgtccgccaccatgcccagctaatttttgtatttttaatagagatggggttttatcatcttggccaggctggtcttgaacccctgacctcgtgatccacccgccttggcctcccaaagtgctgggattacaggcatcagccaccatgcccggctacttaatttattttttgagacagcctctctctgtagcccagactggagtgcagcggtgtgatttcggctcaccgcaacctctgaatcctgggttcaagcaattctactgcctcagcctcccaagtacttgattataggcacccaccacactttcggctaattttcctatttttagtagagatggggtttcaccatgttggccaggctggtctcaaactcctgacctcaagtgatctgcccaccttagcctcccaaagtgctggggttacaggtgtgagccactgcacctggcctcctttattttatgggacattttttgaaaagaggcttggtccaaacaggcagtacttgccacttctgcagtcatttctctaccctgccccaaaatggttactcagttgcatttatttactacaatcggaataccagcaggacatctacaaaagtagaagtattgggtggtagcagatcagtgctctctggcatccagatcgtctagatggtcacagcctttttttttttttttttggagacagagtcttgctctgtcgcccaggctggagtgcagtggcacaatctcggctcactgcaacctccacctcccgggttcaagagattctcctgcctcagcctcccgagtagctgagattacaggcacccaccaccatgcacggctaatttttttggtatttttagtagagatggggtttcgctgtgttggccaggctggtcttgaactcctgacctcaggtgatccacctgcctcagcctctgaaagtgctgggattacaggcatgagccaccacacctggccaattgttacagctttgagttgactgccaagtgttgaggtagcattgagggttgcagaagctgtgttcttgaaaaagagaagagagtaacattctcagaaagcaaacagtattcagaagagtcaatgggtgttctggagcttttttcttttctttcctttttttttttaaagaaattaccagctgggtgctgtggctcacgcctgtaattccagcactttggggggccaaggtgggaggatcacctgaggtcaggaacttgagaccaggaatttttctatttttagtgaaaccccatctctactaaaaatacaaaaaattagctgggtgtggctgcaggcacctgtaatccccagttacttggcaggttgaggcaggagaatggcttgaacccgggaggtggaggttgcattgagccgagatcacgccattgcactccagcctgggcaacagagcaagattgtctcaaaaaaaaaaaaaaagaaagaaaagaaaaagaaaaagaaattacctcttctctgatatgcagagccccgtctatactggacaggtggaagttaccagagaaatacaggccaggggcctttgtctgacattggcactgagaaaagcatagcccagaagcagggtgtgtcttttttttttacctgggcatctgtggtttgagatcttcttggaacactttataacccatttctgaacgtctcccaggcttcagtggagccacctgttgtagcttctaaaactgtgtcctcctcagttgttctcccacccattgccttcacagatgcagagaccaagattcactcactcgccattggacctttagcacccaggtctgtctggcacaaagtaagtgccaggctggtggagtgaatgaattctacttagagaatggccctcaacacaggctgctcattaccaaaactatttggtctttaaaaagtgtgactctgatgcttcagtctggggtgggtaccaaatacttgtattttttaaagagcctcacagcaacttgaatttaccttaatttttatgtaggaacccttgtcctggtagagagtataatttgctgaataagtctactttttcaatcaacatatacggaagagatatcaatgaaagaactgacaaactgtaaagccccctctccaggtgtaaagcactcagggcttgggcctagaagctgatccatgtctctgtgtctgttctgaaatagcctgtgtgatgtgggagaaagagtattgtccttagagacaaggctcgagactggctgtgccctttccttgggcagtatgtagggaacaagaatgcctgcccgcccgcaggcaggttacctgtggacaaggtgtagtgggcagttagaaggtgttggtatgttaatcagtcttttttttttttttttttttgagatggagttacgctctatcgcacaggcaaagtgcagtggcgcgatctcagctcactgcaacctcccaggttcaagtgattcttctgcttcagcctcccaagtacctgggactacaggcgtgcgccaccacgcctggctaatttatgtatttttttagtagagacggggtttcaccatgttggccaggctggtctctaacttctgacctcgtgatctgcctgcctcggcctcccaaagtgctgggattacagacgttacagacgtgagccaccacacctggccagtctttttttttttttttctgagatgaagtctcactctgttgcccaggctggagttcagtggcacgatctcggctcactgcaacctctgcctcccgggttcaagcgattctcctgcctcagcctcctgactaagtgggactacaggtgcctgccaccacgcctggctaatttttgtatttttagtagagaccgggtttcaccatgttggccaggttggtctcgaactcctgacctcagatgatccacccgccttggcctcccaaaatgcttggattacaggcgtgagccactgcacccagcctaattagtcttttgctcctatttgtctttatttgggataaaagttatagccttgttggggtcttcttacacagtagttctgactcacagccatcatctgaacctttcctctggttcacaaccaaaattaaacatccatttatggggattgagatagttttcatagtaaaggaagttttgtttgtaatgaccttcctgtttgatgggtctaagtatatggctggcccttctggctaaagcaggctttaaactggtcctgcctagaatgtgtacctcccactccttatcatctctcttctaggtcccttcccctttccctttcccttccccttccccttcgcttcttccttccctttgttccttttcctttcctttttttcttctttttttttttttttttttgacagggtctcactctgtcacccaggctggagtgcagtgatgagatctctgctcatgtagccttgaccttctgggctcaagtgatcttctgccttggcctccttagtagctgggactacaggcaccaccatacttggctaaattttttttttttttttggtagcagtgaggtctcactatgttgcccaggattatctcaaactcctgggctcaagcgatcctcacgccttggccccccaaagtgttgggattgcagatgtgtgccatcacactctgcctcttccgggtctttttttttttttttttcccagacggagtctcgctctgttgcccaggctggagtgcagtggcacgatcttggctcactgcaacctctgcctcctgggttcaagcgattctcctgcctcagccttccgagtagctgggattataggtgcctggctaattttttttatatttttagtagagacggggtttcaccatgttggtcaggctggtctcaaactcctgacctcgtgatcctcccacctcggcctcccaaagtgctgggattacaggcgtgagccaccgcgcctggcttttttttttttttttttttttttttttttttttaattttacttttttgagacggagtctcactctgtcacccaggctagattgcagtggcacaatcttggttcactgcaacttccgcctgctggattcaagtgattctcctgcttcagtctcccaagtagctgggactacaggcacgtgtcaccacacctggctaatttttgtatttttagtagagacagggtttcactatgttggccaggctggtctcgaactcctgaccttgtgatccacctgcctcggcctcccaaagtgctggggttacagctgtgagccaccgcacccggctcttccaggtcttaatagagcctttttcctctactgaaagcttccactgctttctgcccccttcaaactcatatatacttcattgaattgtttcctcggggaagccttcctgataccaccctacagagggtgtcagacgccctattatgctgtcacagcacttttcacagtaaggtaaattgcttttataattattggattgcctctctgactatgtttgttgaataaataaaaaaaggtggccaggtgccgtggctcacacctgtaatcccagcactttgggaggccgaggcgggcggatcacgaggtcaggagtttgagacaagcctgaccaacatggtgaaaacccgtctctactaaatatacaaaaattagccaggcatggtggttcgtgcctgtagtcctagctactcaggaggctgaggcagaagaatcacttgaacccgggaggcagaggttgcagtgagccaagattgtgccattgcactccagcctgggcgacagtgtgagcctccatctccaaaaaaaaaaaaaagtggctttataacctgccttctttttcttattcccagtgctcttaaagttccgtacagataaaggaagagatcccagttctgatacatatgaggaagattctgagttgttgctccagatacgaaatgatgtgcttgactcactgggtattagtcctgacctgcttcctgaggactttgtcaggttggtgtcagtatttatcactgtttagtctggacagataaagtttgttttcaggatttgccttaatttgacaagctcttttattagaaacccttcagagagcaccctgccacattctgctcgctcctgtagacttctgcctctccactagaatagcaatatataaaaaataaagaggggacagattctgatttttacaataagtatcttatattcacgtggttcaaaattcaaggcaatgtaagatctgtaaacattattctctaccttttttcactttatgtgatcttgttatctcttggggacatctccagatcagtacatagtttgctccctcttttccacagctccttagtattctagagtgtgaagcgatggagtttattgaaccagttgcctgctcactcaagttgtgttcaggcttttctaactgcgtaacactgcagtgtgtgaccttgtgtcgtacgtgtgcaggtacaactgcaggataattaggaggaagggagttgctgggtcagaaggttgtaatttatcatttggtcagcattgccaccttgcctccattggtatcctatcaattcatacccccagcagcaaaaccacccatgttcccagcatcctctcacttggacactccatgctttcaccttacgtgactacctttttgctctcataaacaggcttaggatttgattggagaagaccacatagtgactaggtcacaatctctctctctcttttttttttttgagacagagttttgctcttgttgcccaggctggagtgcaatggcacaatctcaactcaccgcaacttctgccgcctgggtccaagcgattctcctaactcagccttttgagtagctgggattacaggtgcctgccaccacgcccagctaattttttttgtatttttagtagagatggggttttccatgttggccaggcaggtcttgaactcttgacctcaggtgatccgcctaccttggcctcccaaagtgctgagattacaggcatgagccaccacgcgctccatccacatctccttccaagcagctctgggatcatgtacacaccctaattccctttccatgtcttgagaggcttcctaaactcggctttgcagtgcctccagcttgtagcagtgataatgatggctgcagtttactgagcagctgttatgtactaggcatcaggtagtaagtagccaacccagatcccaccccaggtatcattacagtgcttgctctagtagcagcatgctaccttggtttcttatcaacagtaaggtctgccagagtccctagtcctttctttgttgacttcctgctgggaacttcaggtgagcaacagcaaaccccactccatttagggccagcagtggtctttgaagcacctgtggtgccctgacccaaaaagccatgattgtcctggtacagtggctcacacctataatcccagcactttgggaggttgaggcaggcagattgctttgagcttaggagtttgaggccaaccttgacaacatggtgaaaccctgtctctacaaaaaatagaaaaattaactgggcatcgatgactggtgcttgtagtctcagctactctggaggctgaggctagagcatcgcttgagcccaggaaagcagaggttgcagtgaaccaagattgcaccactgcattccagcctgggtgacagagagagaccgtgtctcaatacatatagcgtaaggctgggcgcggtggctcacgcctgtaatcccagcactttgggaggccgagacaggcagatcatgaggtcaggagattgagaccatcgtggctaacatggtgaaaccccatctctactaaaaatacaaaaaattagccaggtgtggtggtgggtgcctaagtcccagctactcgggaggctgaggcaggagaatggcgtgaacccgggaggcagaggttgcagtgagctgagatcacgccactgcactccagcctgggcgacagagcgagagggagactccttctcaaaaaaaaaaaaaaaaaaaaaaaggcagcaatagagtggcagtgcctgagcacacgagactgagacatggaaaagcggtttccccaaagagggtgggcagggaaggaaccactttggagagaaaaccagccagcagctcgttaggctgtggctttcctcttctaggaagcagggccttcaactctgctggccggtgatgcagagccagaccgttcatcactttgaatgcccaagtagtcacttggctgcacactcacggcccagcacacagccccaggtatgctcagtggctgccgcttgccactggctgactggctgggattattggaactgaagccctgcatgacccagtccttcttcctgctgcgaagcacagcagaggaaacacttgcttctcacaaactggtcattcctccaccaagagatgagtgccccagtgagttaccatgagatccaagcctgtacagtgtcatcagccgctgacctcacggtgctgatgttacaaaggcaccttgtaaactgctgcctatgtttagatgatggctttttttttttttggagacagagtctcgctctgtcccccaggctggagtgcgatggcatgatcttggctcactgcaagttccgcctcccgggttcacgccattctcctgcctcagcctccccagtagctgggataacaggcgcccgccaccacgcccagctaattttttttgtattttttagtagagatgtggtttcgctgtgttagccaggatggtcttgatctcctgacctcatgatccacctgcctcggcctcccaaagtgttgggattacaagtgtgagccaccacgcccagcctctttttttttttttttttaagatagggtctctctctgttgcctaggctagagtgcagtggcacatcatagctcactgcagcatcaacctcctgggctcaggcaacactctcatctcggcctcttgcgtagctgggactataggcgtgtactaccaagcctgcctaattttttttttttttttttttttttgtattgacagggtctcactatgttcaccaggctgtttcctattttttaaagttatgaaccgcataacaagagagtatacaaagcacatctgcctgagttaaatgataattaatacttatttatttttgttgtagagacgggggtctcactctgctgcccaggctgttctcagactcctggattcaagccatccttctgccttggctttccaaaacttctgggatagacaggcgtcagccacttgtatctcttttaatttggaatagcccttggcaaactggcttgccacctctttttgtaaataaagttttattggcacacttactcatttatatattatctgtggcagcttttgtgccacagcagggttaaatagttataacaaagaccatatggcccataaagctgaaaatattttattatctggttcttttgtttgtttgtttgtttttgagacaaagtttcactttgtcacctaggctagagtgcagtggcatgatctcggctcactgcaacctccacctcccgggttcaagtgaatctcctgcctcagcctcctgagtagctgggattacgggcatacgccaccatgcccagctatttttttttatttttttattttttttatttttttttgagatggagtcttactctgtcacccaagctagagtgcaatggcccgatcttggctcactgcaacctccgcctctgtgctctgtggttcaagtgattcttctgtctcaacctcctgagtagctgggactacaggcgcgtgccaccacgcccggctaatttttgtatttttagtagagatggggtttcaccatattggccagactgatctcaaactcctgacctcatgatccacccagcttggcctccgaaagtgctgggattacaggcatgagccactgcacctggcctgttatctggttcctttttttttttttttttttttttttttttgaatcagagtcttgctgtgtcacccaggctggagtgcagtggcgtgatctcggcttattgcaacctctgcctcccagctttaagtgattcttttgcctcagcctctggagtagctgggactataggcacgtgccaccacgcccagctaatttctgtatttttagtagagacggggtttcaccatattggccagactgaactattcctccaatacggccaaaatgagattctaccagcaatgggaggagtttttttaattattattattgggagtctctctctcacccaggctggagtgcagtggcaccatctcggctcactgcaacctccacctcctgggttcatgcaattcttccacctcagcctcccgagtatctggcattacagctgcccgccaccacacccggctaacttttgtattttagtagagacggggtttcactatgtaggtcaagctggtcttgaactcctgacctcaaatgatccacccgccttggcctcccaaagtgctgggattacagatgtgagccaccgcacccagccctagttctccatgtattttagagctctgtagtggaccttgataagcaggaagatgttacccctggatgaacaaaatgggaatgtgctggtcctggccagggcgtaaggagccggaggtgcctttggacacagctcttgggattggaatggatacagccttttgggagggcattttggcaatacatatgaaaaactagcattgctatatttagaaatttgtcttaaggaattatttcgacgcctgtgtctttgtcaagatgtatgattacagtgttgaacagcttaaatgtccctcaataggttatagaacagaagagtaatagttgataatatttgggtttaaaattatacctatttatttatttatttattttttgagacagtcttgccctgtcaccaggctggagtgtagttgtgcgatctcagctcactgcaacctatgcctcccaggttcaagcgattctcctgcctcaacctcctgagtagctgggactacaggctcaccccaccacaccaagctaatttttgtatttttagtagaaacggggtttcaccatgtgggccaggatgatctcgatctcttgactttgtgatccgcccacctcgacctcccaaagtgctgggattacaggcatcagccactgagcccgccctaattatacccgtttagattgtgcacttttaaaaatgtctagaaggggctgggcgcagtggctcacacctgtaatcccagcgctttgggaggccgaggcgggcggatcacgaggtcaagagattgagaccatcctggccaacatggtgaaaccccgtctctactaaaaattcagagtagccgggcgtggtggcgggtgcctgtagtctcagctactcaggaggctgaggcaggaaaatgacatgaatccgggaggcggagcttgcagtaagccaagatcgcgccactgcactccagcctgggtgacagagcgagactccgtctcaaaaaaagtctagaaggatgtgcaccacactggggagattggaggtagttctgtagggaggctttccctttcacttgtctgtgttccagtttgcttggtgagcacacagcattgtgttcaggagtaggagctggcagagcacacttcctttggggaagtggtggaattaagtgatttgcttactaggatgggtaacttggaggggcaggtgactgtgtcatctaaaatttgtcctctagatgccccatcctggcccagaagggctggtttctatgtgggttgtgaagactttttctgccctcatactttaatttcacgcctcaaatttcccttgcttcctacatgttaacacaggcctgctccctgacatttgtctgggaatagcatatagaacccactggccattatgggtaagaagagaattgcgagaatgtgaccagggcactgaaacatctgatatctctaggacagatataggaagcacagatatagtctttcctttaacttataaaggtaaaaataaaagtattgtgaaagaatttctgcttgccaaagttcaaaggtcttttccaaccacttatgaatcccttgctcagatttcattttcacgcctagatgccagcattaacactgctatctgaatcgggccctcctgctagaagttgtttttattcaggagagcctactactgaatttctccagatgtcatggtcacagttctgttcccagtgctccattttccttgtcttcctctcttttaggtactgcttctccgagatggccccagtgtgtgcggtggttggagggattttggcacaggaaattgtgaaggtaaaacatcactgtggagcagaaaattgttaaccatgactttgtatatgtgctgacagagagaatggaaactgtcttagacagctgcctgctttctctcaccccattcatctttgtttcatgccctccccatttccacctcatcccattttctctggcccatccaggtgccattcagcaaatgaccttggagtgcctgctctgtgcttagctcacagttggccatagtgcctcgaaggtgtgatctgctctcccctaactgtattagttatccagtgcctgttgtattggtcagggattctgcttctcatagctctataagtgagtactatcatgatccccacttaagaggaagacacttgggcccatgaaagggactccagaacctgtgctcttaacctctgtacagtttatctctattcatcaccatgacatcaaagccctcccttttttttttttttttttttttttttttgagatggagtctcgctctgtcccccaggctggagtgcagtagcacgatctcagatcactgcaagctccacctcccgggttcacgccattctcctaccttagccttccaagtagctgggactacaggcgcctgccaccacgcccagctaatttttttgtatttttagtagagacagggtttcactgtgttagccaggatggtctggatctcctgacatcgtgatctgcccacctcagcctctcaaagtgctgggattacaggcatgagccactgtacccagccgcaccccccccctttttttttttttttgagacagaatctcactttgtctctcagactggagtgcagtggcatgatcttgactcactgcaacctccgcctcctgggttcaagcgattctcctgcctcagcctcccgagcagctgagagtacaggttcccaccaccacaccaggctaatttttgtatttttagtagttcaccatattggccaggctggtctcgaactcctgaccttgtgatcctcccacctcagcctcccaaagtgctgggattataggtgtgagccaccgcacccggccaagcccccgtctttttaaccacacactgtaggtatttgtagagaaatcagtttctgtgtccccatgaacacaccaggagcccctcaaggctctgtacaggatgacccgtgaccctgttaggtaggtgttagtgtgtctctcagaagggaagcatcttatacagggtcacataaccagtaactagcacagccttttgagggtcttctggaacatttgggttgctaaaactataccatacccccaaatatattgtacattctttgcagactttgctatttgcccgaagatgttaaatttgccttttgcaggttcttggctgccttcgtggactccggtgaggctttttccttctttcttatggagcagagtcgtgcctggttaaatgattggccatgtccatgtacatgtcaagtttgagcttgggaggacagtttggaggccagcccttaacactttgtcttggggtctgtacattctggaggcgtttggctcaatttgttagtcacaccgttttcctaaggctactttttttttttttttttgtctattttttctgatccttctctctggtctaaattcttcctttgatcaaatctaactttcttctatgtaatgggcaccgaggagatatttggagggggaagaaaagtgtgcaatggccatacctctttccttgctcacattttatacatagcccagagtgatgtgaaaattacagtttatatgcccaatctgagaagagggtaatggccacccagaggactgttcgagcaggattctgaggctccctgtagacaaactgcaggaaagagtgcagcaatgggaatgttctaagtggggaatgggaatgtacatatttttgtagcctaaaatgacgacaccaccaataatagacaagacttactgaaagcccactgtctgccacacaaagacagtgttttttacgtggatactcatttcatctcccaccggccctatgaggtaggaactcctgtgatccctggtttataaaagagagactaaggtgcaggaaagaagatgcttgcccaggctagtgagtgtggtgccaggatgtgggcccaggcagtctggtttctgagcctgtcctcttcaccacggggcagtcatgcatcaggtgttgccttcaatggcaccatcatgtagagactgcatggaccccagggccgctgcccttgcattgtcagccttacttctgcacatcccattgaggggctccccctaaatttttcatgtgggatggagactggaggttggggcaggtagccttgaccccattgttggtggtagtttctcacatccccatcctcacacagccccctccttcctgcctgctggagacagctggtgcccagcatcttgtttctgtttatcccagatagccagagtactctgcattcttcgttgctgggtgtgtttggaatctcctcctaccccatcttgcttgggaagcactttaccttttgccccatgtcaccccatgccctgctctcatccccagtactccttcatacttattactggtcagccttcagccagctggcaggcggggcctgcagtccaagggcctcagactcacctttctctcctgaggcactgtctgagcgcctatggaaagcttacactaggagatgggtcaagcgcaagtctgctcctttggaatcatcttttgcgtctttcctttcttacgtccttctagataccctattttatatccatgtctacttccttgggtttaaagcagttttcctttctctccatccccaccgtccacggcaggtctccctgtctatggtaagagaggtgatagtgaaagcagcagccatcccaggttcatggtaaaacacataccatctcctgtatcttgggtttgagggtctaagagttccacctgtgtactgttggacccttccacctggctaggttggtggcatccccagtattggtaaaggactcctggccctattattattaatagcagctcctacttactaagaatttactacgtgctcggcactttacaagcctagtcacatttcattctcaccaaaactctagcaggcaggtgctttttatttgcctatttgcccagagaagcaaacttctttctgatccaagctccatgtggacagagacctcagaatccttaatgtctagctgaatacctggcatagagtagatgcttaataaatgttcccttgactgggtgcagtagctcatgcctgtaattccagcactttgggaggattgcttgaacctagaagttcaagactagcttgggcaacatgaggagacctcatctctacaaaagtcccagctactcaagagggtatgggaggatatctggagctggggagacggaggttgcagtaagccgagaatgtgcctcccacctgggtagcagaacaagatcctatctcaaaaaattaaaaacatttacaaataaataaaatttccctggaaaaatggctgactaacactatttgtatatggtagatgtgattgtccctgttttatggatgaggaaaagggtttggtgctgagtttgaagaggagcagttcaggatgtgtagccccaccttcctcatgaatgatgggacggtgctcctgggaaccgttaaaccctgccctggcagcttgcctaggtgatgtcttcctctttaaatggtagcttgtggtgaaatttcaatcctttctgggttaaggacctgtttgaaaatttgtgacaattgtgaaccctttctcagaaagatgtatgtgcatacaagactcagtatgttgtttcgggggctgaccctgcctcaaaagacagggccacgtgctcactctccttcccacccctctctctcgctctctgttgcccaggctggagtacagtggtgccatcacagctcactgcagacttgatttccctggacttaagtgatcctcccacctcagcttcctgaggcactgagactataagcacacgccaccacatccaactaattttttttattttttgtagatatggggttttgccatgttgcccaggctggtctcgaactcctgggctcaagtgattctcccgcctcggcctccctaagtgctgggattacagatgtgagacattaagcccagccctgttcttgtattttaaagtgctctgtctggtaaccccacaagataatcaccattgccattgctaaatagcattgtccaggccctctggatcccagccctgaccccctgtggaagcctagcgactctatgtcctcatggaatagcccccgcttctgcatcagtgtgttccttgattaaatgtgtccccttaggtgataaaggccacagcctaagaactgccacctttctcagttgaatagtcatgaataattatttctgctgtttgcccaatggtggtgcaacacagtgttagtcattgttttagttttaaggtgtttttttgtttgtttgttttttgttttgagacagggtctcactctgttccccaggctggagtatagtggcactattacagctcactgcagcctcaatgtcccaggctcaagcgatcctcccacctcagcctcccgagtagctggcaccttgggcatgcatcaccatacctggctaatttatgtcatttttctttttctctttttttttgagacagagtctcactgtgtcgcccaggctggagtgcggtggcgcaatctcagtttactgcaacctctgcctcctgggttcaagcaattctcctgcctcagcctcccgagtagcatgccaccatactcggctaatttctgtatttttagtagagacaggtttcaccgtgttggccaggctggtctccaactcccaacctcaggtgatccgcccacttcagcctcccagagtgctgggattacaggcgtgagccactgcgccccacctattttagttttcatatagacgggatctcaccatgttgcacagactggtcttgaattcctgggctcaagtgattctcccacctcagcctcccaaagtgctgggattacaggtgtgaatgtgcctggccctggcctgttttacatttttgagatacatagtttaacccaggcaaatacatttcttaatctcatgttaggaaaataaggtaatgtttggagaggttaaataatctccccatggacacacagcttgtaagggacagagcaaggagataggacaatcaaaattgtctccagacattgccaaatagccctttgggagcaaaatcgaccccagttaagaaccactgccctagactgcttttagaatttttttttccctctattcctcttaaagcacttgagctaaaccctcttttcatttttctccccaggccctgtctcagcgggaccctcctcacaacaacttcttcttcttcgatggcatgaaggggaatgggattgtggagtgccttggccccaagtgaactcaagatttggcagccccagagatgccaactgcagcatgcccacctgtattccctgtccccttccttcatgaaggcatctccaggcaaggaaaactgaagtcattggcccgatacaaaacatttcctgcaacgaaggaggtggtgccgacgtgctgcttcccatcaccagcagctgctcgacaaggggcgcagggtggctgtctttgttccagcactgttcaggctgcctgtcatcccgggcctgccagctcccctgagtgatgagcacttccaagcacccctctgccctttctctgtccttatgctgtcccggcctcgccagccctctggggcattgtgggagatgcctgccaggaatgagcaagctctgttgctcgggagcctcttgtcaccttcttggacttattccccacctgataccttatagagaaaagtgtgaattcaggtggagagtaggcccaggccccatgaggcaccagtggaagcacagctccaagttcagacaggtgcccttagagaggaaaaccatgacaggcaaatgcatttcctctggagtttgagaccctgacaaacaacaggtggcatctggtgtgctgttcttgagttttcgtttaggattagttgagttccagctgggttttgggagaaaggagatgctaccaagtcttggatgttagggcgagaccctgcaagttgagtattagagagcttgtctttcaaggcaggttcctggggcttcagggctaggagggaggagcctgcccttttaacagaaccccagtcacatgcggctcaagtcactcagaggctgttgcatttcagggctatgttggtcctttgtttacctcctaaaccacagctgtttgtgtttcacatatgttgtgaattttccttggttctttttaaaggaatgataataaagttacttgctttaggatttgcttgtttttcttccacttcagaagcttctgagagggaatgggatgatcctaccagttgccttttcagacctgaggctctaactcaagagattcctcctctccctcaccattcctgccaccattttttctgggtgatgcagcaagagttaaattgttcacattctagaatgtgtagaagcttctggctccagttgtctaatggataattcagctaaatagtggctattttcagtggcaagaattataataataaagggaagtcaaaagtgatgcttcatatgccccaagtgccacagccgctacgggtcagagcttttattggaagaccaggtttgccttgatgcagccaaagtgcgttccagttcaccccactcttgcttgtgtttcttctttatgtaaattgtgtgatgtttcaataaatcagtctctttcctattctga

SEQ ID NO: 2707 - DNA, 79815 bp, Homo sapiens; identical to SEQ ID NO: 2706

SEQ ID NO: 2708 - DNA, 79815 bp, Homo sapiens; identical to SEQ ID NO: 2706

SEQ ID NO: 2709 - DNA, 55113 bp, Homo sapiens
tggccttgggagatgagggcagggcgcagtttgaacagagtccctggcccggggagagaatgacagtcaggggtcagaggtcaagaggccagcaggctcaagagttctgtggacggggctggtccgtccaggccagccatcacctctccaggaagaatttgagagcccggtcgatgttcatgcggtggcccaccctggtcacacctagatcgacgtagtcctccttggtcaaggcgggcaggtgggagccatcgatctcgtggtccaggaactgggctcggtgctccgccaaacccagccactccagccaatcagccacgtcgaacttggtccagaaccccagaggtttagcgccaaacggcttgtccgggggcagcgagagcaggcgggtcggtgagagggagcgcgaggcccctgacaaggctcccccgagccccccggatatccccgggtgtggcggcacaaagactggggcgaaggggtcagccgagcctcctgcccctccagttggggagccacggatgtcaaagaggcctgggtagaggggtccggaaggcaggatgggcagggacgagggcctgggcgcagggctgaccttgtgctccgaggcgggcagcagcgaggggctgggggcccggcggagcagagggggccgcatctcgaactccacgccctggaggtggcgggtggacgtggaggaggaggaggctgagggtgaggtggcccctggggccgcagcggctgtaggggagacccctgttccggtggggagtggcggcagaggtggtttgggccagttctgaaacaggctgctgacaggcttggagaggagtgaggactgggagtcgtcggagagtctggaatgtgacaagggggcagtgggggaggacagggatttagggggcaagggcaggggtgagaaagaggcagaggtcaagatatagggagagaggaggagagacataagggtagggggagagacggaggagagacgggaagaaatggagggagcaaggggtaagacggccggccgtcgaggaaagaaatgaagggagagaaagatgagaggacagggagagggcgacagttaagagagatgaaagaaaaagagacattaagtgataataataataatcgtcaccgcttactgatgctcacgtgtgccaggcattgttctaagtgctttacatgattgcatctcagtttaatccccacgacagccctgatgcaggttactattattatcagcacagagaggttaaataacttgcctaaggacacacaggaagtggcagagcccggttatatggcaccaaagtctgagctcttcaccactattctatactgcctttcaggttatggccagtcgtagcagagtgaaagatggggagacagtgagagagagacaaaaagagggtgagcatccaggggagagagatggaagggacaggggacacagagagagagagatgaagagagggagatgaaagagagaagaaacaaggggagaaaaaggttcccctcatccctttcgttccctcccctccagcactgtcccacctcagggcctttgaactggctgctccccctgcctggctcactcttgccctgggcagctgctccctctccactttcattactctgcccaccttgcctgttacatgagagaccttctccacccatcccattgtggtagctttttttgtaggatggttgcaattattttgtttactgccccgcccccactcctatgtccctagactatgagccctgtggagttgcacagtctttgcctgtcctgtccagcaggggatcccatcacccagaagggcactctgcacacataggtcatgagtcaataattaatgcaattgttgactgaattaagcatccttcctgttgctgctacaagcagtggaaaaaaaaaaaaagaaaagaaaaaaaaaatcctcttctctaaccagaatacttaagaatagtcaaggaattgcattcagttcttaaaggcctaataaacccacatttgtttgtttatttttacagcgtaggagcattgattcaagttgctctaataatatacacttcctttttcttttctttctctctctctctctctttttttttttttttttaagacagggtctcactttgttccccaggctgcagtgccttggtgtcatatcagctcactgcagcctcaaccttccaggctcaagtgatccacccacctcagcctcctgagtagctgggactacagaggcaggccactgtgcccagcctcctttttcttttctttctttttttttttttttcaacctgggagcatagatttaagttgccccaaatatacactccctgaacccacatttgaaggtcagacacatttggatagcagaccttcaaacagaattcaagtgaactctgtagatggacaaggatatttaaaacctgctcccaaccctctgtgtatctgaagcagaaatgtaactctactttctctaggactagaaggtcttgaatgggctcgaattctgcgacgatgcagctgactggctgctctgggaagcatctgcatcatcccgtatttccccacgtagaagttgctgggctcttgttcgaggccccctcttcccccatcccatgttacaacaatggcacacactaaatcctctcaaaaactctttgggctggcactaggccattccacttctacagagaggtggattcatttgcctaagatcacccaggtagaaagtgcagggttgggactggaagctgagaaggtgggctctagaaccacacctataactgcatcctgtcttgaaccacactggcttcaagggactcacagatttcagggactgtcagaaagaagtggcagctcaccaaggaaacaaacataagcaggtctcactccagtctcctttgttaataactttttttttttgagacggagtctcactctgtcacccaggctggagcacagtggtgcaatcttggctcactgcaacctcggcctcccgggttcaagttattctcctgcctcagcctactgaggagctaggactacaggtgcccaccaccatgaccggctaattttttgtattttttttagtagagatggggtttcaccgtgttagccaggatggtctcgatcttctgacctcatgatccacccgcctcagcctcccaaagtgctgggattacaggcgtgaaccaccacgcccagcctgttaataactttttgttcatcatgggatgtaggttgtgatggtgatgggcagagacaacagaagctactgaaataaatggaaatttaaaggctggacccagtggcttacacctgtaatcacactttgggaggtcaaggcaggaggatcacttaagcccaggagtttgaaactagcctggtcaacgtagcttgtctctacaaaaagttaaagaaaaaatggccagggccaggcatgctggctcatgtgtggaatctcagcactttgggagaccgaggtgggatgaatcaccttaggtcaggagttcaagaccagcctggcccacgtggcaaaacccctcatctctactaaaaatacaaaaatttgccgggcatggtggcgggcacctgtaatcgcagctactcaggaggctgaggctggagaatcgtttgaacctgggaggcagaagttgcagtgagctgagattgtaccactgcactccagcctgggcaatagagtgagactctgtctcaaaaaaaaaaaaaaaaaaaaaaaaaagaagaagaaaagaaaaattggccaggcatagtggcgtgcacctatagtcccagaggattgcttgagcccaggagtttgaggctgcaagtgagctatgattacaccactgcactccagccgggtgacagagtgagaccctgtttctaaaaaaaaaaaaaaagccaggcatgttggctcatgcctgtaatcccagcactttgggaggccaaggcggatggatcacctgaggttgggagttcgagaccagcctgaccaacatggagaaaccccatctctactaaaaatacaaaattagctgggtgtggtggcatgggaggctgaggcaggagaatcgcttgaacccgggaggcagaggttgtggtgagccgagatcacgccattgcactccagcctgggcaacaagagtgaaactccctctcaagaaaagaaaagaaaaaaaaaaaaagaaaaagaaaatatttgtgaaagcatgcttctgtgacagcaaactcctgccaacctggtttctgtttcctttctgccaccctgagaccctaaagggacacagccatgccatcaacacctctggcctcccttgttggccaccagcccccgcttacctctgccgctgcagggaggaggtcctctcggggacatagctggctcccccgtggtggctgtctccgcctcccccactgcctcctcgggcccagggcagagcgccgccagctgccgaggagcccccaaactgctgaagcttggagctgagttcactgatgatgctggcttttactgtggccaaggctgaggcctgaggctgggccaagggcccgggcagaggtggtggcggtgggcccgggccctcctcccagggcagcagcttccggggcagagaggaggccgtcggcaagggcaccggtgggacttctggctctacagccaccggaccccccgccacgcctgccgtggggggtcctgaacaagcacgcagggccagcagcccatcggttccagcccctgtcaccgagacggtggggctggtgggggtaacagggtctcggagtcccccgctggggccaggccgcaggcctccgctggctcctagcgcccggccccggagcttagagggagtcatgagctgaggagggtatggcgggccgggagtactgctgcccccaaaggcctggccgtccaggtaggccacataggtgtccagaagctccggcccactggccacaccggccccagccccgcccccaccccctgcgctgccaccaccttcggcagataggctgctcagcgtggaggcgctgctgatggtctccagtgggtggtcactgctgctccgactgtccacctcctcgatgccagaatccgtgccaggcggagggtccgggccaggctgtggggcagcgggagccggtgctgctggggcaggcgggcctggtggatgggggtccccaggagcggcggaggccccctgggtcagggtggccacctcgctgtcataggatgtcaggctggatgcggtggagtccagggtgggaggggctgcggccacagccgggggtggcacagggggtaacggggtggcaggggcaggtgtgtcgggcagcgggtggggaggcccaggcgtgaggggcgactctggcttttcgaagctgttggagaattccagaggcggaggcagcggttccacgaaaaggaattcgccatcttccacatccaccgagggggcgggaggcggcaggaccagcaggggcagcccgttctcttcgctggccctcggggaggtcggggaggggggcacggaccggcgtgggctgggcggcgggacccccggcccgtcctccgaggggggaccccttccgctcgtcacaggggcccggggctggcagttttcaaggaaccgcacgtgcagcggcagccgctcgggttcttcgggggctgcggacctccagggcttgcttactccggggtgcggggccgggggctccgtccccagctgcagcaggaggggccccaccccgggagcggtgggcggcaggcggtgtagcagggaacgccgggcggcgggcgggctggcgggaagggacttctcctggctgcccagcccggccctgtaccccagctcccggcgcgcagggtccggcggggaggccccccagagacgcagcactggctcgtggtgggcgtggggcgagtggtggtgcggggtgggcggcggggcctcgtagcggggcgatgggggcctgggaggcggctggggggccccgccgccctccgaggactccttcagcgctcgctcgcgggcggccagggccagccccagcggggaggcgggatccagggccttgccggtcagcgggtgcaccaggggtcgcgggggcaggaagctggtgaaggcgctgctgcccccgccacccccgtaggctcggctaccggccccgtagccgccgtagcccgcgccgctgcccgcagactccagtcggaggtagggctcggcggagaacatgccctcgtcgatggatttggagtggcgcagccgcgggcccggggccgcccctgtgcccagcccgccgtccccgccgtcctcgtcccccgcgtcggtggacaggaacagcgtggagcgccggcgcgcctcattctgccagcccccctccctccgggccgcccccaccagggcggccccgaactggctcgtgaagtccagcgtggccgggccgctgggcgaggcgggggtgggcacgggcgagggggacgggggcacgggtgacatggccggggcggggctgggcgaggagccgccgccgccgccgcctcccgtgggctccggctgggtggggggctccgcctcggtgctgctgccctggctgctgcggccgctgctactggtggacggggccttgatgatgatggtggggatggggatggagttcttctccgagggcgcggccacggcgggcggcggctgcggggaggccggggacgtgggcgacggcgcgggcgggaggccgccgcccttctggggctcgccttccaccttggtctgcttgaccagcgggcccttgcggccgcggcccgagcgggcgggcacgtacatggctgcgctggccgcccgcgggggcagctggaaatagcgtagagccgggccctgggaggagccgccgcccccgcccgcgctgccgtggtgcgatggggacggggcccccggggtcgggctgggcccgccgcccctccagcctcgcaggctgggctggggccccagagccaggcggggtggagggtcgtcgggagagccgcctgtctccatctcgggaggatgaggggggtgggcgtggtggtggtggggctgagggggcggggcgtggtggtggtggtggtggggcgggtggtggtgggccgggggcaggggcccactgtggtacaggctcttctcgcggctccccacgcgagtgtcgggaggggagggcccgtcaaaggatgcaggggaggaggcggggagggggccaccagagccagggttgaagggccctccccgaggggagggggtgaggcgccctgaggaggaggggactggaggtgtgctgtagggaggctccggtggggacgtggtgggtggcgggggaatgtcctccgaaccaggcacagacaggctgcggctgaatttcatggctgggggtgctaggtaaggtctgtcatcttctgccgcacctggggagatacagaggctcaaggagggggaccctggcggggagggtctccctgctccactatcccatagaaccgcaacaatactaatgacaagaatggcaccccgtatatgccaggaacttcacgtggactcgcccagctcttccctatttgaggtaaacccaaatctgcttcatacagaggtacaggttgtgcactgcacaactgcaaaccgcaaggaaggtgaggaaactgaaattcagcagaacttcctccccacgccaggagggggcgccattttctaattccgttcaaaggctcagtgaacggtttggggccagcaaaagtggctggagctgggaagggatagtcccctcgtgtttatgcatagatgcgtgtttcttttcacgtatatgcgggaaagaaatgcaaccagcacatcaaagctgtgattctacagagagaaccacttatgatgaggctaaagtttaaaagggattggatctataaaaaaaaaaatcaggtaaacgatgcgagccaggtggaccccacactcagtgggagtgtaagactcacactggtggactttgaacgccaggagttggggaaagctgaatccaatcagggaaaaacaactccaggaggcgtgcaggagttaagtctttgcttacttcactgccaaggctcggtctttgaacctcttctcacctctgactactccctctcaactagtgaccagcttcattcactgcctttctgctgtcgacgcccacgtttatgcctggggccccatcctccgccctgagctctgggcccctatattcaaatacccacacccagctggctgtctcacgggcatctcagactccaaacgctccaacccaagctcctgatctcctcaccaacagactcctcccagcccacggtccctccccaccaccgcagcaaacagcagctctgtcctttcaggtgctaagactgaaaaccttgcagccactcttagctttcttcctcaagtcacccacatccaatccaccagcaaatcctgttgtttcaaaacatatccggaatccaatcccttctcacccctccagagtcaacaccctgggccagccactatcatttcctatctggatagcaatagctgtcacctcctctttggtcccccggcttcccagctcatccccttcaatctagtcccttcacagcagccagagggtttctgttaaaaccgaagtcagctcatgtccctcctctgcttagagccctgccattcactcacctcactcagggcaaaggttcaagtcctcaccatgactccccagaccctgcaggatcgggaccctgtccccccactgccctcatgtccagtgctcacttggcccctgctacacaggcctcctccctgttctgtaaacgcaccagactcagcccgacctcaggacctttgcagaggtagttcgctctgcctggaatgcctcaaccccagggagcctcacgattccccacttcatctctaggtgtttttttttcttttctttttttttgagacagagtctcgctctgtcgcccaggctggagtgcaatggtgcgatctttgctcactgcaacctctgcctctcgggttcaagctattctcctgcctcagcctcctgagtagctgggattacaggcacatgccaccacgcttggctaatttttgtatttttagtagaaatggggtttcatcatgttggtcaggctggtcttgaactcctgaccttgtgatccgcctgcctcggcctcccaaagtgctgggattacacgtgtgagccactgtgcctggcccatctataggttttagctcaaacctgcaccctgccccctacccagcactccctatctctcttaccttactccattattttttttcactctttttttttttttttttttttgagacagagggttgctctgtcgcccaggctggagtgcagtggcacgttctcggctcactgcaagctctgccttccgggttcacgccattctcctgcctcagcctcctgagtagctgggactacaggtgcccgccaccacacccggctaattttttgtatttttagtagagatgggattttaccatgttaaccaggatggtctcgatctcctgaccttgtgatctgcctgcctcggcctcccaaagtgctgggattacaggcgtgagccgctgcgcccggcccactcttttttttgttttccatagcacgtacaactgctaacatactagataattttcttgcttattttccttataatccattatctgtcttcccctgctataaggcaagcccatgagggcaggaacctttagtctgttttattcgctgacgtatccccattctagaacaattcctggcatgtggggagcgcttggtaaacacttgtaaaatgaatgaatggatggaatcgggtataagagaaacaaccagaaagctgtagcgggggctttagctcactgcatccccattctccagatgtagagccagaggcccagagaagtcaagccacctgccccagttcacacagctgggaaggaggggagccaggattcatggccaagttcacccatttccaaagcctgaactcttaacccaatttgatgaaactatggtctctctgggagcacagaacatttccaagtctgcttgcttttcctgaactgtcacgttcctggcctcccccagcccccacatctcttcttctgggtggcataccgatagatttttgccggagcatcaacccaggtcctggaggcaggaaagaaggacgctcgtaacttggctgggcacggtggtggggatcgaagctcgactttggagcggcagtcagagggggagagagagaaaagatagagagagatcagtcagcgcagaaaggcttgtggcttcactatacggctgcccccattccttccctaagcccctgccgtaagggagagcagtgtgaagacggtggaaggaggccgggcaacgtggctcacgcctgtaatcccagcactttgggaggctgaggcaggaggatcacctgaggtcaggagttcaagaccagcctggccaacatggcaaaacctcgtctctctactaaaaatacaaaaattagccaggcatggtggcaggcgcctgtaatcccagctactcgggaggctgaggcttgagaatcacttgaacccatgaggtggagaggtggaggctacagtgagccaagatcacaccactgcactccagcctgggcgacagagccagactctgtctcaaaaaaaaaaaaaaaaaaaaaaaaagaaaagaaggcgaaagggaattctgcgggaatgaaaagcctcaagtctgggcaggaaggagaaagaaaggagaagaaagcagattttccatcgactcttgatctgcttccttcctccagccactgcccacatccaggtccccaccagtgttctccgggatggagcagcctcttccctcatctccctgctgccatccttgatcccccaccctgttccagtctgttttccacacaagagtcagaggcatctttcaaaaagcatgctattgcccctgcttgaaatcccatgtcagttaggaggagatcagaggggaccaaactcccaactctggtctacaagaccctctatggcaggcactgctggtgcccctgcagctgccctccccctggatgcagcatcccatccctcacccactgctgggagggtcacctgcctgcagcccttaagaatcaccctccttcagagtcctggactcgcccagtccgttatgtgtccctgcttcctggagcagcccacagcccacgatggacggatacggaggcccgaggcagcactaaagccggggtgcccagcctgaccccatgggttcccactccagcgtgaaccgtgtctgcttgacttccttccacaaccccagccagtctcccacactccctgaaggttcccccgtagcaaacccttggtacaggaatccccacctccggctcccgttctagggaagcccacacgaagacaggtcctgcaggcgggacccagccctgcccccatttcccacttgctcccttggtccacctccacccccacctcttccttctcctctgtcagccccaggtctaccctcattggagaacacctgcgagccctggttctctcggcaacagctttccctcttattgtcacagttccttttcagcgcgaagttctcctcggcgagaccttccccggccccctacccagactgcacttccctctgtcccattttcttcacagcatctctcttccccagaaaccatcttgtttacttgctgtctgtttcctccactagcctagaaactccctgaaggcggggctgatgtatcccaggcatcgcacctacagtgtctagggcccatgatgcttttaggggaagtgttttcatttcttttcaaagtagaagtgaaagaaaaaaagaaaagagaaaattgtaccctggataatatcggtctttgcagcaacaaagtcataaaatttaaacttttttttttttttttgagacagggctggagtgcagtggcgttaacacggctcactgcagccttggcctcccgggcccaagcgatcccaaccccaaccttctgagtagctgggactataggcaggcacaatcacatccagttaatttttaaatttttttgcagaggcgagttcttgctatgttgcccaggctcatctcaaattcctgggctccagcgatcctcccactttggcctccccaaaagttctcagattacaggcatgagccaccgtgttggcctattttttttttttttaatgcagaagggcaaaagtgcctaaggttcatggaagtcattatgaaacctgcctgagggtagggtagtgactttatcagtctcctttcctactgagtccccggtccccgcatagggcctgctgttctacaagcaagtgttagatgagtaacagggagaatcagccaaggtcaggcacttcggggccctgactccccagcttctgccaggtcaccccatgtgtctcccttctccatctttgagaccagaagtgcagagaaagggagccctctcggaatgaagttcgcacctttgggatgaacccttacttcctgcacttcccactataccccctcctgcctctttcctccagccattcacaaccattcccagttccctcgcttctcacttccgagactctgcatggagcatcctttccctgggctctgggctctgcttgggaaagctctgttatcttagccctccaccctggcccggctacccgcttcctttaggcctgcagtgcccccctagagcagccactagccattcaactgtacatttcaggccaacgtggtggctcatgcctgaaatctcaacattagggaggatcgcttgaccccaggaatttgagaccagcctgggcagcatagggagactctgtctctacaaaaataaaaattacaaaaattgctgggcacggtggctcatgcctgtaatcccagcacttcgggaggccaaggtgggcagatcacctgaggtcaggagttcgaaaccagcctggccaacatggtgaaattccacctctactaaaaatacaaaaattagctgggagtggcggcatgtacctgtcatcccagctatacaggaggctgaggcaggagaatcacttgaacccgggaggcggaggttgcagtgagccgagattgtgccactgcactccagcctgggtgatagagcaacactcggtctcaaaaaaaaaaaaaaaaaaaaaaaattaaccaggcatagtagcacatgcctgtcatcttagttacttgggaggctgaggtgggaggatcacctgagtgcaagagttcaaggcttcattgagctatgattgtgccactgcactccagcctggatgacagagtgagactgcgtcattaaagaaacagaccaaccaaaaagacaagtgtaaatttcaattaattaaaattaatttgtaaaattcaatttctctgttgcactggccacatttgaagtattcaacagttacctgtggctggtggctaccaaattggacagtatagatatggaacatttcatcatcacagagagctctattggttctagtccagagtttcctggggtctgtattacatgcctctcactacacttcccttcctgaattgggactgtctgtttctatgtttgtctcattgattcattcattccagaaatatttattgaggacttcctttatgccagggactgtgacagatactgcagatacgacaaattagacaaatgtcccagcccacaggaagggcaagcaggccataaacagcataaattcgtaaaatataacattggtcagatggaggtaagagggaggagagagggagaatgtaatttaaaatatgggctggtgccaggcgcggtggctcacacctttaatcccaacattttgggagttcaaggtgggtggatcatttgaggtcaggagtttgagaccagcctgaccaacatggtgaaaccccatctctactaaaaatacaaaaaaattagctaggcgtggtggtgcatgcctacggtcccagggaggctgaggcaggagaatcacttgaacctgaaggcagaggttgcagttagtcaagatcgtgccactgcactccagcctgggtgacagagcaagacttcatctaaaataaaatagaataaaataagggctggccaggcacagtggctcctgtctgtaatctcagcactctgggaggtgggaggattgcttgatgccaggagttcgagactagcctgggcaacatagcaagaccctgtctcacccccaattttttttttttaattagtggtgcatggtggcatgtgcctgttatcccagctacttgggaggctgaggtgggaggatcccttgagcccatgagtttgaggctgcagtgagctatgatcgtgccactgcactcctgcttgggtaacggaacaagaccttgtctcaaaataaataaaataaggaggtcaaggaaggcctcactgagaaggtattatttgagcaaactcctggaggaggtgaaggagggggcataatgatgtgtagaggaacagtgttccaggcaggtggaacagcaggtgcaaaggccctgaggtgaaggtgagccaggcaggctcaggaggaataggaaggaggccaggagctgaagggtaggagttgaggttagacaggtgatagaagggtgggagtgggtaggacctgcaagtttcaggtttctttcagatttcggctccaaggtctcctctctggagaggcttcctcctgttactctgtcataactcctttaactgatgacagtttggagtcatcatcattatttgcttgcttgtttactgtctgtctccctaggcatgcagcccaccccaatactctttctactctatttccttggtaagaaaatgccaatcttatttggcaccttttgagagactacacttcccagcttcctttgcagctaggtgtggccatatgactaaggaaggccaaccgggatgcccaagtgggagtgttgtgtgttacatctgggatgtcttggaggtaactcaagaggcagcaaggtgccctcttttgcccttctgcctttctgcccttccttgttcctgctacctggaatgctggtgcaatagctagagctccagcagcaattttggactatgaggccagtctgcagttggaaacatggctaagatggtggagcagaaattgagaaggattctgggtctttaagaccatggaggctgctaacctgcctgagacttcctatctcatactttttttttttttttttgagatgggagtctcactgtgtcacccaggctgaagtgcaatggcactatcttggctcactgcaacctccacctcctgggttcaagtgattctcttgcctcagcctcctgagtagctgagactataggttcccaccaccacacccagctaatttttgtatttttagtagagacaggggttcaccatgttgcccaggcttgtcttgaactcctgacctcaggtgacccacccaccttggcctcccaaagtgctgggattacaggtgtgagccactcatgcctggcccccatacttctttaacaagagagagataaaagcatttttcttggtcaagccaccattatttgctttttctccctcaggtgcagcagaacccaattctgctagtctcctctttcaaatgtaaattctctaaaggaagttactttgtttgactgattcactcttataccttgagagcccagcagcaggtccaggatatagtaggtgctcaataaatatttgtagaaggaagaactcattggaagcaatacaagacaccctgacaagatgtggcgagcaactccagggcaaaaccccagcctgttcctctgaacatccccatcaaacagcacagggccagctccaagcaggcttcaggaggtgtcgcctgaaggcatccctgctttgacggatttcctgccatgctgctcttctctaagcgcttctcagcctgctcaatccttctccactttgctgaatgtttttctgaccccctcccccacctccttcagccacagaccaatactctgcttggctttctgtcccgtcctgcagctgtgtggtatcagagagcagaaccttgcaaaagataaaggcagtagagaagtggcaagtggaaggagacactcttgtgtgagccattttacctgctatttttcgtatgtgtcctcactggatcctcacacctgtgagttagggtggattatacccatttggatgataatgaaagaggccgtggatcagagagaaaaggtccttatcctagaccagccagcgagtaaggaggagattcaagatgcatcggagaaaagaggtcagagtggctcaaaaaccctgagataaaatgggaggggtacgaagagccaggagaagggggtgtgaccagtcaggaagcacacggggactgctgaggggcagggctggagaggacagcaagaacagagtccaggcaggagaggacagctgggaggaggggaggaaggcaagggaaacacctgcatggggcacgggggcaggtggtgggggccagagggagaggcgagggtcaggtgacaggtgagggtgaaggtgatgaggcagggatccgagtgacagtggaggggttgatgtgacagtggaagggtcagagtgacagggaagggaccagggtgatgggggagaggtcaggatgacagggaagggtcagggggacagtggagaggtcaatgtgacagagaaggggtcaggtgacagagtaggagtcagagtgatggggaagggtgagggtgacagggtgggggtcagggtgagagaagaggtaaaagagagacagtggaggagtcaaagggaaaacggaggggtcagggtgatggggaaaggtcagggtgatggggaggggtcagggtgatggggaggggtcaagatgatggggaggggtcagggtgtggggaggggtcaggatgatggggaggggtcagggtgtggggaggggtcagggtgatggggaggggtcagggtgtggggaggggtcagggtgtggggaggggtcaagatgatggggaggggtcagggtgatggggaggggtcagggtgtggggaggggtcagggtgtggggaggggtcagggtgatggggaggggtcagggtgatggggaggggtcagggtgatggggaggggtcaagatgatggggaggggtcagggtgatggggaggggtcagggtgtggggaggggtcagggtgatggggaggggtcagggttacaagcattacaggtaaggggtgagggtgatgggggggtgtcagtgtgacggggaggggtcagggttacaggcaaggggtcagggtgacgggagagggcttagagtggcagggaactggttagagtgagggggaggggtgtccccgacagaggagggtgcagagtgacagacgcctcgtcagatttgcaagctgacaaaagacacttcagcaccatgtggaagaagaagggacaaaaatgggttagcttgacataagaagggtcagggtgacaggagagatgtcagactgacggaggaaccataacaatctgatggggcatcgcactgactccccagggagcacctgaactccaccaaccaacgggagcattcgctcccgcgcagaagggacagccaatcagagtgcgcagccttgcatgacgtcactggctgccgggcagactccccttcagtccgccgcccaaaggcccagttctccgtcacctcgtggtctggcgcctcagtggcagcgcatgtcctgccgctgaccagtggctggggaactcctgctaaggaggcagccctgagaggggataggggagagaatggacggggagacaactgaagagacagagatggggggacagagatagacagagacagagagagggagacaaggagacacagagacagacgtagagagacagaaaaagagagacagagatagagagacagagacagacagacaaaggcaaagatggggagagagacagagatggagagacagagacagagacaaaggcagagatagggagacagagatagagagacagagagacaaaggcagagatggggagatagagatggagagacagagagacaatggcagagatgaggagacagagatagagagacaaggagagagctagggagacaaggagacacagagacagagatggagagacagagacaaagagacaaagacagatgggggagagagggaggtggggaaacagggagggatgggaagagaaagatagggagagtgagagaggcgaagagcgacagacagagatggggcctagaagggggagagacaaggactgagagatgagaggggaaatgagagggcgatgggaagcatgggaagcaggaagagcccagagaggaaggagggagggcagctctgactcagagagggcctgcgcagccccaggagggaaccccagaagtggggagtgcaactgagagggagcaatgacgtctcagactgagagatgagggggcacgagggagccctcgggcatcagtggcgggtgacaaagacagtaccagagaaagccaaagccataccgaggggcggatggacagcagagccctaggaggagacagcccaagaggtgccctgacctagggtggatctgctgggctccgcgcccctgctgtccctacctcctctaggttatatgcaaaagtgcatctttggagagggttgaaatctcccagtttccaagtccttagatagtggcatctttttttttttttccccgagacagaatcgcaccctgtcacccaggctggagtgcagtggcgcgatcttggctcactgcaacctctgcctcccaggttcaagcgattctcctgtcccatgctcccgagtagctggaataacaggcgtgcgccaccacacccagcaaatttttgtagttttagtagcgacggggtttcaccttgttggccaggctggtctcaaactcctgacctcaggtgatccacccgccttggcctcccaaagtgctgggattacaggcgtgagccaccacgcctggctgatagtggcgtcttatacaatgctttgctcttgttcacttttgtgcagacctgatccaagaagcctcggggggtactgcaccccccaccccactgcatctagaccagagggaagatgcagggtgaagaggggagaggagcctaaatgaatgggaaatcgagacaccgagaacaagaccagacgtcgagagaggccaccaagatgcagaaacctcatgaaggggcatctgtattgactcagagagcgggaaagataaagatggcaggtgggaaggagcagagaaggcggcagagagagcctccgacatgagagggggacctggagaaggcccagggacagatccaagaggtgagagaagaaaaggcgagggggatgtacagggcaaatgactatgggtcctctggacacagagggaaaggaggtctcccagaactcaggtgagtgcttgtgagtttcatttctaggaggcaggggcaggtgggcagctggttttattactggctggtgtctgggctcctctgggggtggaggtctttggagctcagagggtgagttccctgagggttaggctcttgactgtcctgtaactgggttcgtgcagggtagacctagaactgtggctgcctggcactttacaggagctctgcgcatttgttgaattaatgaaaacaggacttgctctaattagtttatcagagatttacactcagtctgatacgctattgtggggtctctggtgttgcggggtctctggaggcatacacagagatcactggtgagccatggtggactttctagtttattttatttcagtgaattaatttatgtatttattgagacaggtctcattctgttgcccaggctggagctcagtggcgcaagcatggctcactgcagctttgacctcccttgctcgagtgatcctcccacctcggcacacaccatgactggctaatttttaaatattttgtagagacagggtctcactatgttgcccaggctggtctcgaactcctggcctcaagtgatcctcctgccttggcctcccaaagtgttgggattacaggtgtgaaccactgtacctggcctattttcttttccttttttctattttttttttagacggagtctcgctctactgccaggctggagtgcagtggcatgatctcggctcactgtaacctccatctcctgggttcaagtgattctcttgcctcagcctcccaagtagctgggaccacaggtgcacaccaccacgcccagctaatttttgtatttttagtagagacggggtttcactatgtttgccaggatggtcttgatctgttgcccttgtgatctgcctgccttggcctcccaaagtgctgggattataggtgtgtgccactgcgcccggcccagcctggcctgttttctatcctgaggggtttaccttctgttgggagtttgctgtgttacagttaacctcatggaaccctcataagaactgggcaagtttcactttagccccattttaaagaacagaaaactgagatgcagagaaattaagtaacatggtccaaggtggcaaattaagttagaggaagtcaggatttgcatccccatttgtctgttaatatagagtttctgggggatcaggaacaaacagaaacacctggggtatggttagagacccagagagggaaattcagagggaggagagtgtaaaatacagactggggggaggcatgaagaaatgggattagtgggagtacattccagacttccaataaatactgaataatttagtgagtgaatatggatggtagcatcctgaatctaagtccacttaggataatcctggggctgaaaatctttttaatctttttcgtttgtttgttttttagagacagggtggtctctctctgttgcccaggtgggagtgcagtggcacaatcgtggcttactgcagcctcaacctcggaggctcaggtgatcctccctcttcagcccccagagtagctaggactacaggtgcatgccaccacatctgcccaactaattttttgtatttttagtagagatgggatttttgccatgttgcccactctggtctcgaactactaagctccagggatcagccagcctcagccttccaaagtgctgggattataggtgtgagcccctgcgcccggccctgaaaatcttttaaccttagaatgatacagggcagtggttctcaatgagaggtagttttgccccccagaggacgttgggcagtatttgctgctggcatccggatggtagaggccaggggtgctgctgaaatcctacaatgcacaggacaggcttccacaacaaagaattacgcagctccaaatacaggcaattgtggctatatgcagtagttgtgttatatggggttgccacacatttccctcaaccaatcaatacataaccttgttttatgcatgtttctgttgaaggatgccttatttaatatacattgttgattcattcacatccaactcctggccaccagtgctctaactcatgcctgaatgaagcttctctaacatacgtattttctccataaggcacatcacggccttctcgcacttaggaacgctagacagctcttcagcaccatgcttgggggaccttttaaacgctgatatcaccactaaaaggcccaaagatgcaaagcacgtggcactaaacagaccgagaaaagacactcgttcacagtataagagccgaaatgagaaggcaccctcgttcagcctcgtctgggaacccacacatagggctactcaagattttctctgctttgcgcctgtccaagaataaccacaaaagcccttcgcgtattgattctgggcttctaataaatttcagcgagtaggcaaattcgcagacacagaatctgggaatcatgagggccaactgtgtcaacagcgcagatgttagaaactatgacggacaggaagaggtcttggactttggttctgtcttgatgagagacacacttgatgaaaggtctcaggcaagtgaatgcaaatctctaagactgtttcatcttctgtaaaatgggaatgtgcatgctctgtctttctttctgtttctgtaccgccctttccttcttaaagctggttgtgaagaagtttgttgaggaattatgagaagtttgctgcagggcagttgaggatagaagaagatcacaggaggaggaaacagggtcaaaaaaggtaagagcccaggggaggtagatttggactccatataaggaagaaggtttttttttttttgagacagagtttcgcttttgtcgcccaggctggagtgcaatggtgcgatctcggcttactgcaacccccgcctcgcgggttcaagcgattctctcgcctcagcctcctgagtagctgggattacaggcacatgccaccacatccggccaatttttgtatttttagtagagatggggtttctccacgttggtcaggctggtctcgaactcctgacctcaggtgatcagcccacttcagcctcccaaagtgctaggattacaggcgtgagccaccaagcccagcctcctactcttgatttttataaaagtacgagcccctccagagcatgagggattgtggatagacttcaggggcctgtgcacttgtacaggaaaaaaaatcctatgtcttcattttcatcatcctccaacaaaaactcaacctttcctcaattaaatatgtaagcagcaaaccatgctagtttcagcaagacccatgcctgtatccccagtaggaatcacagatatctccatatcccatcacagtggtgcagatttcccaaaatagtgtttatgcgcctcgtgattttgaaattagagttgttaaaatccaccgccaatgtctaacatgttgacaaaaaaagatgatattatgatatcacaaattttgcttttgaaaaatattttgagaaactacattttagtgtaactggcctcttttgttatttcatgttatgcatttataagcattattctgagaaggaccacggcagcctgccaaagagatccatgaccccctaaaagccaaaggacccagttttagagtaaatggacccctgaccactacgtggtggatgcggccagaggatggggactgggcagagaagaaggaagcgggaagggaggagcaaggcagagcgtggcctctggaggagacagttggagggtaaggggtggcactggcaagcctagtgggggatgtgttggagggaaggcacacagcccagtggagtaggggcaacatccaggaagggagcagcaggcccctaccaggatagccagggctgtggcaggaccatgggttcagagggctgcctgcctgggttaaaatcccccctccttccttgagcctcagtttccccctctgtaaatgggctaacaacctcgtgtacctcccaggatgaatctaaggaatgaatgagataatccatataaaatttgatgtctggctggtggctcacgcctgtaatcccggcactttggagggctgaggcgggcagatcacttgaggccaggagtttgagaccagcctggccatgatggcaaaaccctgtctctattaaaaatacaaaaattagccaggcatggtggcacacacctgtaatcccagctactcaggaggctgaggcaggagaatcgcttgaacccggggggcagaggttgcagtgagccaagcttgccccactgcactccagcctgggcgacagagtgagactcagtctcaaaataaataaataaataaataaaaattgaaaaataaaataaaatgcagtgtcccccaaattatcaacaccccctacaggttggcctctggttgtggggagaggcagacagagtggcaacagacatgaccattcatattttaataagtactacgtgttgggtatctattattatgccggggaatctccatccatgacatcattttgccttccttgagacccttaagatgggacgcagagggacacaaagaggcggggcaagagctcaagtataatagcaggggtggaaagtggagagagaaaaggacagagatgggatttgagggaaaggggataaggaggaaaggaggtctccaaagttgggagaaaggaggaaaccctaggatgtgtgtcgcccctccaggaccagcctaaagcacagaggcgtcaggagggttttggaaagagaaaggctccaggttggtgtgtgaaccgcctcccccctggcagttcctccccacaccaggccgcctacctcagtggcaaagaaacctttgggtcggtgtttgcccagggacgcgaggccaccgggaccagggctttcgcttgcactgatggtctgttgagctgcggccaggatttcgtccagtttgtctaggggtagatgaatgaacagaggtgggaagacaatgaaatgaagtttgctttgacccgggccgcaaagaccagagctgccgcccgcagttcatccagcacctggatcaaccaggaaagggcagccctgcctgggtccgggtggacgggcagtcccgcttggagacacaatctcccagcccagtgggcagcacccagggtgggaaggggtgcgggcagggaacggggcagccgtcgggagagggcgggcggagggaggggaggtgggatcgcagcctctctggggcaggaaggtgaggggcgccgtggggttcatggtgggacagggatgcagcgggtgccggggctggggcccggcatcccgaggagcagggctgggccgtcttactgagagccatctgatacacggtccgctttttctccatgctgggcaccggcgccggctgctgctcgtactctgtgggcaaagaacacggatgacgcccagggagcccccgggggcggggcggagcgggctcggcctgtgggcgtggccagcaggtgcgggccagtgggcgtggcgggcgcgagaggggcagtgaggggccggggtcagggaggggcgagtccgccggcggggtcgggagacgggggccctcccgccagtcctgtgcccactcaccactcttcttcttccagggggagactagcccgggggagaggcagtagaggagccaagagttaggacgtcaggggaaggtgaggggccccctgtctggaagcccgcctccctcggggccccggggtgggggcggtcagctgtccgaccagccccctgtcaggggaaatgggacccccaggtccactcggccttgtctggagggaggggctcgctttcctctgttattgggggttggggggagctggtggagggagagatgttgaatggggctggggggtgaggtgggacaaaaggaaggagacagagagacccgcagagagggtacatacagaccctgagagagaccccaacggagaaacagatacaagagcacagaggaaagtcgtctctcagacaccccttcccagagacacacacacacaggccagagtccgacccatggactggggacaggatgaggacaaggacccctggtcactaacaacactaacgaactcaagggatggtccagccctccttcccctctccccccggccccctggcctcagcagccccgcaggctcacccatctcctccagctctgaggtcatagatttggaacgcagggagatggttgggggcggcagccgcttggcctgctggggtgctgaaaaggtgatgaggggaggcatcagtatcatgggggagatgcccccaccaccctctaccaccacagggctcccagggctcagagaatagccattgccagcgtgcggagccctccctgcctcagtttctccccacaagggtcacggagaagcagtgctagggaagggaaggccttgggcagcagcaaccagccctggggctcccgcagggctgagcctggtggcagtggggtggctgcgagagtggccgcaggagcacctttcttgtgcactgcctcatccatgtccgggtgcctggtgaccatcaccaccttcaccatcagcgtgttgcccccttggcggatcatgttcaccacctgtcggtggccgaccttcaccacattctgcccgttcacctgtggcacagacacccccagatcacacagagtagacgaggggaggggtgcttgcagcttcagagaccccaaggaggatgcctcctgcgctgccctgtccatggccctctgggctatgttcctctccctccgacccttcataccaccgcctccctgggcaagccccctttcccaccctccctggccccagggttgggggagaggctcagcctaccctattcacttccccctccctccttgtccccagtatttatttatttatttacttttatttttaaaagacagggtctctctctgtcacccaggttggggtgcagtggcccaatcatggctcactgcaccctcgacttcctgggctcaagcaattctcccacctcagcctccagaatagctgggacctcaggcacacagcaccggctaattttttttttaagagacaggatcttgctatgttgcccaggctggtctcaaactcttgagttcaagcaatccacctgcttcagcctcccaaagcactgggatcacaggcgtgagccgctgtgcctggccatcccccggtattgtgtatgtgttggggacagctctgtgtcactcttttgagatgcctcagaggcctttagatggaatcgctggggaaagcagaggctggctggggggtgggcagggggctgggaatcctggtgccaaaggagaataaaactgggcagccagatcctggtgtgaatcatgagggggtctgggaacttgtcacagggtcccagggaagagagggggcctggactgacctcgatgaggaagtctcccattcgcagtccagctcgccatgccacgccaccctcgtccaccgactccaggtactgcagcgccgggaaggccggggtgggggtgaactcctcgatgggggtctgcgctgcagacagggaggagccggcggggtcggaggggagggggtggagaggccgagcaggggatggggctcagacccaagtcacggaggcctcaccgcagctgagggaccagcaccccggggtggggtggtgggcgggctggggtcccttcccctttccagcccccattttcagccctgcttctggggtcacagagcccttctcccatcccctccccggctggcactcacccttggccccccggagcacgaacccaaacccctcactgtccttcttctgcagcaagactgtcttctccttaatgatgtaatcgctggcagggaggcaggagaaatgggggggtggtggggggagtggagaagacatcatgagacacagaggctgtcccccacccggcaacccagacccaaacctctgctccagggccattaattgcatctcctaggatctctgtcacccactctgtgtgtgtatgctagccctgatgggcttccccctcagagccggcatgctctctctctcactccctctctcctcattcatccatccatgcatccatccacccatccattcagcaccaggcacggtggggaggatggggagaagagcttccagattaccagacagccaggcttgggtccctgctagtcacttcctgcctatgaccttgagcccacaactttaaccttttgtgcctcagttccctcatctataatggggggctatcacagatcctacctgatggggttgcagtgggaatccagtgggggtaatacacatttagtatttcgcacagtgcctggcacatagtaggtgctcaatatgatctgctcgatgtccttaggtcagagtgttaagtcaagaggactcatgtactttgatgatacccctcaaaattcctttatacatatgtcacctcccaggaaccccacacagggtaaaattgctaattctgcactgcccaatatggtggccactaggtgcacgtggctgtttttatgaaagctaatcaaaatcaaatggaaaaattcaattcctcagtcacagtggccatatttccaagtgtgcagaagctgcacatggctggtggccaccacattggacagtacagatatagaacatttccattgctgcaaagctccccgtggacagcactgtcttctgtattccctggtgcatctcaaatggagctactgcatgcagtcagcatattctattatagtaaaatgcaaagcacccatgaatatgggtggtagtttccagtaaagccatcaaatgccaccagcacatttaggtaaggctcacgtacccaggaaatgtcaatgaaactcagatacagttcatggatctcaaggctcactcaaacagccccaaactcctgacatgaccactgtacacctcaggaatatacatccattccattcccagaggatccgacaccccagtctacatcaggaatactcagacaccctggctgcaaccccactgccttcagaatacccaagaacacccaggagtcactggaacgcgtgctctgctgtgctgagcttccttcagcactgtctaaagcctgtcccagggcacacttgtagcacctcccaccctcacaatcccagtgtattccaataatacccagatcccagtaacatccatgtggccctaatacactccaatcatagccaagcatgctccccaattacctgcccccacaaattcagcaaaacagccgtcctcgaatactccagtatgtttcggcaacccccacacatcccagtatgttccaataataactccccctcactcggatctcagtgtattcccataacacgccctctgaacacatacatcccagcaaatgccaataatacttactgtgctccactgtatttaggtaccacccccacaagcacccctgtatgctcccaggacccccatggctccccttgtaaaaatccatacatttgcaccatggcgacagggttctggatgtgcacgtgtcctcccttcctgctgccaccctccttgtggcacctcagtgcacctaacaccacgcatgttcacatgtacatactccagcaacagtcctcgctcaaagttcgtaacagtccagtaaactcatccacaccatacccgccatgtcttcctcccctggatagagaggtgttggcagagaaggagggaaggggctgaaaggggtgaatgagggtaggaaaagggagaggggaagggaggaaaggggccgagaaggccagaacagcaagtggacggggaaactggacacagaaattggctcagaggtcagagctgcctgtttctaaccatgcattctgtaatgtccccattcccaccttcttactcctcctcctgtatctcttccaggtctccaaggccccccagcagccagcagcacccttcctcactggaggcaacctcactttctttcactcatgccacaaacccctcccttcctccatctttctccctcccctctggaatctctcttgccccctcatcagcctcataccccatacataagccttccccaaatgtcagccaatatagtcaataaaactcccatatcaatatgccaagaaggagcacttgccattggctgggcagtatctgaagcccttcacagatagatcattaaattgtcttctcataaccagcctctggggcagggataagtaccagttctactttatctatgtatttattcatattttttgagacagaatctcactctcttgcccaggctggagtgcagtggcacaattatagctcactgcagcctcaaactcctgagctcaaaggatcttccaacttcagcttcccaagtacctaggactacaggtgcttgccaccatggccaactaattaaaaaaatctttttttttggtagagatgggggtctcactatctttcccacgctggtcttgaactcctagacttaagcaggcctcccacctcagcctcccaaagtgttgggattacaggcatgagttgccacacccagccctagtttcactttataggtgaggaaacagaggcacagaaaggttaagtaacttgtccaaggtcacacagtgagtatcattcttcaacaatacccaagagaatactcgggtaactgcagtggtaataccctccactccacagcaccgaaataccttgagcacatatatccatctgctcggaatccaccctgagctcggccctgcagcacctggagtttatcccagggtgtggcagtaacaccatgacaatgaggaacacttatcgaattattactgaatgccagccatgattccaagcactttgcatttatatatttccatttatgtattcagttagtcctcacaacaacccagggaagggttgactgttattcttcccattttataaatggggaaaccgaggcacagagaaataacttgctcaagatgacaccagctagaaaaatgtcaaagccaagatttgaattcaccagatatatatatatatatacacacacacaccagtggtgatctgaggcagggaggggggtccaaccacatccagacccaccctgttcctgcttctgcttctcaaccaccccctatcctacacatgctccattcccctctctgctccatgactccctcacccaatccccagctaggacatacgtggtgttgccctcatcccaccacagtctccttgaacttcccaactgctctcttgctcccacagctccatgtacctctaaactccctctccccaactcctgtgtacccctcctctctgcacctcactccctactcctccatgccatgttgaggttccacatcgccctaacccacccccctcatccctgactcccacaagccctcctcacaccctatggagccatccccccatttcccgtgtcccctgacacaccctacccccctttccccctaaacatcctcctcagacctctgtgacctcctcacccttgtcctgcgacctctccctcatcctttggcctcacccttcccacaccctcctgcacctccgtaagtaatctcactggctcccctaaagtacctctggtccctttcatacttcctgggtaccctcttttgcatccgtggaaacctccacctatttctgccccctcgactcacttcaccacatgccctcccgcctgcatttactggcagctgcgtttcatttacattccctgtgtcctcttggtattctccccctactgcccaaatccccacccccaaatacccccccacattccctgaattccctccccaccccatttctctgctccgaaccctcggtgctccagccgccacccctcccccacttcagtgtccccactctcccctgttccattctcaaccctgcacctcctacccagacccctctagtccctcccccttgccccccatcttggctgcccctgcagcaccccattcaggctccctctggctgactacctgccctgcaggagcccacacaatgcttttccccaggccatccctaagcgaccctgagcggcctccagagctcagcagccagctcttgttcactggatcccacacacaggggcactgcagcggcctgcactcccctccccaccccaacgtccctctcacacacccagggtccgccagcccagagcctgctgctgtgcacgggcgcacccccaaccccgcactcagccccttcccacgtacccgtgtccatggcctgcccagaggccaccacagagggacgccagcccccctccccatgctgagaagtggcacacacaagcggatgcggctccccatgcagctcagccggggctcagcacacgtgccccacatgggcagagggcagagccagtgactcaagtactcctgacatgcacagacccccgggggcaagggggcaggggagaggagcacatggggacagagacacaggatggacccttgaagtaggggcctgtgggggaggggtaggccaggcccaggagggtgggtgttgggaagcacagccgcagtccctgggacagacccactccagcacacaccacacacacacacacacacacacacacacacacacacacacacagtcccagacagcctcgctgtcgctccaagtcatacagagacagacgctgtcacacagggacacacagatggacacagttggggggtgggctgggagcccaccatctctccatttctctctctcacacacacacgcacacacacgcacgcggctgcaggcagtcacacacacgcacatcgacacagccacactgacacacgcaccgtcgcacagtgacacgcagcggaaaaagaggaggggaggggaagccgggggcgggatgcgtgtgtgatggaggggggatgactgtgaatgggagagaggggtatgaatggggggacttgccaacaccgtgaagaggtgtggggatgtggggatcagagggacaggggcctgggatgtaggcggatgcgggtaagccacggtggctccccacagggagggctccggggaatgggggcgctaagggcggcagaaaggcgagtgggctccaaatcctggaggggggtcggtttagggggcctgctgggaggaaggtcttgggggaagagcagaggggggcctggaagggcctgtgagggggtggaggaaaagattcccagggctgacgagtgcgtattaggggggagggtcggggagaggattccagggaggaagatggagaggagaagggttgagaccaggggcccgaaagggatttcgggctgagagaaggttagggaagaggagcggaggggaaggggcgggttgggggaaggggaaaggccctggggctggggtttagcggcgggggagggtcgccaccgcgggccggggcctgccggccggcccgcaaagcaggaggcggcgcgctccgttacctgtagatgtaccagacgctgcgccgccggggccccagggctggccagctggaggacagcgcggggggcggctgcggcagggagctcccaccggggccgcccccgagacccccgccgccgaccgcagacaaagccatcgccgccgcggccccagccccggcccgggtcccggtgccggccgcccccgccgccgccgccgccgccgcgtccccgtacccgctcggccgaacccccgtgtccgggcccccaggccccgcctcatgctgacccgcgccgggaggggggagggggagggggcgcgcaccccctcccgcgggagggagggcagggccgggggctcacatgccggggggcgcgggggcgcggggcgcggggtcgggccgcggcggtagcgcgaggaccgcggacggcgccggcttcagcaccgcggacagctccggaggcgggcggcgggcgcgaggcttaaccccttggcgtcctgcgccgggcggcggagggggccgggcaggggggagggggccgggaggggaacgcgggggcccccttggcgggagaagggggaggggcgaggcttggaggggggaggagaaggggaggcacttccggtctgggcccccccttaatccccctcccccctccagagccctcccgcgcaggtgcagagctagagagcgcggggagagggaggcacaacatcacacaagatgcctcgcagccgcgtgcacggacgcgcggacggagccccgcttccccggcagggacaccgcgggtgagagaggccccaggcggggacacgcagcccaccaccacagaccaacacgcaacgcacctcgacacagtcggcaagaaaggccaggacattcagactgggccccaaggccatgagcaacacccctcccccaccagagaagcccaggcggaggggcgaacacaccaccacagctccccgagagagcgtggaccccgagccagcgcggggagggggcggcacacgccaggaggggagacacacggaaggaccgcccagctccggcagggaggctggggttgggccctggctgccgggcgcacggcacagcacaggccaggccagcgcagacagggtccgggaagagcggggaggcaggaggaggggaagctgagacgcaccacacacacagcagcacgtgggagccagcgagaggcacggaggagtaggggaggaagcccattgacaagacagagtagaaggaggaagctgagggtgacggggaccacccgcattcagctggtaggacaagtgacccccacagacggaggccaaggagagacccagagagacactggtagacaagaagcagaggccgacatagaagctcggggtgtgggggggtgtaccccaatactcacccggtgcccagagcaggagacgcgccaggcaaacacgcacaacggtcaagcgcctcagacactcggggcgcagggtggcaccccagccccaccctctctccccatgttgccatttctctgtcccccccatccccgacccatccccactggccagaacacagacacgtaggtttggacacatttaatggaaggatgctacgcacaaggggactcttccctggattggggggagcagtggaggagagtgtcatattttagacaccaaattatgaccctccctcccccacagccctgtccttctggaggcccaagccctggaatcctcccctcctctgcccttccctcccccaacatcccaggtcctgaatctcagatcaatcagacagacgcacatgcatgcacacacgttaatgtgcgagtacacacgcacagtgacatgcacagagagggacggatgtgtgcagagacccacctgtccatgtgtgtgagcagactcactgacatgccctgtggtgcttgcccacggattcagagaagcacagatgtgcagagccagccccacagtcatcatagccacaaaggcaccagtatatacagagcagggcagaccctccagccccgggcataggtacaggtacatccaggccacacatgcacacagatgcgtgtcatgcacacctacagagacacacgttcacacaccaagaaacctcagctctggtcgtgcacacacgttcacacgccccccaggcaccccgtccttcccctcctgaccccatcccctccctgcccctcgcctctcacctccctgggccaatcccatccattaagcttccgaagcaagtcagccagcagccagggaggggaaaggtgtcagtgcacccatctcctcaccccaatcccacccagccctgactgcaccctccccacaccggtgcatgggacacacacattcccactgcacatgactgcacagagatggggcacatgaaggagacaagggcctccagccagccagacataagagcgccccggcccccccaggcatccccaccctgccctgaccaccccgttgtctctggctaccccagagctgggcagtcttagtggctgccgaagatggtttggggttgggctgtactgtctgaagctaattctggcttatcccacccctggatcaaacttgagaaggaacagattagaaagggggcttagaggtgatggaaatatttaaaggtgtacattgtgaagggaacttggggtgaggggggttgcccgagggtgtaaggacatttaccttggggcatcaaagctgtcgtaggagcccacggtataatgccggaagagtctctttgccttgtcactgcggctttctgcagggtgacaacagacaaccttggactcttgttttggaaaccacaatcccagccctagagctcctggcccaagtcttcccatctacctcccagtaccccacccccattaggaagggaaaggagtggacgtgggaatcctagggtccattgaacactgctgggggttccgcattaccttgcttgctctcctgagagcgattcgccacttcttccaggcagtcagaggggaaccagccaacacgacctttgacctggccttcccagaagcctccttccccgatgctaagtactggatggggaacggggacatagagacatttctgtgtttctgtgctgcccctcaactgccaacacactcaacttagagcattcccacagttaccagctcctggcccaaggccatccttaataaacatctgaggaaggggcgaggagcttgggggagacccatatcatatcactcttgcattctagtttctggatccaataaggatgacaggcattggggaagacgactgttccataacatggtcttcctaggttagaggcaggtccacaattggtccttgtctcccctggtaactggtcacagctcagttgtgtaattccccttcaccctcctaggctctgtggacttagatcacggatggggcgacaagttctacctcaccctcccatcactgtccctgccacctcccaaagtctccttgccacttaatctttagtcctttgtccccagacccctgtctctgtctctctcggcctctcctggctctagaagggaaaagagattagcatcacctctttccttctctccctctcccctaatggaagcggcttccccctgcccaccctcccaggccccaccgcttccccatttagcaaacatcacagactgcctgttacatgcctgctgctgaaaaacagagatatatgacaagaacagctaatgcgtatccaactctcacctgggccagaaccctaagaggggccactttcattatcccccttttactgataggaacactgaggcttggagagccaagatcatttgctgaaggttacaaggctagtaactgacagatctggatttgaacacagctcagtctgcttccagagggcatactttcagtcactcatgtgcgctacctctccatgcaacggcttcagtgcatgacaagggcaccagtggcaaacacatggtcttccatttctccggcatttttcatgactctgcccccattcagcccttcacatagtttccttcctcgttcaacccttgtgcctacccaggtaggtaacaactgtttttccattttatagacaaagaagctgaagcgaatgtggagaaaacccttgcctggagatggctccagctatgctaggggttgagttggggccatcagatgtattcccctccacaaactgcctcccttgagagcatctggggagaccaaatgaggggaagctgaaagtcatggaagagagcaggagatgggttgtcaaggggactgggttcttggctggtactgccatgcctggcttggtggtcttgtaatcaatcatttgttcactgtaaaaatatttagttagtgccagtcatgagtcaggtaccagggtagacactgttgaatataatcaatgttgttccttcctttgaggagcttccagagcagtggccaatagaggcataactatacaagtgactgtatgattggaagttggggtcagagctcaagggaaaataagagggtgtttggagagaagccagatgggagtatataacttataatggcaaaggggtccagggaggtgtccctgaggtgtgacacataggttgagacctgaaggatcctaggagctggggaggcaaagagagcatggaagagttccaggcagaaggaccagcatgtttgaagagtttggtgtacaagaaagcttgggacattggaggaatggaggggttggtatatcggaggactggagaattggagggctcagggcattgggggattggaaggcttggggcattggaggaatggaggggttggtagcactggggaactggaaggcttgggcactgggaggattggatggcttgggccattgggggaatggagggcttggggctttgggagattggagggattggggcattagaggattagagggtttggggcattggaggattggagggctcggggcattggaggattggagggctcggggcattggaggattggagggctcggggcattggaggattggagggctcggggcattggaggattggagggctcggggcattggaggattggagggatcggggcattggagggttggaaggctcggggcattggaggattggagggctcggggcattggagggttggaaggctcagggcattggaggattggagggatcggggcattgggggattggagggctcggggcattggagggttggaaggctcgggttggaaggctcgggcactggaagattggagggcttggggcattgggagattggaggactcggggcattggaggattagagggtttggggcattggagaattggagggctcggggcattgggagagtggaggactcggggcattggaggattggagggctcggggcattggaggattgaagggctcggggcattggaggattggagggctcggggcataggaggattggagagctcagggcattgggagattggaggacttggggcattggagaattggagggcttggggcattggaggactggagagtaggatgaggtccctggaaccttgtgggtgaaaggaagagtcgcatgagatgaggttgacaaggtgggcagagaggcagcttggaggccaggtgaagactctgggctgtgattctgagagtagcaggagtcagctccctcatcaggctgtgtgaagctcagtgacatcgtggatgtgggtgtgctttgaggcaattaagtccctcttaatggaagacgaggatataaaaacagaaggcagtgtgttctctccctgcgtagaagcattgagcttgtagctcagcaagatactgcccatggtcctctgcctgcccggaaggtcctttacctctggcctcagctcacctttcttttctcccatctcccccaaccccacgtgcctacatcccaggcagctggccctgaaggagctgcacctggcccccacagtagctcctgaatttgatcattcattcactcaacatatgtgcattaaagcctcctgtgtgctgggtcattaaactgagccctagagacccagagaccagtgacttatgacctcacctacaggaactcaggctatgggaagagagactaggaaacacatgcagttacacagcccacctgatgttctgacccccgaatacccttcaaggcctcactcaagttgaccttctatggtaggatcctccctgcttattcaggggcccaggtctctctcctctaagtgcctgaagtaggggccacttaggaaaatgatggctttttttttttttttttttgagatggagtttcactcttgtcagccaggtgtgatcttggctcactgcaacctccgcctcccgggttcaagcaattttcctgcctcggcctctcaagtagctgggattacaagtgcgtgccaccacacctggctaattttttttttttttttgtatttttagtagagatggggattcaccatgttggccaggctggtctcaaactcctgatctcaggtgatccaccctcctcggcctccgaaagtgctgggattacaggtgtgagccaccttgtccggccaaatgatggctcttatatggcacttgttatgtaggaaacattggtctaagtactttacatgatctgactcctccaatcctcatcaaagtcccattttacagatgaagaaactgaggcccagagaaatcacttggctgaggtcaccctgctaggaagtggtggggtctggatttgaacccaggctgccaggctctcaacctctataccgctcagctcctgggcagcctagagtctggcaaagaattgttccaatgcctcgtattaacggccacacctgcggcacgtggtggtctctaaagcatccttctatccaagaacacgtcagcagccctgcaaagcctataagcaggggagactggctccactttccagatgaaggtggaaaaaccaaagggaggtgaaccctgataacagcaccaccattttgggaaccctcgccacggccaaacatcttatatctgccagctcgtcggggccctagaagtaggtccctgcctgtctctcagttgaggacccctggacagatgcaggaggcaaagttaaggctgctcggcctcacgctctgcaccaggtggcaggaaggactgtgggcttggactgaggaccttgggcaagtggcttcacctgtgtgaggttctgttccttcaaccatgcaatggggcccatgacctccctccccagaaagggccatcaggagtctaatgagacgatttggtgagaagttccagccatgccctgcacacggcatcagtgtcccgcagtgggacacggctcacttcactgcctcctgacagggtcatctgagctacactctatggtcctccaagcctcaaggggtgtcctggggctctctgaggtctccagagtgcatgagatactccaggtgcccgagaatggtctgctctctgctccacattttccctgatcgcccccacagcccagcccagcccaggccctgcttccaccctgggtacctttgatcttctcgcccttgctcagggagatctccccctcggcttgggcctggtaggacttcacagccatgaaggagcgtccgggtaccgctgagtagagcttcctccgcctcccgcggctgcccagggagcccccggggccccctgagccccccgtgcccccggctggcccttcccggggtgtcccgctggagctgcgtacacagagggcatgagaggaggggagggtggagggaggggacacctctgggaggacaggggtccttgggtgggggaagaggacggtgcatcaggggggagggggggtttcccagcactggcgtcctccaaggaagagggcatttgggggctccctctgcctgcccgcagctgccccaaccagccccctctcctgcctcctggcttccggctctgccccctcccacggtcctgcgcgcaccgcctgattcagcttcctgaggctgagctgggactgtgtcatccctccgctcacgagccttccgcgactcccagcttcctcctgggtcaggtccaactcctctgcccgccgttgccagcctctcccccacttcctcgggacacgcctggctggccttcgcctccttctcaccctcctctagccaggtgggcttcctgaccccggaatgtcccccgccccttcctcatcctccctccagagtgacctctctgtccccctcaagtccctgccaccccccccatcctcttcctgttcagcttccctccacctcaccctgtcattctgtctgtccccaggggctggggcccatgtttctttggggtaccctctgcctggggcccctgtcctggagcagacatccagctaacatgtggtgcaccgggggtggagtcgggacagtagctcccaaggccttgctttaccccaaggtgacactagggacttggatgagggcctacagaggaaggcagctgggctggcctcgggggaagccgccgatctggagaggggatttgacggggctggggactgtggagccagggctgcctcccctacctgggccggcctcggggctgcctcttggcgtcctcagggtgcctccctcgggatggagagcgggccctggcaccccgggggctgctggcacttcggagggtcccgctgctgagcttggtggtgggggccgagggctgcgactggccctgggaccctgaggtagggccaggggccccagaggacgcggcccccggggcggagaacaccatccagtcgggcagcgccatgctggtgtcactgttggcccgcagcagcgccgggggcaccgtcagccctgtgcctgggggcccccgtcgccgggccgcgtacttgggggactcctggaagggcactgagagggcacagtggcggcggggggcagatgttaggggagaaaaggcaagcagggggccatgcgggggcaagagatggtgggagagaggcatgagggagaaagacagagatgagaaagggaggggggcctggaattgctcccccaccaccatccagacatttttggtcctctagggttttctccatcctatcctggcccccaagtcaggtcccccaactcccccatcccaccatgaaacctcaaccgccccaggttctctgtgcagtccgagctccctgtcactcacccacatcctgttctcggtggtttcggatcagctcccccagctcaaaattcccagcaatcactgccacctggagggagggggtagaggcaggtcggccaggggggcccaggcagcagagagagggcagggaacgtggcgaggtccctggcccgacccaaaccttccactccgacaatgccgccctctgtcttcttccagctccccctccacggcctgtctccttgctttcctcattgtccccttccttatccactgggtgtcactgtcaccctttccttagccctggaaactccagcacatcccctgcagccccagacctggaagggggtctgtccgttgttgttcttcacatccttgtcggcacctcgatacaggaggatcctggcacaggtctcctgcgggtaatggccagtggcacaggacaaagagagagagaaaaaattaagatcaccatgagtggatgcaggttctgtgctaagagcctcaggaataaatactccaccctaaacccgcaccactgaggacagcagccacctgccaggtacggaccaggagcactttagtttaaacgtggccggcccaaacggagatgcaccatgcatgcgaactacacactggatttcaaggatatgccatatgaaaacaagaaagaatttaaatgtctatagccaggcgtggtggctcaagcctgtaatcctaagactgtgggaggccaaggcaggagttccagaccagcctgggtgacatagtgagacgccccccgtctctacaaaaaaataaacagaaattagccaggcaggtggtgggtgcctggagtcccgaatacttgggaggctgaggtgggaggatcgcttgagctcaggagttggaggctgcagtgagctgagatcaagcctgagtgacagagcagggacctgtctcccccccagaaaaaaaaaatgtcaggtgtggtgacacacacctgtaatcccagcactttggaaggctgaggtgagtggatcacttgaggccaggtatttgagcccagcctggccaacatggtgaaaccccgtctctatcagaaaatacaaaaattagccaggcgtggtggtgggcgtgtgtaatcccagctactcaggaggctgaggtgggagaatcacttgaacccaggaggtggaggttgcagtgagccgagatcctgccactgcactccagcctgggtgacagagtgagactctgtctcaaaaaaaaataataatttctgtattgattctatgttgaaatgataatgttttagatacactgttataagtaaaatatgttgttaaaataaatgtcacctaattattttccccttctctttaacatggccactaggatatttgagggcatttagggtatgtgctcatgctatgttccactggatgttggggccggataatcctttggtgattcattggtttgtggagggtgttctgagccctgtgggatgttgagtagcatccccggtctctaccactagatgccagtagcactcccctccccagtcatgacaaccaaaaatgtctctagacattgccaagtgtcccctgggagacagaagctcccaggttgagaaccacaggtctagaccttacggaggcttaccatgttacgtgccaggcgcttggcactttagaggcagaagctcattgaattgcccaacaattccaggacatggaaattgtctctattttacagaggaggaaactaaggctttcaaaagagcccaaggtgggccaggggtggtggctcactcctgtaatcccagcactttgggaagccgaggagggaggatcgcttgagcccaggagtttgagaccagcctgggcaacatggcgaaaccccgtctgtacagaaaattttaaaaaattagcctggcttggtggcacacgcctgtagtcccaactacttgtggggctgaggtgagaggatcacttgagcccaagaggtcgaggctgcaaagatccttgttcatgccactgcactccagtctgggtgacaaagtgagaccctgtctcaaaaaaaagggggggttgggggggctcaaggtcacacagctggtgattatcagccttggattcgaacccagatctctctgactccaaagtcttctatcttaatcacactttctgccaggcccagaaggaaggggacacacattgtggaggaaagggtgggggcaggactgggccagtggggacagggatgccttctacattcagatcaatttctcaccggtgtcaatcacatggcacccatcatcactttttgggctaagcacaaagtccatgccacggcctaggagggttagggttagctgagctaacctgagctgcctgccctgccactccccaccctgaccctcaccaacttcatcttctaccacctgcccttgctcccaggctgcagccacactggccacctccttcctctgacagcacactaatgccccaggacctttgcacggctgctccctctgcttggaatcctttcccgctagatctcagcatagcttgcttcctcacttcgttcaggcttttgcacaaatgccgcctcttcagagaggtcttctctggccatcctgtctaaaaaaaaaacccttgtcctcttccttgctttatttttatttatttatttatttttaaaatttttttgagatggagtttcgctcttgtcacccaggctggagtgcagtgacacgatctcggctcactgcaacctctgcctcccaggttcaagcgattctcctgcctcagcctcccaagtagctgagattacaggcacccaccaccatgtctggctaatttttgtatttttagtagagacagggtttccccatgttgtccaggctggtctcgaactcccaacctcaggtgatccgcctgccttggcttcccaaagtgctgggataacaggcatgagccaccgtgctcaaccctttgctttattttttagtaccacactgatgtatgtgccaggcactctaagccaatgttaactcattttcttcgtaaccccgtctcactgaaattccatttcctgttatttgtctcagtagtgtctcttctcctctacaccataagttgtacaggggcatgattttgcctgtggcacccaccacctggattaatgctggacccacagggactattcggtagaaggagtgtcctctcccttttatcttggcctggccaaacccaacttggcctccagctcaactctaccccagcgccctctgatgctaatttaaccaccatttcccaagcacctccttgatcttaccccttccacatgacaaatccaccaaggggtttgtatgggcctatgttacaggacaggttcagagagggcagatgctacgcccagggccacacaaccagttagtggagcagttaggattccaacaacctggccttcttcttcctttttttttttttttgagacagagtctcgctctgttgccaggctggagtgcagtggcgtgatctcggctcactgcagcctccaccttttgggctcaagcaatcctcctgtgcacctggccttctgatcctatggttcacctatctcctatgaatggacgactctgactgccaaagtcacacatcgggcagcagagttagcccagtgtgtgttctgggtgtgtttgggagtgtgtgtgtgcatgtgagtctgtgtatgcccgtgctgctggccaactagactgttaactcctgccatgtgtacttttgcgtgtttttcttttcttttcttttcttttcttttcttttcttttcttttcttttcttttcttttcttttcttttcttttcttttcttttcttttgagatggagtctcactctgttacccaggctggagtgcaatggcgcgatctcagctcactacaacctctgcttcctgagttcaggcaattctctgcctcagcctcccaagtagctgggattacaggtgcccgccaccatgcctggctaatttttgtctttttagtagagacagggtttcaccatcttggccagacttgtcttgaactcctgacctcgtgatccgcctgcttcagcctcccaaagtgctgggattacaggtgtgaggcaccgcgcctggctttttgcatgttttcacagccccaacacccacactgggggcacagggccagagcacagcccctaaggtcacctgctcctcatcctactcttacaaagctgagaaggtgtgcaagtcagagttgatggctccctcccctgggcaccaagagaaactcgcatttaacggcatcctagcacttatctcatgtcgtagccatgatttgcttacacgtctgcctcctcaccagactgtgaactcccaccccccccaaccccgccctcgccctccccaggccagatgctgtgtctgattcatctcacatccccaaggcctggtgctgtgcacatagtaggtgctcaaggaacgtgcatggaaaggatgaggatggaggatgtggggttgagtcagtcaaaattcatttgttcgagtcattcattcattggttgagtcattcagtctgttgaaacaagcaaacacctgttgaatgctctgagccaggcactgtgcacagtcttggtggaaatccaagagggctgaccccatcattcattcactcattttcattcattcattcactcactcaacaaagatggaactaggcctgctgtttgctggggtcctggaacagagcaagtaatcagactcaacccccacccttgaggtgctcacagcctagacacggatctgacattcaccaccaaatgctagacgggcatatcaggaggccaaggcggcagaggctgaggaaaaactgtcagactcagccctggctcttggaaagcttaaagcctgggaggaagacaaggggggaaatggaggaatcaagttcgtatgtgttatgcatcggtttgttaagcccatggcaaaggcaagcaaacctattaacccacttgatccttttgcatggtagatatttatttatttatttttttgagacggagtctcgctctatcacccaggctggagtgcagtggcatgatcttggctcactgcaaactccgcctcccgggttcacgccattctcctgtctcagcctcccgagtagctgggactacaggcgcccgccaccacgcctggctaacttttttttgcatttttagtagagacgggatttcagcgtgttagccaggatggtctcaatctcctgacctagtgatccgcccgcctcggcctcccaaagtgctggaattacaggcgtgagccactgcgcccggcctgcatggtagatattaattattgacccatttcacagctgagaaaggagatcaaggaggggaaaatgacttgtgcaactgtcccactaagaaaactctgcctgctgtctaattctaatttttttttttaaggcagggtctcactctgtcacccaggctggagtgcagtggcatgatcatagctcactgcagcctccacctcccaggctcaagcaatccttctgcctcagctgcccgagcagctgggacttcaggtgcatgccactgtgcccagctaatttttgtattttttcatagagaccaggttttcccacgttgcccaggctggtctcgaactcctgggctcaagccatcctcctgccttagcctcccaaagtgttgggattacaggcatgagccaccgtgcctggtctaattctctataccaaaatttctctgtttatctgaacggtacagtttctgtctctcgactggaccctgactgacactggtgatggtaacaatgacaattattattctgatggctgccttccagggatgagcacttagtatacacgatggctcaccctcgtcaataagagctggcgttattcccatttcaggaagaaggatggagcctcaaagagggggagggacttgtttgctccccacccccatctgcctgtggggccagggcttcttccccatcagctgcacgagggcctgggagtcagaggattggttgtgaggcctgtgtcgcagagcaggagacaggagcacgtggggagagaagtgccggcaccatgttggttcggtttgacaaacactgagtcttccctgggctccaggcatactgctggctgccacaaggcggcacgtggccacccgccaaatccccagcactgcaagttctgccgaggcagagggggctgagggctgttttggaagacttcctggaggaagggggctgacagaccagctctgtcatgctagcgcctgtctctctaagtacccccaccagctgcccttcaagggcaggaagcatcaagaaacaggtggggagattgaggctttccatggggctgacctgcccaggatcatctgcagctcaggtggctaaagtaccagaggtcatgacattgaaagacccggctcttgccaaccagctgccacgagcccccctgcctgctccgtacctctcctctcctaggaactccagaagtgggggtgttcttcccatctcccttcagcactcccttcctgctcagggacccaggttgtcaggacccccaaggtcctgaattgctaaaactcccatcccactgtcattcccttcaggggccacgggggctgcacgttggcctttcccctgtgccctgccgtgccgccacgtggcacctgcacacaccactggctgaatgcagacacaggggaactgaggacccacagccccctttcctctggctttctgcacaggctgtgcccccaccctggagcacccctttctcctcttttctactcctgctcatcttaacactgggggcacctcctccaggaagccaccttcacccccagccactccatcccaagcccagtcccagatgtgggctcccgcagggatctggattccctgtgactttgctctgagcactctggactgtagcagcaaactatgttgtctgccctctgctaggccatgagctcaacactttgtccccagcacccagctccaggcctgatacagaggagctcagtaaatatctgttggatggatggatggatggatggatggatggatggaggaatgaatggaggaatgactggatgaaagggtggaaatagtgaagaagtggagggtgcagagatgcagtcaagaggagtgtctgagcttggccctgggggaggcggctatcggggatgtgaggggcctggggtggccgctgctaggcagaccttgttgtagagggcgcagatgtgcagagccgtgttccccgaggcgttctgggctccaggctcagccccgtagaaaagcagatgctccaggtgctgagagtgaccccgctggcaggcctgggcaggacagggagcgaggggcatggatcagacccaggctgttctccctctgggccaagagtctgtctatgacctgtgcactggccttctcatcctatcgttcaccgcatccacctccccatcaccttttagccccgcttcctgctctgggacccaggctgtcagcctcaaaacccaaatgttcagtcattccaaggcccaggcgtctggtctgcctccttaagggggtcaagaggacagcccatccctctcaggggtcaaggcatcaggttccccagcctatgcccccttagggtctttctgccttcacccccaccatttcctctttggggaccatgttattctcacccccatgctctgtgaggaccctggcatctggttcccagccccagccccttggatgcctcagggactgggtcccccaccccagcccttcatggcctgaatcaggagcacctggtggatttcctgccagccgttctcatcagctatgcccagctgggccctgttgaacaggagcagctcgcagcatcgggggtcaccacccaccatggccgtgtggaacagaggggtcagcccccgacggtccttgtagttgggggaacccccaaggtccaggagcgcctaggaacggagagagaacccagtagaaaaacacagatgacagtcacacattaaccagctcattctgaagggccagggggactggaccgtcctgggtgacctacagtggccaatgacagtctcagttctgccgtgatgcccttgtgcaaccttgagcctggccctttccctccctgggccactctgattccgtgtgaacaatgtgggacttgggtagatgcctccagaggacacttgcactctgacatcccacccagccttccccctgggggcgatcttggatgagccattgaaagacattaggggccacagtacccacccattccacttcctacaggtgggttgttggggacaagtgagaggacagagtctggatgctggagggtctctgaccaagtgggaggtgttattaggtccaggatctcaaagaaggggcacagcaggaagccaggggacaggtaagcttgggtaagggcaaggatcgggccggcctcactggggctggaggccacttcctgcccccacttgaaggacagctctgggtgtggaaggctggcaataatgaacattaataggagaaagtcttggcagcaacctcgtgtgaggacagcctgtagcagtgccacccaacagaacgtttcccccatcatggggatggtctgcaactgcaccaccctatatggcaggcacgtgtgggcccctgagcacttgaacgtggctagtgagcctgaggaactgaaattttaattttacttcattctatttaatttaaatttaaacagccccaggtggccagtggctactggcttggatagcgcaggtctggaggctgggaggggcgtgtgtgagcaggatgtgggtttgggggtgagtgtgcatgggagatacatgaagaggatctgttaactccaggggtatactgcagatctttgtggctggcatctgactgcattaggggctcttcaggaaagcatctgagggagagaagggaggggccgtttagctggagcagctgtgcgtcggggtgcttctcaatggctgtctttgggggcagcccatcctgaccctcatgtgaagagcaatcaggtgtcctggcgggggcagggggagaagagtattttaaaattagactgtgcagctgccgctgtgtatgtattttgtgggtgtatgggtttgtctatttgggaaagtgcatttgaggctgtgtacgtggggaaggggctgtatttgcatgtgagagaggagggaggggagctggtgcagtgctggtttggaagggtagctggggggctgttttcagggtgtgtgtggaggggctctatctgggggcatagcagggagctcacttcgtattttaaggaatgagaagggtttacaccttggggagacagaggcagatttggtattaagctgggccacaggggatggagacgttctgggtgtttaggggaggaggccgtgcccgggtctgtgtgatgtcagctatagcccaggtgggtgcatctggggggcctgacaagggtgacaataggggctgtgtctcagtctatggaaaggggctttgaactggggacatgagagggcctatttttaactgaaaccaaagaactgaggtttgagaaagaacaaagggaaaaggagagagggccccatggcggggatggggggtccccgaagcctcaccgtgagtgccaggcagtgtcgggcgcatgcggccttatgcagtgcggtcatgccatcccgggcccggaagtcaatgtgggccccgcccaggcacagggttcgaatcacctctacagagccttcggtctgggccgccagtgtcaagggggtctctgaagggcgggaaaagctggtcacatgaagccccttctcctcccctccatcccttcccattttccaggctctgcagctctccaccccacagcctctggccccgtggcctcccccttggacagcaatgtgtttgggagacaccagtcaggaatggatgtgaatgcagatggcacccctgctccccagctctgtcctggccctgaggtcctcctgatgcgcacccctccctacctcccgaatccgagtcatggtaattggggtccagccccttgtccagcagccgcgccaccttgtcagatgtcccgagctgcacatactccaggaacttcttcaaccccgtctgagccatgggcaaagagagagaagacaggacagtcaggagcaaggcagagaagcagggtcctcaagcagcgacgtccagtgaaaatatacgtggagtcacatacgccattgaaaagcttctagcagcctcctttacagagaaaatacccagccctttgggaggccgaggcgggaggatcacttgggcccaggggttcgagaccagcctgagcaacaaagtgagacccttatctctacaaaaaatgcaaaaaactagccaggttgtggtggcacacgcctgtagtcccagctactcgggaggctgagctggaaggatcctttgaaccctgaaaggttgaggctgcagtgagccatgattgcaccactgcagcccgggtgacagagcaagaccccgtctcaaaaaaaaaaaaaaaaaaaatcagggtggttgggggtgaagtgttagttgtgttgaaattcgtgttaatgatatatgttatttaactgatatagctacaatgttactgtttcaacaggtaattgagatgaaaattattaatgaggttatttaacttttttttggtactaagtctttgaaacccagtgtgtatttcacactcacagcgagtcttagttgggaccaaacacactgcaagcactcaggagccacacttggccagtggttcccaaagtggaccgtgaaagtctggagggatggaacatttaggggaggaaagagttcaatgcatgctgtggtggggagagggtagacaaggagggactgggagtttttccttctcaaggatcaagagttcttcatttctgaccaaagcagttcccgatttcctcccagctctcaccatcgagacacaggacagacaggggctgaggactggcgggcaaggtaccaggaggacagatatggctggaaaggggggtgtaatggttggattttgcagagattcaggctatgaggttgggagaaatgtagcctgtctttgaaatagactctaggcagaaggaccttcagtgtcagggtcctaggccaaggtggggaagtaaagaggccttggatggatatggggggaggcaggggaagagaagggagactcaaaggaggccaggtgggaatgatgtgggcccaggcagagggatgaagggcaaaagaggaaagtaagaaggggttgtgatggggataatggggggtatttgtggttgtctcaaatgtggtacagcatcccaagttaagcgggggcagtggccagagggatcgctggcttggggaatgtggaggtctattgggaagaggtggggagagaaagtggttgggtagggggctccagtggtagggggctataggggatagatgccagcagggttttctcaccttcgtgtgcaacttggccagctgcttctcatccaggttggtctgtttgtaaactcgggtcttgtatcggaactgaggtcaagggtagggtagtgagagagacacagagacttggaatcaggggcctggggagaaggcttggggtaggggaaggtctgatccccttctaattccccggggtagctcagggtgggagtgaaaacagccctggaaccttggtctaggcggtagatgggtggcagtggcttttccgacagtgctgggtattatggtatatgtgcactgcaacccctgccttgaaggaggaggagtctggaccccacagggaatgttctagagtgcctactgtaattgggaatcctcccccaatttgatgggtgaggagaagcttggggcaggaaagtgacttggccaaggccacttagctggtcagaagcagaacagatggtaatttgaactcaggactctctgacttccctgtgatgcttagaaggtctggactcgcacactgggtgccccctcgttaaggtttcgagtgtgttaaaaagtgggtggggggcagatgtgttttagggcatgccttctcttatcagtgaaggagttggggaagcttcacctccaggtaggggacccccttctcaaaggactgggggtactcccgcagcagcctctcctcctccaggaagttggcatcgcggccggaggtggccggttggaacaggccatagttgagcacatcctgcaggctctcgctcagggcacagagcacctgctgcttggccgtccagatggtggcatcggggttgaagcgaaggcatttctggttggggaagagataggggctagggtgggccaggggccagaggagagcctgaggtgggttgggaagtgagccaggagctgagtgtgggggtgattcctgggaggatacccagcaccagtggactccccatgtcggttggggcactgtccctctcctgccgctggccagtgggcaggtactcactgtctggtgcaggtccgggatgccaatcctgaagaccatcatgctgaagtgggcgtcgtctgggacggacattgagcggccctggaggcctctaacagaggccaggctaccaggtgccccactgccctggccccgggtcccccgggggcctcgacctggcccgtctggggagctgtcggactctgagcccccctcgggacactcgctggcactgtggcgttcctcgtcctcgcttgtcgcggggctgtgggtcattgtggggccacggggcgac

SEQ ID NO: 2710 - DNA, 2378 bp, Homo sapiens
agaccaacggaccggacagagacgaggagaggaacaggaagagagaagctgggagaatcgggaacctgggggctagtgacctgcacacagggcaggggcactcggcagttcccagaggccacccctcccaccccagacatccagacatctggaactttgggtgccaagagtccagcttaatgcaggcagcctggcttttgggggctttggtggtcccccagctcttgggctttggccatggggctcggggagcagagagggagtgggagggaggctggggaggtgcccaggaggaggagcgggagagggaggccctgatgctgaaggtgagctctggagtgtcagggagctatgggtggtgaactgtgggtctgggagggggtattgcaaggttagggaaatggacaatgaggagcgattgggatagtctcagaggagtgggagggtgatgggctcagagacaggactcaggcagcagagaatgagttatgagttggaaaggggtgaatggggcatcttggtggcaggctggggctcaccacccctcccctgccccagcatctgcaggaagccctaggactgcctgctgggaggggggatgagaatcctgccggaactgttgagggaaaagaggactgggagatggaggaggaccagggggaggaagaggaggaggaagcaacgccaaccccatcctccggccccagcccctctcccacccctgaggacatcgtcacttacatccgtgagtaaccagaagccctcacccccaaactcctaggccgccgcggtcactttcgcaaaaatgaagggtcggttcactgccaagtggcctttcagttgtccattgcccagcccagagcccccacacccctaggagccccaggtccacggccatgcctcctaaaggcctgggccactcgaccctaccttccaggagtccggggtgccccccccaccgccaccccgccctcaggagccctagatcccagttctccaggtcctcaggccccccgctgcatctccaggctccccctccagcatgatccctgtctgtccgcagtgggccgcctggccggcctggacgcaggcctgcaccagctgcacgtccgtctgcacgcgttggacacccgcgtggtcgagctgacccaggggctgcggcagctgcggaacgcggcaggcgacacccgcgatgccgtgcaagccctgcaggaggcgcagggtcgcgccgagcgcgagcacggccgcttggagggtgagtccgcggcgcgcggggtggaaaaaaatgagactatctgggccaggaatgggactggttgagaaggtgaccctaggtgtccggggcgggagagttcgggagagctgctgtgtgctagcggacggggttagagagctgggaggctgaatgcagggagcgggtgggcactccagacccgcgcggacccgactggggcagcaccacgccccctacagtccagctcccaccgcctggccccgcccctggcggaccagactctccacctcctggctcccgcggttctgaccacgcctcctcccagccctccccatgagttcctggccccgcctccctccacccccggatgttttgtcctcgcccccttccagactctgaatgcatgaccccgcctccttctctacccggccccgcccacaggctgcctgaaggggctgcgcctgggccacaagtgcttcctgctctcgcgcgacttcgaagctcaggcggcggcgcaggcgcggtgcacggcgcggggcgggagcctggcgcagccggcagaccgccagcagatggaggcgctcactcggtacctgcgcgcggcgctcgctccctacaactggcccgtgtggctgggcgtgcacgatcggcgcgccgagggcctctacctcttcgaaaacggccagcgcgtgtccttcttcgcctggcatcgctcaccccgccccgagctcggcgcccagcccagcgcctcgccgcatccgctcagcccggaccagcccaacggtggcacgctcgagaactgcgtggcgcaggcctctgacgacggctcctggtgggaccacgactgccagcggcgtctctactacgtctgcgagttccccttctagcggggccggtaccccgcctccctgcccatcccaccacccggcctttccctgcgccgtgcccaccctcctccggaatctcccttcccttcctggccacgaatggcagcgtcctccccgacccccagtctgggcgcttctgggagggctcttgcggtgccggcactcctccttgttagtgtctttccttgaaggggcgggcaccaggctaggtccggtgccaataaatccttgtggaatctgacttgaggggcagtgaa

SEQ ID NO: 2711 - DNA, 71 bp, Homo sapiens; identical to SEQ ID NO: 1097

SEQ ID NO: 2712 - DNA, 11852 bp, Homo sapiens; identical to SEQ ID NO: 1098

SEQ ID NO: 2713 - DNA, 80 bp, Homo sapiens; identical to SEQ ID NO: 1099

SEQ ID NO: 2714 - DNA, 87 bp, Homo sapiens; identical to SEQ ID NO: 1100

SEQ ID NO: 2715 - DNA, 16897 bp, Homo sapiens
cgacagagcaagactctgtctcaaaaaaaaaaaaaaaaagagcaaattttttttccaaggtgatagggagagtccgtggctgatgtctgcactgaccagacgcccctagggggccagcgagggcgggtcccaggtgcagcggatgcagaggagagaggcccgggcgcggcgcgggggatggtgcgatcccgggcccgagggcatcagacggcggctgattagctccggtttgcatcacccggaccgggggattagctccggtttgcatcacccggaccgggggattagctccggtttgcatcacccggaccgggggccgggcgcgcacgagactcgcagcggaagtggaggcggctccgcgcgcgtccgctgctaggacccgggcagggctggagctgggctgggatcccgagctcggcagcagcgcagcgggccggcccacctgctggtgccctggaggctctgagccccggcggcgcccgggcccacgcggaacgacggggcgaggtactcggcggggtgcggcctgcggactcgcccggaggccggggggcgggagggggcggccggggaagggggcgccggaagcctctgggcgtctgcgtgttgccgcgtgttacacgcacgcacgccccttacacaccttttcacagaccccgccgtcggggcgcggccaggtcagatcccttttgatccgggcctgggctgagtgctccccccgggcttcaggtgacgcggccccgcggagcgtggggtcgcccgagttgggctggggaagccagggacggaggtgtccggccgtcacccctagaggagggcgtgcgggggtctgttttgcgtgagtgcgggataggggagtcgtgtggtgcggtgaggggcttgtggggggcactggaggactctgggggtggcgggggatccgagggggtcctcgtgaacccgcaggggagagtcctgggtgagggtgggtcccgagcacctgtgtctcaggagatggtgagagctgtctggagggctgggcacttggtggcaggggttggcggtgcaggggacaccgccgggacagggctggggtgccctggagcgggggagccgagggagtgggagcgggggcgcagcgcgcgatctctggcccggcagggccgctggttctccccagtgcgcggctccgggtttgcaggtggacggtgcgcgcgtgtctgcggtgtgtgctgtgcctgcagaccggggagggcgggggacgacagccacctccttccctctgcctcacccccctcctgtcccagggccgcgcttcaatttccgctgaaacttctgactcggacacccgccgcctttcgcttgggctcccacgggaggggcctggctgcggggggcggggcggggtgggggtgcggccttgctcgggtagaccatgggtgtgacagctgggagggctgtgtgtgtgtgtgtgtgtgtgtgtgtgcgtgcgcgcgcgcgcttgcgcttgatgtaacccgccctcatttccctgggtcccgagtgtggcagggaacagcaagaggtagatattaggggctgctttcattccacatcacagattctattctgcagtgtggtctgcaaaatgccttgcccaagatgtatagactcagttaccgcatctgtccccatctgggtggagcttatcccaggccccaacaggctctgagggatggccggggccaaggcagcctggactactgatgtggcacaggccagagggactccaggcagtctcctgctgcacagggcacaaagcatgtgcacagccaggtatcatcctgcgtgactcagaacagccttgagatgtaaggagtgtcatcccagcctcgaacctggggagctttctaagactcccaaggatggtacttatgcatcttgctgtgaagaataacaggatgagtgctaataatgaccatttcctgacacctacctggcaacaggtccataagctctacatgcttcatttgtgttttcatttcatcatcacgaaaaacctgtaagctttgcatcctgttcccactttacaggaactgaggctcagaaagcttgaggaacttgaccaggggtaccccccagctagaaagggtttgagacaggattagaacccaggaatatctgactacagccactccttactgcattcttaccaagccaaagtcatgacctttcactcatgtggggaggccttcccttccaaggcagctcttccatttgggagcagcgtacttggagaggtgggcctctgtctggtaactgactcatgttgccttgttaatcctgccttgaactgttgggaaggtctttaaccaggctgaggtctctcgcaccaatgcccatacctgggcatgcacctccttggaatggagtttaagtgggtgggcagatgggttctagagagaacccgtctgccctgaccatgccctactgccctctccttcagccaccacacacacagtcacacagctgcgtgaatggtggctttcctttcacttaacagttcactctggagatccttccaattaccctataaagagcatcctcaaccttttaaatggctgcacattgttccgttgtgtggatgaagtataatttatgtaaccagccctgtaattatagacagccaattatttctgtcaaaagggctgcaggaataactgtgtatttgcatgcttacacacacacacctctacagaataaattcttagcaatgggattaattgctgaatcaaagctcacacgcttttcatcgttgtttttgttttgttttgttttgctttgttttgagacagtctcactttgttgcacaggctagagttcctgaccatggctcactgaagcctttaccttctgggctcaagtgattcccctacttcaacctcctgcatggctgggactacagctgtgtgccatcatgaccagataattttttttttcttagggacagggtctcgctacgttgcctaggctggtcttgaactcctgggctcaagtgatcttcctgcttcagcctcccaaagtactgggattacaggcatgaagcactgcacccagcctgtttttcattttgatattgtcaaaatgcactcctcagaggtggtaccttttatcctcccactagcactgtcttcattgttagtggctgcactgccactattccacagtataaacccacttttcatgacactgccaagacataagggtctgaaatacttaacagttttcttccacagtccccaaaatacaggcttctcccccagctcaggacatgaagccatcatccctcctcattgcaggagccaaaggctggacctcacctcgattccaccctctccttcacccctcacatccaatccatccagtccatccagtctgccactgagtcctcttgatcttcctcctatgagcccttaacttcgcgtctccatctagcaccccctagtccaggtcaccttctcctgcctggactcgtgcttgtgtgggcctcctagctagtctcactgccccgtcttgtactttcaaatccaccctaaaagcatgatgttcccctgctgaaatccttcagtggctccccactgcctttggataattccaaatcctattgtgtgttaattaggattaggctcagctgtaatatagaaacagccacttaatagctaaaatgaaatagacgtttttttcttctttttctctttttttgagacagagtcttgctctgtccccaggctggagtgcagtggcgagatctcagctcactacaacctctgcctcccaggctcaagtgattctcctgcctcagcctcccgagtagctgggactacaggcatgcaccaccatgcccacctaatttttgtatgtttagtagagatggggtttcaccatgttggccaagatggtctcgatctcctgaccttgtgatctgcctgcctcggcctcccaaagtgctgggattacaggcatgagccactgcgcccagccttcaatagatgtttatttctctcctgtgtaaaaaacctggaggtctggcctgacaactccatgtgtcagggacctaggctcctctcttgctctactgtatgtggtacttctgaagccaaggtagatgctggagctccagcagttaggtccacattccagcatacaggaaaggaggaaatgaggaagttgggccctccctttaagaacactgtcctgggcattgtacacaacacttccacttgtgtcctactagccatatgctgatacaaggatacaagggagacaggaaatgcagtttattctaggtgtccttgtgctcagctgaaaatctcaggttctaatcctatgtaaggaggggagacctgaaactggggaccactaaccacctctgccatatgatgctcgtagagcccttcacaatagggcctctactaacctcaccttatttttatttatttatttatttttgagacggagtttcactcttgtcgcccaggccggagtgcaatgacactatctcagctcaccgcaacctttgcctcctgggttcaagcaactctcctgcctcagactcctgagtagctgggattacaggcgtgtgccaccacgcccggctaatttttgtagttttagtagagacggggtttcaccatgttggtcaggctggtctcaaactcctgacctcaggtgacctgcctgcctcggcctcccaaagtgctgggattacaggtgtgagccaccacgcccggcctattttttttttttttttaacttttcacttttttttgcagtcacgctcattctccaccgtgttcttggggaacatgcagcatgttcttttgcctcttccctcaccccagaacaggggttactggacagcggcatcaacttcacctgggaactggatagaaatgcagattcagaccttctgaatgagctactttgggagtagggcccagcaatgtatgttgaaacaggcctccagatgatctcaatgcttgctcaagtttgagaaccactgaaccgcagtatgactctccgtgtcacctggctaactctgcctcactttcaggtctcagtgtagacaccacctcttctaggaagacctctcttgacccaccagcccaggagagaggcctctctgggttcctagaggcccatgcttctctgtatagtagggctgatcacactgtatgtgatttttttttttttttttgagagagtctttactctgtcaccaggctggagtgcagtggcacaaacatggctcactgaagcctcaacctcccaggctcaagcaatcttcccacctcagcctcccaagtagctgggactacaggcatccaccaccacacccagctaattaaaaaaaaatttttttttgtagagacagggtctcactatgttgcccaagctggtcttgaacttttgggttcaagcagtcttcccaccatggccttccaaagtgctaggattacaggtgtgggccactgcacctagccttggacgtgattttattactcatctgccctccaaattgactggaagatcctgacggcaagactgctgtctaacctacttctcttcctagcacccagtgttaagtgaatgaacaagatcatatctctcatctgtgaatgtacgagagccatggattatgagattagttgattttcttaactataatttttagaaacaagctgtgtttttaagcaggtatttatttccttaaatgtacatttctgattacaaaatacttttttttgagacagagtcttgctctgtcacccaggctggagtgtagtggcacaatctcggctcattacaacctctgcctcctgggttcaagcgattctcctgcctcagccttcccagtagctgggattacaggtatgcaccaccacgcccggctaattttttttttctcccgtgacggagtcttgttctgttggccaggctgaagtgcagtggtgtgatctcagctcactgcaacctccacctcccgggttcaagtgattctcctgtctcagcctcccaagtagctgggattacaggcccacgccaccacgcctggctaatttttctatttttagtagagatggggtttcaccatgttggccaggctggtctcaaactcctgacctcatgatccaccaccttggcctcccaaagtgctgccgtgggctgcactttggcattgccttggtcacgtgctgctacctgggattacaggcataagccactgcgcctggcctaatttttgtattttttagtagagacagggtttcaccatgttggccaggctggtcttgaactcccagcctcatgattcgcccaccttggcctcccaaagtgctgggattacaggcgtgagccaccacgcctggccaggaaatacatttacatggctcaaattcaaaactataaaagtcggccaaacatggtgactcacatctgtaatcctaacactttgggaggctgaggcaggaggattgcttgagctcaggtgagaccagcctaggcaatgtagggagacccccatctctacaaagaataaaaaaaaattagtcaggcatcatagtgcacacctgtagtcccagctacttgggaggctgaggtggaagaatcacctgaaccctgaggtcgaggctgcaagtgaactgtaatagtaagagtctcctcctaatcttgtgcatcctttcagagagagagatgatagatattcaaacaaatacatacatatatataacatatttatatatattctttttaacataaaagtatagccaggtgtggtggttcactactagagtcccagctacttaggaagctgaggtgggaggttcacttgaggccacgagtttgagaccagcgtgggcaacatctcttggggaaaaaaaaaaaaaaacccaccataaaagcattctataacacgtaattctgtgtttgtctttcttctcttaatacatcttggagatcagtacgcatcagtatatagagagcttccttgtcctttttcagggctgtgtagtattctgctgtatggctataccatgatgttttcactagctttctactgcctgacatttgggatatttcctgcttttgctattggacacaaggctctgatgaacagcctttactatatttaatttttttgtgagaagtttaactggaagataaattcccagaagtggggcacccagttaaggatatgtgactttgtcattttaacacacactgccagatcaccccctataaatgttgtgccacgtatcctcccaccagcaggggaaaggaggggccaccaagcagtctcactttagtgcttttctctcctttttaccagatgcgagccacccctctggctgctcctgcgggttccctgtccaggaagaagcggttggagttggatgacaacttagataccgagcgtcccgtccagaaacgagctcgaagtgggccccagcccagactgcccccctgcctgttgcccctgagcccacctactgctccagatcgtgcaactgctgtggccactgcctcccgtcttgggccctatgtcctcctggagcccgaggagggcgggcgggcctaccaggccctgcactgccctacaggcactgagtatacctgcaaggtacgtgcccatgggcggctgtcccccagcaccacaggaggcctgggaaggaggcctccaaaggattgccagggtgcagaggggtccttatgttcattcattcttgtgtttgtttagtggggaagcatccagggagcccctgctggactgatactagagaggtaaaccagaggtcgtcccagtcctgggggagttcacagcttaggccctacagtgtgataaatgctgcaggggtagaacttagggatcatgggcgcagaaaaggccgagcagaagttagccaggtagaagtgggagatgggagttgcaggcagggggaacagctgttcaaaggcctagaaaagtgaggggatagcactttagagaatgaaaaggacttctctgtggccagagtggagaggatgtgcagaaaggggcaggagatgaaggttggcagcagctggtcatgaaggtgttaacaaggggcctccactgggctgtgcggagctactgaagatgtttgcacaagagaagggtagggcatggtagacatcaaaactcctgggacctcggaggtgatcgagcctaacctggggccattttacagataggaagactgagatgaagacaggagaagggccatgcgtgaagtcacatagcactgggcctggctcctggggtaaactaaggggtagaaaagtctgaggattcctggcagaaaccaggaaatggacagggtcaaggcccctgagggtcagcccatgcaggacactgacaagtgacagtccaagaagacagagatgagaataaaaagtgtaacaataggtattcactgtgcaccaggtactatgatgattgcttagtgtgcacaatctcttttaatcttgacacaaccaatgaggtggtttctatcattgtgccccttttatagatagaggacactgagactcagaaagccatggttacttgccacatgacagagccaggtggtatcagagctgggattgggcccaggaggctgagcccagagagtcctgtgcccgtgctaggataagcgtttcacacaatcagggcaggctgccctggcaggcaagcataaggaagataagggggacctggaaacccaagggagagtagcgggggcctgggtcccttgggaatgcacagagaagcagaaggacttaagcctcctcctggggcagcagcagagctttgctctgttgacggagatgcagtgaacagcggggcagatccagacagggtccagcccctagcttcacctggcctcttgtgcacagatctccagcgcccttaccaggtgccctaaggagcccagaactctgggtccccttcctgcagcatcacaggctcttttccactcccgctggggaggtgagtccatgataagaggaataacccaagcaggctcaggagagaagcgccatgcgttcacagggccctgattctcaagaaacatttgggaaaatccactggaacatactcacccctatgccaatgtgcaccatgggtgctgaatggtcatttccacacttcctcagcttttctggtcagtgtgtagaaagatcaaaatcttgtctttgtaaatgatcaacttattcattaattcaacacaacttcattgagcacccgtatttgccatgtaccatgctgtggttaaaaaacaaagttctgttctcatcaagctgacgttctagtgggagatacagacactaaacaagcgaataagtaaaatacgtgtcaggtggccgggcgcggtggctcacacctgtaatcccagcactttgggaggccgaggtaggcagatcacctgaagtcaggagttcgagactatcctggccaacatggtgaaaccttgtttctattaaaaatacaaaaaattagccgggcatggtggcaggggcctgtaatcccagctactcgagaggctgaggcaggagaatctcttgaacctgggaggtggaggttgcagtgagccgagatcacaccactgcactccagcctgggcaacaagagcaaaactccgtctcaaaaaaacaaaaaacaaacaggaaaacccttattccagcatctttcttggttcctttgcaatgcttatcagcatttgtcaatatttggtttctgggcatgtttgcatggcctcccagtgggcaccggagagcagagcccatggctgtcagtctagctggacatgtggctggcccgtgcaggcccagggccagcatactgaatgaatgaaagcgtgggtgggcaaagaggacgggagctgtgacggtgatgagcatcaggtgccttctgcatcatccgcccttccggattcctcctgctttgtgggttatttttctgtttgggtgacctgttacttttcagttatccgatgtttgaggccatatagcgtagcagttaagagcacagacaaaaggccgggtgcagtggctcacacctgtaatcccagccctttggaaggctgaggcgggaggatcacctgaggtcaggagttcgagaccagcttagccaacatgatgaaaccccatctctactaaaaatacaaaaattagctaggtgcggtggcacatgcctgtaatcccagctacactgggggctgaagcgggagaatcacttgaatccaggaggcggagtttgcagtgagctgagattgcgccagtgtgctccagcctgggtgacagagcgagactccgtctcaaaaaaaaaaaaaaaaaaaaaaagcacagacagtggagtgcatacgtgcaaatctcagccgtgctgtttgctggctgtgtggcctctcagcttcgttaaccgtaaaatggagcaagtcatcctaccttataggaccatggtcagggctgagtgactcggtcagtgaagcgcttggtgcgatgcctagcacatggtagtgtctaataggtcagctgtgactgtttgcaatgccagcctcagctcccgggagtccccagctgtgctaacaccatgctctgcccacaggtgtaccccgtccaggaagccctggccgtgctggagccctatgcgcggctgcccccgcacaagcatgtggctcggcccactgaggtcctggctggtacccagctcctctacgcctttttcactcggacccatggggacatgcacagcctggtgcgaagccgccaccgtatccctgagcctgaggctgccgtgctcttccgccagatggccaccgccctggcgcactgtcaccagcacggtctggtcctgcgtgatctcaagctgtgtcgctttgtcttcgctgaccgtgagaggtgagtgtggtctcagagaccccagccacagacacacccagggggtgggccatgatggagagaaaccgaggcccaggaaggcaaggtaacttaggcaagaagtgggagaaactgaagtaaccagcagcccctgtttagttccctgagaagagttgactcaggccaggtgcagtggctcacgcctttaatcccagcactttgggaggccgaggtgggtgaatcacttgaagtcaggagttcgagaccagcctggccaacatggtgaaactccgtctctactaaaaatacaaaaattagcctagtgtggtggcgcacacctgtaatcccagctactctgaaggctgaggcaggagaactgcttgaacctgggaggcggaagttgcagtgagccaagatcacgccactgcactccagcctcggcaacagagtgagattccatctcaaaaaaaaaaaaaagagttgactcagtcctcttgggagccccttgggattctgggatggagcactgagatgtgaaagtcatagtagccgacagtgacgaaagcatcgccacattatctaacgtggtcttccatccttacaaacacgaggcaggtactgttattatccccatatgatcaaggaaactgaggcccagagagctcaagtaacttgcccaagatcccatagcagaataaatggtagagctgggatttgaacctagatctgactccagagcctgggtcttaattcaatctgagcttgagaggcaggggcctggctgggcttaccaactgactttgggtgacctagtgtctctgagcctcagtttctccgttggtaaggaaaagggctggattgttagggtgttttcaggattccaagaccacagccaaaatagggtctgaggttccccacacgggaacgttttctgtgaaactgagaattagcactttttggttaaaagaatcttccttctctaggttgggatgctaagaatttttttttttttaattgagacagagtctcactctgtcacccaggctggaatgcaatggcgcgatcttggctcactgcaacctctgctgcctgggttcaagtgatacgcctgcctcagcctcccgaatagctgggactacaggcatgcgccaccatgcctggctcattttttctatgtttagtagaaacggggttttgccatgttggccaggctggtcttgaactcttgaccttaggtgatccgcctgcctcggcctcccaaagtgctgggattacaggtgtgaggtactgcacccagcctagacgctaagaaaaatttttaaaagataattctggggagaagggcagagagactcgcctcctgttccctctccagattcctgggggcagtcaagatgtgtcagggagtgcactaagctgccagttacacaggagttttctgtggagaaaggagtgtgaccccatggcattttaaaaaactttttatcttgaaataattttagacttttagaaaacctacaaaaatagttcaaagagtttctgcatatcctttaaccagtgctctccaatgttaacacctgacgtagctatggtacaattacccaaactattaactaagccacagattgattcccacttcccgagtttcccactaacaccccttgctgtgcaggatccagtgaggatcccaatttagtcatcagtggtttccttggtctcttccaatctgagacagttcctcagtctttccctgtctttgaagacccatgaccttgacacttttttttttttgagacagggtctcactctgtcacccaggctggagtgcagtggtgtgatcacagctcactgcagcctcaacctcccgggctcaagtgatcctcccacctcagcctcctgagtagttggttctacaggtgtgtgccaccccacctggctaattgagatggggtcttgctatgttgcccaggctggtctcagactcctgagctcaagcaatctgcctgcctcagcctcccaaaatcctgggattataggcgtgagccactgctcctggccataaccttgagacttttgaagagtactgatcagttactttgtatgtccctcaatttggatttgattgatgttttctcacagttagattgcagttatgtatttttggcaagaacaacacagaatcgataggcccctctccacatcatatcaagagatacttgagctgatagtcattcctatgtcgtgaccttgatcacttggttagggcaggacctaccaggtttctctactgtaaggtcctaatttaccctttgtaattgacaaataccttgggggaggtaagctaggcatataaatatcctgtttttcctcaactttcacccactaattttagcagccatccatcttgcctatagcagttattattgtggtgcttgcctaagtctaattttctttttcttttttttctttctttcttttttttttttttttgagacagagtctcgctctgttgcccaggttggagtgcagtggcacgatctcggctcactgcaacctccacctcccgggttcaagtgattctcgtgcctcagcctcttgagcagctgggattacaggcacacaccaccacacttggctaatttttgtatttttagtagagatggggttttgccatgttggccaggctggtctcgaaatccgcctgccttggcctcccaaagtgctgggattataggcatgggccgctgcgcccagcccccaaggctgattttctgttaatatttccttctacattttatattagaacaagcatgccttttttaaagaagtaacatttataatgatgtttaagctagtacataacttcaaacacattttaggcttagggtagatacaactaccccggacctcctggaggagacagcgtgcttcctgctcttttcaagaagtcacttgatggcccacacctgttatcccagtgcttcgggaagccaaagtaggaggactgcttgagcccaggagttcgaggccagcctaggcaacacagaaaaccccatctgtacaaaaaatttataaaaattagccaggtgtggtgatgcacacctgtgatcccagctacttgggaggctgaggcaggaggattgcttgagcccagaagtttgaggctgcagtgaactaggattgcaccactgcactccagcctgggtggcagagtgagaccctatctctaaagaaaaaaaagaaaaaaaaaaagaaaaatcacatgagagtcattggtagaagagggaccgtgagttagatagacctgtgtttaaatcctgggttctgcttcttacctgctttttggccctgagcaaatgacttcacctgcctgagcctttgtttcttcatctgtaaaatgggctaataatgctgacaccccttgtcccccaatactgtgattcataggattggtcagtatttgtgaaatgccactggacacccaggaagtaatgccataaagaagaaactaatagcagtggtaatagaatgattactattaaagtcatctttgagtgctcagtggaagttgtttaaagtagaaattgcaaatggcaggacacactttttttttttttttgagacagggtctcactctgtcacccaggccggagtgcagtggcgcgatctcagctcactgcaaccgccacctcctgggctcaagtcatatccttctgcctcagcctcccaagtagctgggactacaggtgcgaatcaccatgcctgctaattttcgtattttttgtagagataggtttttaccgtgttgcccaggctggtcttgaactcctgaactcaagtgatccccctacctcggcctcccaaagtgctaggattaccggcatgagccaccgcgcccagccttacacacttttttttttgccctgcttacctgtttgtgttttttatataaactggttgccaatattttttaaatggggaccttttcattaaaatacaattcctggcttctcttggggaaaacaatgggaatgtggggccatcttgggaactgcgagggtgggtcacagcactggctctgagtatctgccagccagcgttcccatcccaggcccatgctctacagctgtaaaatggtgtcttccttgcaggctgtagcctagatagaatgaggtgagccaggtaatgagctgggtcaagggccaggaacacagcaggcacttggtaaaccctagaatgcgttgtgtaccctttttaggtagcgcttgtgctgagatgtcaggcacacttcctgtttctctcatcttattacctgcctggaccctaagtttgtagctggtttaagagaggcttaaccctctcagccccatcagccccctccccaagggactctgttgaaaaatgtattcctttcagaattttagtttaaatttaattgctctgtggccttaaatgacttaacctctctgagcctgggcttgggtatctgtaaaacaggatcagacatcacaggactggcttgtgtctgtcaaaggccagcaggcacttggaaagtgggtgccacaagggtgatagcatggggtggtggcatgggggttctgggtaggacctgacccttctgtttctccccatgtcccaggaagaagctggtgctggagaacctggaggactcctgcgtgctgactgggccagatgattccctgtgggacaagcacgcgtgcccagcctacgtgggacctgagatactcagctcacgggcctcatactcgggcaaggcagccgatgtctggagcctgggcgtggcgctcttcaccatgctggccggccactaccccttccaggactcggagcctgtcctgctcttcggcaagatccgccgcggggcctacgccttgcctgcaggcctctcggcccctgcccgctgtctggttcgctgcctccttcgtcgggagccagctgaacggctcacagccacaggcatcctcctgcacccctggctgcgacaggacccgatgcccttagccccaacccgatcccatctctgggaggctgcccaggtggtccctgatggactggggctggacgaagccagggaagaggagggagacagagaagtggttctgtatggctaggaccaccctactacacgctcagctgccaacagtggattgagtttgggggtagctccaagccttctcctgcctctgaactgagccaaaccttcagtgccttccagaagggagaaaggcagaagcctgtgtggagtgtgctgtgtacacatctgctttgttccacacacatgcagttcctgcttgggtgcttatcaggtgccaagccctgttctcggtgctgggagtacagcagtgagcaaaggagacaatattccctgctcacagagatgacaaactggcatccttgagctgacaacacttttccatgaccataggtcactgtctacactgggtacactttgtaccagtgtcggcctccactgatgctggtgctcaggcacctctgtccaaggacaatccctttcacaaacaaaccagctgcctttgtatcttgtaccttttcagagaaagggaggtatccctgtgccaaaggctccaggcctctcccctgcaactcaggacccaagcccagctcactctgggaactgtgttcccagcatctctgtcctcttgattaagagattctccttccaggcctaagcctgggatttgggccagagataagaatccaaactatgaggctagttcttgtctaactcaagactgttctggaatgagggtccaggcctgtcaaccatggggcttctgacctgagcaccaaggttgagggacaggattaggcagggtctgtcctgtggccacctggaaagtcccaggtgggactcttctggggacacttggggtccacaatcccaggtccatactctaggttttggataccatgagtatgtatgtttacctgtgcctaataaaggagaattatgaaataa

SEQ ID NO: 2716 - DNA, 35018 bp, Homo sapiens
catgctgggggaggggctggcggcctcgacggcagctgcggaactaggccgagggacaaaggctaaggtcagccgcggttcaagccctttcgtctgccgacgaccagcggccagacgctgcgggagcactgctgggctggaggagggctcgagctgcgaggacggcacggagcagcggggtgggactcggggtcgccccaggagagttccgcggcccgggggggcagaggcatgcacaagtggggggcggaaggagggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagggggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgcgtaagtgttccgtggggcgccctcccggcccgccctgcccccccttccggcccaccctgtccccttccggccccgccgccgtttttcccgcgcgcggacactgtccccgcacggtggtccctcgttggtgcgtggcctgacatccggctggaggcctcgggtgctccgaaagcggtaccttcgggggcccccccgcacccattggtatgcacttcccgcttgttggagtggagggcttttccccaggacctgtcctcccttttcttagctccttgggcattctcttcctgagggtcacatgattttatcctcgagaaggcttcttttgactcatttccacctcctttcctcccaaatcctttgaatccccaatgtttgttttccgtgggtttccaaagagctgctctctaatactttaagtcccttttattcgtcaatttcgggcttactggaaaatggtgaactgccccttgagttgcaccaggcctgaaactgtattccgtgcacctctaaggtggctgcccttcttctcgtgagaatccaggtcatctctcacccacatatcccctccgttttccttctgtctatttgcaggtactcacgattcagaactgtggcattctgggcattaaggctctttgttttgaggggaaacaacatctttctgaattttgccttgggagttgcatacgctcctcccagagaatccgtttccccattttattaggtttctttttctgtgttgtgtattttctcccctttacaagtcttcaattcaggaccgctgcctggcagccattgctgctgttgaaagtatcaattgtcctgatactgtaatatgagctttacagtgtgatgccattttacatatggttggactttttggtgggtgttgccagattcctatttcaggaaattgacttgtttaaatgcagattgtgagagggagggaaaatggcaagatgtgagatttttattgaatagtcttctaccttagcccagtcacccaactgcttttttgaatcttctctgatatggatgattaaatgtagttctattttgctgtgaaaagtttgggagttttcagttcttttgtctttttccatcttcttgcaacagatttggaaaacagattcttaacctgtgccattttcagagtcagtcacctagttttgttttatttgagaagcacctgagtttgaagcaatgcaaaatatgagatccttcatggttttgtattacatcgttggaaatggatgtaaattccaaagattcagcaaataagagtatagccattagccacaagggtttttttggtttgttttttgttttttactttgagacagcgtcttgttctgttgcccaggctgaagtgcagtggcatgatcatggctcattgtggccttaacctcctgggctcaagccatcctcctgcttcaacctcctgcattgctgggactaaaggcacgtgccactatgccaggctaatttttcaatttttatttttttaaatagagatgggatctcttatgttgcccaggctggtcttgaattcctcctggtctcaagcgatcttcccacttcggcctcccaaagtgctgggatatagacgggagccattgtgcccgacctggcagtcgtctactaagagctttggtaactcattagcctcgtggctctgaggtaggtggtagtattccattttacagatgagaaaactgggacacgtttgcccggtcaaatggctagtgcgttgtgaaatagaaatgtaaactcagaattgctagcttcatagcttttgcggtggaccactgtgtttttctgaattatttacgttctgttagttatttcttcattgctctaagaccaagcataagtttgatcttttgtgttcaagactgacttacttgaggcgaaaatttttagatactgtggaagtacttccaaatattgagcatgagaatgacctggtaaaagtgcagattcagtgggcccagttaagctcctcatattcaaatacaggtgactcaaagaccacactcagaaaaaccggtttacactgggtggggagaattatattaaggtagttttgaaacttattttagggaactaagtagacacatattcatgctataggatttatattttgttttgatgtttgatgtttgtcgtgattcccttcattatcttctctggctgataaatcatgaaaacccatctttccagtataagacctgctaaaggaatgaacaggatactgattgttcttccttccatttgtttcttctgtactatctaggggtgcccctgttaggtggagaagcaggctgggcgcagtggctcatgcctgtaatcccagcactttgggaggccaaggcgggtggatcacctgaggtcaggagttcgagaccagagaccagcctggccagcatgttgaaaccccgtctctactaaaaaatacaaaaattagctgggcgtggtggtgcatgcctgtaatcccagctactcaggaggctgaggtgggagaaacatttgaacctgggaggtggaggttgcagtgagccgaaattgtgccagtgcactgcagcctgtatgatacagtgagactcctcaaaaaaaaaacaaaaaaaaaggagaagcagcttgttgactgccgaaccctcctagagtatacttcagtcttatctctgagagaattcaactaagactaaatcttttttatttattgttgggaggtttgggtatggaatggtgccacctttctggtgaaaccctatctctactaaaaatacaaaaaaattagccgggtgtggtgacgcgtgcccgtagtcgcagctactcgggaggctgaggcagataattgcttgaacccgggaggcagaggttgcagtgatcgaagatcgcgccactgcactccagcctgggcgacagagcgactctgtctcaaaaaaaaaaaaaaaaaagccttactctgataccgcactacttgtctaaaggtgcagatagatactagttgtcatttgaaagtcgaaggagctattcaggttatcttaggcattcttgtggtcctggttgtagtcgtgttctgtcacgcgtttcctagagcagtgtagttcccaaaccggcccttgtcccagacttactgcatcagaatccctagcgatgaggctaggcatgtgtatatttaagttcttcaaaagttttgcatcaggtggggaggggggtatgtctcgcagggctgaaagaaataccaaataaagattgattttaaaatgatggaaaccaagacgctaatgatggtaatgtagctaccattttctgagtgcttatttgtcttggacactatgccgagtattttataagcatcttggttaagtctcatagctatcctgtgaggtaggtgttttttatccccaatttccagatgagaaaacaggctcagtgaaattgtccttttgtccaaggccatatagtgagttagtgatggagttgggttttgattcctggtgtcttgacttcagatccagtgttcttggtccacattttggggtgggggaaggtatgtgtgatgtaatccagagctgtggttctcaagtttttaaaactttccctcaacctaccattgcatgatataggtctgcaaaggggtctaaaattatattttaaattttattgaggcataattaaatagagtaaaatgtacaattttggcaaatgtagacactcatgtaacaagagaacatacatttttatcaagggctccaggtgttgagcatatgtgcagcaggtgtgcagaaggtgtggaagccctgtgatcagagtgctccacagtagtgtggacaacaaacttatcctttgaagatgactcgcaaggcatgttgtagcatgccagggagacctttggggcttgttgattttggactcctacaaatctaaccttcataatacagtttttgtttgtagcttgacaacactagcctagaaaatggatcattttttcttggctttccgaggagcgttgctgttggcagtatggaactggagccggggccctgttaggctgcctttattaggctcagcatttcagcttcagggaattaggacggattgacccctgggagctgaggaaaaatgttagattgctatagctttgtggcccattgggagaggcaagatgggagttttttttttgtttgttttttgtttttttttttttttttttagaggagtttcactcttgttgcccaggccagagtgcagtggtgcaatcttggctcactgcaacctctgcttcctgggttcaagcaattctcctgcctcagactcgcaagtagctgggattacaggcatgtaccaccatggccaactaattttttgtgtttagtagagatgggatttcaccatgttggtcaggctggtcttgagctcctgacctcaggtgatccatttgcctcagcctcccaaagtgctgggattacaggtgtgagccaccgtgcctgaccgaaaagatgttgtttgtttgtttgtttttgagacagtttcactcttgttgcccaggctggagtgcaatggcgtgatctcggctcaccacaacctccacctcccaggttcaagtgattctcctgccttagcctcccgaatagctgggattacaggcatgcgctaccacgcctggctaattttgtatttttagtagagacaaggtttctccatgttggtcaggctggtcttgagctctggacctccggtgatctgcccacctcagcctcccaaagtgctgggattacaggtgtgagccaccgcacctggcctgaaggtgttttttaacctattgatttatcaactttttatttatttatttatttattgagacgaagtcttactctgtcgcccaggctggagtgcagtggcaggattttggctcactgcaacctctgtctcccaggttcaagtgattctcctgcctcagcctcctgagtagctgggactacaggtgtgtgccaccgtgcctggccagtttatcaactttaagtggaaccaaagtaaatacagcctgtcttcttagatatataataaatactaagcaataagcagggactaaaaatcgtccccttatgcagctgtgtaaaatggtacagtatattactttaggggccatgtgtaagaatcatgcagttggataatatggttgtttagtgttggtgtccctgccttctatctggggagaccatagcaggaagagatgtatgttgttaaaaatattttgctgactgtgtatgctggctcatttctgtaatcctagcactgtaggaggctgaggtgggaagatcacttgagaccacgagttcaagaccagcttgggcaacatagccagacctcgtctctccaaaaataaaaagggcatgcatggtggctcacacctgtaatcccagctactcaggacgctgaggcaggagaatcactcgaacccaggaggtggaagttgcagtgagccgagattgcgccactgcactccagcctgggagacagggcgagactccatctcaaataaaataaataaataaataaataaataataataaacaaattagcagaatgtcgtggcacatggtcgtagtcccagctacttgggaggctgagacaggaggattgcttgagcccggaggattgcttgagcccggaagattgaggttgcactgagctatgatcatgccactgcactcgagcctgggcgacagagggagaccctgtctccgtttttttttttttctttttttttttctcaaaacatttcaaaaaataggaggaggaagatagactaggctattgtagagcatcaggcaatgaaaagaatggctattttgattatttaaaagagcggtgatgttttttggacttaaagtttgtagccttgtgagcttttctcaggttcataatttggggtatcttcaggcactgttcaggtaagactgactgggatgtgaaaacttttctaaattgcggcttaaagtttgctttctaaaaatgaaacccatctcagttttttagtagttcgttacattttgtgtgtttatatttcctgaatgtagaatttgttgttgaatttgctgattttacggtatgtggtcttttataagtatctagtccctgagtttaaaactattttgggaataagaataattattaaagtacctctttcaatgttaggccaagatattgctttcctagaacagcctagacatggatttgcgatgtcattaaccatctgtggtctggtaaaagtgtagttcataatattggaaaattgagcacacttttaaaagtaaactgtgtgtttctttttttttttttgagacggagtcttgctctgtcgcccaggctggagtgcagtggtgcgatcttggctcactgcaagctccttctcctgggttcatgccctttctcttggctcagcctcctgagtagctgggactacaggtgcccgccaccacgcctggctaattttttttttttttttttttttgtatttttagtagagacggggtttcaccatgttagccaggatggtctctatctcctgacctcgtgatccgcctgccttggcctcccgaagtgctgggattacaagcgtgagccaccatgcccagcctactgaactatgtatttcccattggaaagtgtgatgttgtgaaatatatatattggtcttttgcccatttcctggcatacaactcctgaaatccttagaaactccacagtgatgtccttttgtgtgctaaggagttaactgatggctggaagcctctggacttagtcatggaaagaacaagacaggattagagggttgggactttcactcctctccagcctctggggaggggtgggggcttgaaggttaagttgatcaccagtggacagtgatttaatcaattatacctactaatgaagcctccattaaaaacccaggaggacagggtttggagagcttctggatggccaaacaagaggttccaggagggtgcagtgcccgagagcacagaagttccgtgtccctcccctatactgtgtactatgcgtctcttcctctgaatcttttgaaatatctttataataaaccagtaaatgtgtttcttaggttctgtgatccagtctagcaaattaatccaaaccaaagaggggtcatgcaaactccaacttgaagccagttgatcagaagttctggaggcccagattggcaactggtgtctggcagaggtgtggtggaggagcagtcttgagggacttagccctcgacctgtggcatatgatgctatctccaggtacatagtcgttggaattgcattggagggcacccagctggtgagtgctgcagaattggttacttgctttgtgtgtgggctcacagaagtcttctgtgttgatcgttgctgtggtgtgagagcagaggaaaaactttgtttttccacactcttaaaggatttcagtcgttgagacctattatgggaccttgtgctttgcatacgttttgaaatgtggcctaagtcaagtataggttgtctagactgagtaccttggaggtcttaatatcaggaaatatgttaagggctgtgaatagactgaaatatctgaaaattaatggccaggactcactaactagaaggcaggggccttctcttatcagtgagctctaggctggatgtgttagctcacgtctgtaatctcagtactttgggaggctgaggcgggtggatcgcttgagcttaggagtttgagaccagtccgggcaacatggtgaaacctcgtctctacaaaaaattagctggttgtggtggcctgcacctgtagtccagctacttgggaggctgaggtgggaggatcacttgagccagggaggttgaggctgcagtgagcctgaacctggtgattgtaccactgtactctagcctggatgacagagtgagactgtgtctctcaaaaaaacaaaaacgaaaacaaaacctgggtgcagtggctcacgcctataatcctagcactttgggaggccgaggtgggcgaattagttgaggttacgagttcaagaccagcttggtcaacatggtgaaactgtctctactaaaaatatgaaaactagctgggcatggtggtacgagcctgtaatcccagctactcgggaggctgaggcaggagaatcgcttgaacaactgggaggcggaggttgcagtgagctgaggtctgtcgctgcactccatctgagcaacagagcgagactccatctcaaaaaaaaaaacctcttggttttaattggttatattggattttgttttttggaatctgttgagataatcatgatttttttcccttcatcttactaattggaatttctaatgtaaaagccattgctgcattactgagaagaatctcttttggctatggcctattaattttactgtacaactagattccattttttattttattatttatttattttgagatggagtctttctgtcacccaggctagagtgcagtggcacgatcttggctaactgcagtctctgcctcccgggttcaagcaattctcctgcctcagcctcctgattatctgggattacaggcgcccaccaccatgcctgactaatttttgtatttttagtagagatggggttttaccatgtcggccagactggtctcgaactcctgacctcaggtcatccactcgcctcggcctcccaaaatgctgggattataggcatgagctgcctcgcccttaggctttcttgctgagtatatttaataaatatgtaaggctagatgtttccgtttaagtactactttgggtatatcctattggtttctatatattgtattctcactgtcattcatttaaaaataaattttgttttgatttcctttttaatcccagagttaatagtttaaaaatttcaaagtagatagatttatttctttgtttgttggattaatttctaattttgaagttttgcagtaagtgaatgtgacttgttctttggaatttgaagttctttaagctagtgcagttaatttttgtgagtgctttatgggtttttaaaggaatgtttgcatggttttgtttgttttgggaaacagtcttgctggtcttgagtgtttttttttgtttgtttgttttgggaaacagacttgctgttgtctaggctggagtgcagtggtgcgacctcggctcactgcaccctctgcctcccgggttcaagtgattctcctgccttagcctcccgagtagctggaattacaggtgcccaccactgcacctggctaattttttatatttttagtagagacggggtttcaccatcttggccaggctggtctcaaactcctgaccccgtgatccacctgcctcggcctcccaaagtgctgggattacaggcgtgagccaccgtgcccagccgggtttttttttttttgagatggagtctcgctctgtcatccaggctggagtgcagtgatgtagtgtaggctcactgcaacctccacctcctgggttcaagtgattctgctacctcaggctcccaagtagctgggattacaggcatgtgccaccatgcccggctaattttttgtatttattggagacggggcttcaccatgttagtcaggctggtctcgaactcctaacctctggtggtccacccatcttggcctcccagagtgctgggattacagatgtgagccattacatccggctgttttttttttttttccccagagttctatttgtgtttactagatccaccttattagccatgatattaaaattctctttctaccataattttgtaggtgtgtgtgcaatctacaaattcctgaggtctgtgtcattctcatactgacttgtagatgtgtcagtttctctgttagtgttttcgaagtatgtgttatgtgcataaggaacatggctattacattcatcagttgtacttttttttttttttttttttttgagatggagtctcgctctgttgcccaggctggaatgcagtgctgcgatcttggctcactgcaagctccgcctcccggcttcacaccattctcctgcctcagcctcccaagtagctgggaccacaggcacctgccaccatgcccggctaatgttttgtatttttagtagagacggggtttcaccattcacaggatggtctcgatctcctgacctcgtgatccgcctgcctcggcctcccaatgtgctgggattacaggcgtgagccactgtgcctggcccatcagttgtactttttatgcacatgagagagttttttttttgtcccttcttaatgcttttttgtttgtgttgtttggtctgctagtattgtatctgcttgctgttaacatttgcttgatacagtggagtagcattctccaggcatttattttagtcatttaaattcaagtgtataaattcagcaagtgagttaagtgaatggtgccagcgattctacccagtgtttccgtcagtaactatatgattatgagtgagtatagggatgagaatggtgactctcctttcccctgtagggaaaggaaggggcgtgattgtctggaggggcacctcttgtaatgtgagcatagctctttgccaaatgaaacactggtcttgaaacaaggtatgacctttactgtactatggctcttaaatgtaaatcagctgctctatctagtattcatctctagtgaggtgcttaagagtgcttaacatttttataatgtgtaatacttttgactaaatgccattttcatctttcaaagcattcaactcctcctcatggtgtgactccattgtgggtgatttaccatttttccttcagtttacttgtataatcttgtttgaggtatctttttacatcaacatatacttgaatttctccttttctctcctaattcctggttaagctcacagaatttcctcttcagtctagaagagaaatttgacctatttgtgattactgataagtgcagtcattcccatcatttatttatttattaaattatttttaagttttttttgagatgaagtcttgctctgtcgcctaggctggaatgcagtggtgcgatcttggctcactgcaacctctgcctcctgggttcaagcgattctcctgtctcagcctaccgagtagctggggttacaggtgtgcaccaccacacctggctaatttttctatttttagtagagatgggggtttcacgatgttggccaggctggtctcgaactcatgacctcaagtgatccacctgccttggcctcccagagtgctgggattacaggctttattatttatttatttatttatttaagaggtaggatcttgctctgctgccaggctggagtacagtggctgtatcacagctcactagcctcaaactcttgggctcaagcgatcttcctgcctcagcccctggagtagctgggactacaggtgcacgtgatcatacctaaatttttttttagagatgtggtcttgctgtgttgtccaggctggtctcccaactcctggcctcaagtgatccacccaccttggcctctcaaagtgttggaattacaggcatgagccaccacacctggctgttttgtatttactgtacttttccccatttcttgtcaatcagcttttttgaactgattgctttattttttttctaatgtgaaagtcattttttttttctcctctggagttacctctaaattttgacacatttaaactatcacttctatattcttgtgtagaattaatcagaatctatcttttcttcccttttccaacaagacagaactgctgcttgctttcatttccttctcccttctcttccctcttcaacttcctatgtcgaaatcatgtaagtattttagtttcagattgcttatttttgtaaaagtcagtacttttgtttatttcttaaagctcttggattaaaaaaaagtttcttaaagctcttggatgttttaaaattatggcattcatctaccaattatgttagagaaggtctttgaaaagtaaagttgatcccttacatatgtgaaaattgtttttgcactcccgcttgaaagcttatttggttggctggatataagtttcaaaatcattttccttataactttgaagccagtgctccgttgtcttctggcatctgtgctgctgatgaaaagtctgatactgacttttatgtgatttatgtatctttataggaattcagttttttccttatgatatcttgaaatttcaataggatgtgtctaagttgtcttccccttctctgctgaccgataaacactgttcagcccttagagtaacctgatgattggtgtcttccctttccccaaggaaatttctggaactaacataagatgttggtccttctggttctatattctctccctctctcttttttttttttttttagttagagacagagtctcagtctgttacccaggctggagtgcggtggcatggtcatagcttgctacgaccttgacctcctgggctcaagctatcctctcacttcagcctctcaagtagctgtgactacaggtgtgcgcctggctaattttttatttattttttatttttgagacggaatctcactctgtggccagactgtagtacagtgggacaatcttggctcactgcgacttccacctcccaggttcaagcgatttccagccaatttttgtatttttagtagaggtggggtttcatcatgttggcctggctggtctcgaactcctgacctcaagcgatccacccacctcggcctcctaaagtgctaggattacaagcatgagccaccgcacctggcctagttttttttttttcttttaaagtagagatggggtctggctgtgttgtcctggctgatcttggactcctggcttcaagtgatcctcccatctcggcctcccaaaatgctaggattacaggtgtgagtcactgcacccagccaggttccattttctctatattgactatattgacctttctttcatacttgaaaagcatttggggataatcttttaattttgttttctatttgttttttctgtgcccattttgctgttaaatatatctgtcaagttttattttagcaattgttttttctcttttataacagcgtctttaatgttgtaatttacatacaataaactgcatccatttaaaatatacagttccatgagtttcgacagatgtgtatagacacacacacacacacacacacacacacacacacacacacacacaccccttttacccccaaacaagagttgggttaccagagtttttccctcctcctgtgcagtccaaccccagctctcaagcccatgatttgcttgctttcagatgtaaaaatgattagcttgccttttttttttttttccccctttttgagacggagtctccctctgtcgcccaggctggagtacagtggtgcaatcttggctcattgaaatttactcctcctcctgggttcaagtgattctcctgcttcagcctcccgagtagctgggattacaggcatgcactgccacaccgggctaatttttgtatttttagtagaaacgaggttttgccatgttggctagtctggtcttgaattcctgacctcaggtgatccgcccgccttagcctcccaaagtgctggaattacaggcatgagccacgacgcccggcttttttttttcttcttttcctttttttttttttttttgagactgagttttgctcttgttgcccaggctggagtgcaatggcatgatctcggctaactgtaacctctgcctcctggttcaagtgattctcctgcctcagcctcccaagtagctgggatttcagcgcgttccaccacgcccagctaattttttttttttttgagatggagtctcactccgttgcccaggctggagtgcagtggtgtgatctcggctcactgcagcctccatctcctgggatcaagcgattctgctgcctcagctttcttagtagctgggattagaggcatgtgccaccacgcccggctaattttttttatttttagtagagacgtggtttcaccatattggtcaggctgatctcgaactcctgaccttgtgatccggccgcttcagcctcccaaagtgttgggattacaggcgtgagccactgcgcccagcctaatattttgtatttttagtacatatgtttagtacatacgtacatactttagtacaatatgatttcaccatattggtcaggctgctcttgaactcctgacctcaggtgatctgcctgccttggcctcccaaagtgctgggattacattcttgagccactgtgcccggccagtttgcattttcaaaagtttcatataaatggaataatatagtatgtagccttttgtgcaaggtttcttttactcaccctatttttgagattcatgaatattaaatatgtagtagtttgtcccttttttttggttttcagagcattctttcccacaattaggaaattaacatggacaaactgtatttaaattttgccaattttggctgggcatgatgactcaggcctgtaatcccagcactttgggaggccaaagtgggaggattgctggaggccaggagttggagaccagcctggacaacacagtgagaccttgtctctccaaaatagctggcatggttgtgttcctgtagtcgtagttacttgggatgatgaggcaggaggattgcttgagcccaggagttcaaggttacagtcagttgtgattgagttgtgattgcactccagcctgggaaacagagcaacacgctgtctctaaaaataaaaataaaaggtgaaaaataaatagaaacagttttgcatggattcttttgtacgttgtttatttagttgtatataattttatcgtgttaatttttgcagccacacacatctggcaatcgttttttaatttttgatttttctctatggtagctttttttatggatgagttatgattttacctctgagaatatttttgattctgtttattcctgcaactctttcttcagatatttagtttctcatttttgtagtgtttatttcccttgtagtttttctagtttgtaaaagtgataatctctggtttgagaattcctgttcttctgccagtggattcagtgtctgtttaccagttggtcaggattgattttaggggaggtatgagatacgtggcaaaatatggggtaaaatgtctccttatttcttctgggtaatagcagccacctgagtgccatcctgattctggggctccagtgcctgtttccagtgaagactttgcttctgtcagtgttggggatagaacatggttattggtagagggagtggcctgtccacttgtgccaaacacatttccccaccatcgcttgtgactgcaccactgcaccagacctgcttttgtttccccatggtagccgccctgaacctacggcttggatagaatacccctacgttctctctctcaccttcatagctgatcccagttttaatagcattcctcttttgaggcttatgcatggttattgcctctgtaaacctagttctgctgctgctatctcttttttttttttttttttgagacggagtctcgctctgtcacctaggctggagtgcagtggcatgatctccgctcactgctccgcctcccgggttcatgccattctcctgcctcagcctgctgagtagctgggactacaggcgcccgccaccacgcccggctaatttttttgtatttttagtagagatggggtttcaccttgttagccaggatggtctcgatctcctgacctcatgatcctcccgcctcggcctcccaaagtgctgggattacaggcgtgagccaccacacccggcctgctatctcttcttgtttcccagaattattttagaaaataatatatcaaatatatcaataaacccacacccttttttttttttttttgaggtggagttttgctctgtcacccaggctgtagtgcagtagtgctgtcttggctcactgaaacctccacctcccgggttcaagcaattctcctgcctcagcctcctgagtagctatgattacaggtgcccgccaccacgcccggctaattttgtatttttagtagagatgggggtttcaccatgttggccaggctggtcttgaactcctgacctcaggtgatctgccctcctcatcctcccaaagtgctgggattacaggtgtgagccaccgtgcccggcctaaacccacatctttagtaatttctacgatttagattgggaggggaagcatgtacagatgctttttgacttacgatgtttatgctacattccataaacccatcagaagttcaaaatactgtaaatcaggctgggcgcagtggttcacacttgtaatcccagcactttgggaggctgacctgggtggactgcttgagcccaggagttcaagaccagcctggcaacatggggaaaccctgtttctacaaaaaatacaaaaattaggtgggtgtggtggcatgcacctttagtcccagctgctcaggaggctgagataggaggattacttgagcccaggaggcagaggttgcagtgagctgagattgtggcgttgcattctagcctgggtgacagtgagaccttacctcaaaaaagagaaaaagaaaatactgtaagtcaaaatgcatttaatatacccagcctattgaacatcatagcttagccaaacctaccttaaatgtgcttagaacccttatattagcctacagttgggcaaaatcttctagcataaagctagatgatttaataatgaataatataaaagataattattttacaataaaatgtcgaatatcttgtaatttattgaatactgtactaaaaataaaaaaaacaataaatacttgaagtagagtttctactgaatgcttattgcaccattgtaaatttgaaaaatcattactttgagccctcattaaattgggaccttccatatgtctgtgcagtccactttgatccaatctcttcaggccttttttttctttgagacggagtgtcactctgtcgccaggctagagtgcagtggtgcgatcttggctcactgcagcttctgcctcatgggttcaagcgattctcctgcctcagcctccggagtagctgggactacaagcgcacgccaccacagccagctgatttctgtatttttagtagagatagtttcaccatgttggccaggatgatcttggtctcttgaccttgtgattcacctgccttagcctccccaagtgttgggattacaggcgtgagccaccgtgcccagccctgccttttttttttttttttttttttgagacagagcctcactctgtcgcccaggctggagtgcagtggtgtgatctcagctcactgcagtctccacctcccaggttgaagcagttctggtttagatttcctgagtagctggtactacaggtgcacgtcaccatgcctggctaatttttgttttagtagagatggggttttaccatattggtcaggctggtctcaaacttctgacctcaggtgatccacccaccttggcctcccaaagtgttgaaattacaggtgtgagccactgcgcttggcctaaaggacattttgggaaccggtgttaatgtctattgaaaccttttatttttggaatatcagattttgaaagataaattgaccattggaggttatatgttacataggtttgggaatttcctgtttctagtttgctgctaaaccagaactctgaagtctcaatgtttttttttaagccgataggaaagagagattttcattctgaatctttgtttttcacagttgaggcttacgagtagtcatcttgttatttttaaaacacttcatagtgcggtttgcgcttgtctgacagaatggttgggttggctcaatactttgatatttttctttttcgtctttgccgtagtattttttttttaagttatgcatctaaatcaagacagaatcacatttctttgccccaaaacccttttgcctagaattatgttctttggaaaccctagcgtttgaaataagttgctactgtggtaagggtaaatttaattttcagaaaaaagctgttctgacttatttttcttccccatttagtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacagtatgcattttttagcttatatacaatttatggtaatttgattgttaaaaataatgccagtagcaagtggtgaaataatttccatctctaatggaacttgaattttcttgagtcaaatgaagattaaaggtacgctagtgataggagttggccatctagaggtggttgtctagttcagatgtatggacgacaatcagaaccactaaaagggtagcattttattgctcctttagtatgaaaaattagggcatctgctatacgttgaggaagaaactacctaaaaggaacatcattagatcatgaacaatgagattgaaatataattaaaatcatttcatgtcataaaattgttttcagtcttgtctaccacataatttctcttgtctccctcagttgtttgctggcatgttcactaactgaaaaaaataaggaactctggtcaaaagtggtgttttcaggctcagggctggtctgagatgggtgactgcagagccctcctctcccagaatgctttctgatgtgttctgtgctgcacacttaactggagtctcgccaccatgtctggcccctggggaatgctgccaggcgctctatcttgctttcattgagtgaacactggagaacattgtgagcaagaccttgaggctaggtcctttcagggtggatggtgggggtaggccggagaactgacaaatgaataagccaagatcctgaccgtcagggtgcaatacagattgaaaatgtcttcagtgactgactgtttttctgttgctaaatgagagaatattagtctgaaagagattctgcctttttgttttgttttgttttcttgagatggagttttgttcttgttcccaggctggaatgcaatggctcaacacaacctccacctctcgggttcaagcgattctcctgcttcagcctcccaagtagctgggattacaggcatgtgccaccacgcccggctaattttgtatttttagtagagacagggtttctccatgttggtcaggctggtctcgaactcctgatctcaggtgatctgcctgcttcagcctcccaaagtgctgggattacaggggtgagtcaccttgcccggcccagattctgcctgttattctgcatgtcttttagtagagatggggtttcaccatgttgtccaggctggtctggaacacctgacctcaagtgatctgcctgcctcggcctcccaaagtgttggaattacaggtgtgagccaccgttcctggcctcaactttttgactaacatgccttggagttcttcccacttcagaacataaagatcctcttcatttttgttttgttttgagacggagtctcgccctgtcacctaggttggagtgcagtggtgccatctcagctcactgcaacctctgcctcctgggttcaagagattctcctgcctcagcctcccgagtagctgggtttacaggcgtgcaccaccatacccagctaatttttttttttatctttagtagagactgggtttcaccatgttggccaggctgatcttgaactcctgaccttgtgatccacctgtctcagcctcccaaagtgctgggattataggcgtgagccaccgtgcccggccgatcctcttcatttttagttgctatacagtgctccataatacgaataataatttagtcattcctttattatttaaatggaattaattgattatgaaacagttcaaattttgactgctaaaattcccctccctcccaagaggctgtagctagtttagatagtgaaaaaaatcttaccttctaactggatactttcagccttttggcttcagtttgttaaataatgtgtggcctcttttgatactgctccaaagccttgagatggtcctctgtcacagtccttgtggctcccaccctgtgtcacaaggtggtttctgatagtgctgtggcctgagcttggtatcagccccattgtccctgtaagcagagatctgaatttctgtttgaaggttgataaatgctgtggttttttttttttgttttttttgttttttttttggtcacacttattcagctgctgcagtagtttctatgtagagtgtatttgggtctgtagtagcaggagtctgtctcagcactgtgtccctaggtttgctcctaaatctgttctgtaaagcatgcacaaataatacacatctgtgagtgcactttcatggttgtttcacgtagtggggatgccttattgaatggaatttttgtttctgttggcttattaaaaagtctgagtacattcttatttcattacagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactaggtaagttgtatataaaactcactgtttattcttagtatcctaacgggctgagttttcaggtattacatgtaactacaccttcaagaacctgttaggtgaaagtgtttctggattatgcaaacaaatgtttctctttgaaaattctgattttatgacctagttttctttaatctctactgttcaagatttattatcctaggtgtttcttaaaagatcacatcagcagactcattgtagcctttgccctcagatagtttatggtgtgcatacacaaagtagctaaagttattaggcagcatctgtaaggagaaggcacgggaaaggacctagctctgaaacctgtgtaaatttcatgcttccacacacatgtgtgtgtagaataatgatgtattctatgtatgtgatttagaagttgatatgtactgatcagtagaaaaattattgagggaaggtagtatgaaaagagaggattagccgggcgtggtggctcatgcctgtaatcccagcactttgggaggctggggcgggtggatcatgaggtcaggagttcaagaccagcctggccaacatggtgaaaccccatctctactaaaaatacaaaaattagccgggcgcagtggcaggcgcctgtgaatcccagctactcgggaggctgaggtgggagaattgcttgaattcagagggtggaggttgcagtaagccgagattatgccactgcactccagcctgggtgacagagtgagactccgtctcaaaaaaaaaagaaaagagagtattagggccaggcacggcagcttatgcctgtaatcccagcactttgggaggccgaggcgggtggatcaccagaggtcgggagttcgagaccagcctggccaacatggagaaaccccatctctactaaaaatacaaaattagccgggcgtggtggcacatgcctgtaatcccatatacttgggaggctgaggcagaaaaatcacttgaaccaggaggcaaaggttgcggtgagccgagatcgtgccattgtactctagcctgggcaaaaagagctaaactccatctcaaaaaaaaaaaatgaggattagatggaagaagagaatgtttcggcttaagggtcagaggtcacttcaggaaaaacaggcatctagggattgggataaacaatttttttaaaaaaacagttgtgatttaaatagaggagtaatttttttgtgacaaaacacgttgcaggaggagtatgtttgggggtgtactgataagccagggtgacaaggtgcttggatgagaatgactcagggaatgtacttggagaagggaaagggaggaggtgttagcatggccccaggcgtgtcaggctaatttgcacctgaggctcttcatacttggcagacagccagactgcactggggacatgggccctgtgttttgtactttgcatgttggctcacatgcatatgtaccttaaaggtgtatatcaggcaccttatcttttcacagacttgtttcctaccagtggcatttgcatgattgggttggatatgtgaatatggttttggggttcataaatgttaacttcttgttcttatttttaaaaatgttataatactgtgttaattgtttttaatcatagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaaggtaagggggcatgtgtgttctaagaaatacaggcgggccgggcgcggtggctcatgcctttaatcccaaaactttgagaggccgagatgggcagatcatgaggtcaggagtttgagaccagcctggccaacatagtgtaaccctgtctctactaaaaatacaaaaattagctaggcatggtggtgcgcgcctgtagacccaggtacttgggaggctgaggcaggagaatcacttgaaccctggaggtggagggtgcggtgagctccagcctaggtaacggagtgagactctgtctcaaaaaaaaaaaaaaaaaaaaaaaagacataaaataataatattgggcatattttttaaaaaagctctattgagatataatttacgtactataaagtcagctgtttgaagcgtacaatttagtggtttctagtatatttacaggattgtgcaaccatcactgtaatcccaattttaggacatttttatcatcctagaaagaaaccttgtgttcattagctacgactctccattccccccacagcccctgccaaacagtaatttattttcaatgtaggtttgcctcttctgaacatttcatataagtggtatcatacagtatatgatcttttgtgattacttcttcatatagcatatgttttcaaacattcacattacagtgtgaatcagtactttattcctttttattgccaaataatatttcttttttctgagacggcgttttactctttttgcccaggctggagtgcaatggcgtgatctcggctcaccacaacccccacctcccaggttcaagcaattctcctgcctcagcctcctgagtagctgggattacaggcatgcgccaccaagcctggctaattttgtattttttagtagggaaaggatttctccatgttggccgggcaggtctcgaactcaggtgatctgccgcctcagcctcccaaagtgctaggattacaggtgtgagccaccgcgcccggctgccacataatatttcattacgtggataatactacattttatccatttattggttgatgaacatttgggttgtttccattttttggttataatgttgaacatttatatgtaagtctttgtatgtatgcacacacacacacacatatatatatatatattttttttttttttttgagacggagtcttggtctgtcgcccaggctggagtgcagtggcgtgatctcggctcactgcaagctctagctcctgggttcatgccattcttctgcttcagccttccaagtagctgggactacaggtgcctgccaccacgcccggctattttttttgtatttttagcagagatggggtttcactatgttggccaggatggtctcgatctgctgacctcatgatccgcccgccttggcctcccaaagtgctgggattacaggcgtgagccactgcgcctggcctgcacatatatttctaattctattgggtatatacctgagagtagaattgctgagtcatatggtcacttaatgtttaatcttttgaggaactgctacactgttttccaaagtggcagtcccattttacaatcttagcagtttatgagcgtttatatttcttgtcaacatttgttattatctgtcttcttggttttagttgtcttaataggagtgaagtgatatcttgtagcgtttttattttttaagaggcagggtctcgccctgttgcccacatgagagtgcagtgttgcgatcataactggctgcagcctgtgtctcctgggctcaggtgtttctcctgcctcagtctcctgagtcactaggactacagctgtgcactgccttgcctaattttttttttgtagagatagggtcttgctatgttgcctaggctgtcctggcctcaagtgatcctcccaccttggcttcccaacatgttgggattacaggtgtgagccatcactcctggctgaacattttttttgtgtgtgtggcagggtctctctctgttgcccaggctggagtgcagtgacaccatcttatctcactgaaacctctacctcctgggttttagtgattcttctgcttcacctcgcaagtagctgggattacaggcacacctgtaaattatgccaacatgcctggctaatttctgtaattttagtagagatggggtttggccatgttggccaggctggtctcgagctcctgacctcaagtgatccacccaccttggcctcccaaagtgctgggattacaggtgtgagccactgtgcccagcccgaacatcttttcatgtgtttactggccatctgtctgtagtctttggataaatgtctgctgaagtctattgctaagtttttagttggattgtctttttattattgagttctggatacaagtcccttattagatacataattcgcaaatgttttgtcccattttgttagttgtcttttcacttccttgatggtgtcctttgcagcatggaaattttaaattttgatgaagttaatcttatctatcttctgtcacttgtgcttttggtgttatgtgtaagaaatctaagatcatgaagaattgcctaatttaagatcatgaagaattgtttattttcttttaagagttttatagttttagctcatatatatatatgtgtgtgtgtgtatttttttctttttttcttttttgagatggagtcttgctctgtcaccaggctggagtgcagtggtgcgatctcggctcactgcaacctccacctcccgggttcaagcgattctcctgcctcagcctcctgagtagctgggactacagtgcgtgccgccacacccagctaatttttgtatttttagtagagacagggtttcaccatattgtccaggatggtctcgatctcttgacctcgtgatccgcccaccttggcctcccaaagtgctgggattacaggcgtgagccaccacgcccgccagttttagctcttatatttagctcttatatttgatccattttgagtaagtttttgtgtatggtgtgaggtagagctccaagttcatttctttttgcgtgtggatatccagttgtcctagtaccatttgttgaaaagatgattctttccctgttaaattctcttggcccctttgtcaaaaattagttgaccatagatgtttgggtttactcctggactcttaagttatgttccattgatatatatgtctgtttttataccagtaccatactgccttgatactgtagcgttgtattaagttctgaagtaagaaagtgtgagtcatccaacttgttcttttttcgagattattttggctattctgggtaccttgagaatatgaattgtagggttaacttggcaaggtctgtaaataagacaactgggattttaatagagattacattgaatcttttggccatcctaatacaaagtcttctgatccaaaaagatggaatgtcttcccattgatttagatctttgctttctttcagcagtgttttgtagattttattgtacaggtgttaatacttttgttagatatatccgtaagtgttttattctctaatgctattataaatgaaatcattgtctccattttgagatcgtttagaagtacaattgtttttcgtatattggggcacatggcttttactaatagaaaaatcatatgtatacatgcttgtttactaagttttaggcacttggtcaatgctgttgattttctgtttgtaacatttgctcgttggtcatcacttccttttctgattggaaaattattgtagcagttctgctgagcatgtactttgaagtactttatcttctagggaaacctgaaattcttaagcagctcactctgggactcagctgtctgtgctttactctgctctgatagagcagtttaccagatgtgcatgtggccatctgagtggaacagctgtgcagttgagatgaattgctgttagaggtgttgtcctggaactgtctggttgcaggagcaatggtgccttccagtgcatctgatgagattctaactgaatatgtgaatatctggtatccaagctagatttcagtagaaaccgcagggaaagctgtctgctcatttagaatgttggagggctctgtttgaagtttgcatttctctttgaacagatgctccattgcaaaataaaaggtttgaagatttcaacaatgttgccctaaaagctaattttatttcaataaagtaacattcaagttctgttgggctttgttgctgttggtttagcaatgggattttttttcccccatcacagctttggaaacatgatgagcaaggagaagcgagaggctgtcagtaaagaggacctggccagagcgactttgatcaccatcaccaacaacattggctcaatagcaagaatgtgtgcccttaatgaagtaaggggacatggatttctttaattgctctaaggaaaatactgaacttaagtgggccccatcacgtctgttttctcagaacagtgcctaaatgtagtcatttggggtggggtttgttttagcacgaagttaaaactcttcaaatacagattaatcttcttttttttttttttaaactgaagataaacattgctacttgtctagaggtaaaatgacatcttttgaggagaaagtagaggaagagtggaaggtagccagtgttccagatattggggactgttgggggtgatgatggataacgatgctgaatgtagactccacactcactgctgagctctagaggccctagggaggaatccagaggaagtcacggaagctgggagaagactgagcaggccgaggggtgccctccttggctcccccacctcagcagagctgcgtctttgtgctttcagcttctttacagtgctgccttgtagcattcaggtcaagcagcattgtacagggctatgaaagaaccaagaatgggctgcccttgggaaaagaggatctaggatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcataacttcttttttctttattgtatgttccctttcctgtgcttacgtattttcagaaattttagttggtgtgcataccacaatttgtattttatacttaaatatacatttcatggttgtatatttatttgatcaagttcttttatatcaaataacagagcttggcatttggttgcttgctcataactcggcagtaagcatttttaagcatgaagttattctttggttgaattttattcttgatatggggcttaggagtgagatttctggtctacagaaatgatcatgctcatgaattttgacatttatcgtcatgatgctttgcacaagggctgcaccaatttagatcatctttagcggtgaatgagtggattaattttactacaactactgatggtggtggtggaatttcagttgcttttttttgcgaggttaataggtctaaaattttacttttgtttgatgactagtggtttgaatttttcgctgcctgttatattgcttgtatactttgcctgtttgtgtcactgtccttttggattggagtcatactgtttttttttgtttattttaacttatctgtataaaacattgtattcaaaactagttattgttggtcagatttaatacaaatgtttttcctaatctgttttcttctcctgtgacattatctagcatgctttgcagtgggtccagagttgtctggggatcaagtttaagtagccctggaccaactggactaaatttgatcagcagtcaaattgttgctaagagctatgcacatggtgctgtatttggggtagcttttatgagaaaatagaaattaagatgaaaactaattgcctttttttggtgtgctcagaacattaaccaggtggtatttgttggaaatttcttgagaattaatacgatcgccatgcggcttttggcatatgctttggattattggtccaaggggcagttgaaagcacttttttcggaacacgaggtaagctgacttgttcgttgtggtatattatgtacacagagggcttgtgggtcacactgtcatggaacttgaggtagagggtggaggtgaaatgggctgcagtgtttcttttgttttttgtttttttgagacggagtctcgctctgtcacctaggttggagtgcgtggcacagtcttggggctcactgcagcctccgcctcctgggttcaagcagtcctcccacctcagtctcttaagtagctgggattacaagtgtgcgcccccacaccctgctaatttttgtactttcagtagaaatggggtttcaccatgttggccaagctggtctggtctcaaactcctgaccttaagtgatctgccagcctcagcctcccaaagttccaggattacaggtgtgaaccactgtgcctgaacttttttggtagtttaatttcgtaacatttgaaagctgtttcttccctgatactaatgcaaggtaaattttgggttaatttaattgtaagcttaaggaattttagagaaaaacccttgaacattcccctatatttctgatgccatatttttgtctgaactatcctctatattttttctattgcactgactgtgtcattactctgggttctggttttttcatttttttcagtgccagtttttatatattgttgtaattcttgtgccagttatttaagatgcatgttgtaaaaatgaatagatgagtaaacctctcagactagaaccatactatcataagaacttaagtacaattgtagacaggctggaaatgatgaaatggaaaagaatcaaattgctcaacctcatagcctgtcttggaaagcactcttatttttcctatttggggaaaaagaagcagaggtatggaaaggcgtgtaggggttctttcttcccttcttggttgtggggcagttgaactattctttcaactgttcttggattttagatactgttattatgaacatttttcagaattgtattgcatatttagtttaacagtctatatgaattaaaggaaatcaaagtccagataatagcacagatttgaagtgctagagattactttttcctttaaagttactttaagtttttctttttaaattgctttagttcatagttgaagtccaaagtacacaaatccccatatcaaaaagcttaaaattgaagtcatctaacttagttttaaaattctaacattactgtatttgtaaaccagcaccgaattgccattaagtttcttacagttcatgtttctgtatacatctttttttgtgatctgacttattttattttgctttatattagaattttttaaactcgaatgttagatctttttctgctttatttctgcctcttgtttaaccttttcctaggtagaacatggagattagttttttaagttaaccttaaaaaaaaaataggctgggtgcggtggctcacgtctgtaatcccagcactttgggaggctgagatgggcagatcacctaaggtcaggagaccagcctggccaaccatggtcaatgtggcaaaaccctgtctctactaaaaatacaaaaattagctgggcgcaatggcgggcgcctataatccccagctactcgggaggctgagacaggagaatctcttgaatctgggaggcggaggttgcagtgagctgagatcgcaccactgtactacagcctgggcaacagaacgagactctgtctcaaaaacaaaaacaaacaacaacaacaaaacaaacaaaaacaccaaacaggccaggtgcagcggctcacgcctgtaatcccagcactttgggaggccgaggtgggcggatcatgaggtcaggagttcaagaccagcctgaccaacatggagaagccctgtctctacaaaaaatacaaaaattagctggacgtggtggcacatacctgtaatcccagctacttgggaggctgaggtgggaaaatctcttgaacccgggaggcagaggttgcggtgagccgagatcgcaccactgcactccagcctgggcaacaagagcgaaactccatctcaaaacaaaaaacaaaacaccaaaccgatatcatcataatagttataagccttcgtgaaattcttggttgcattttgtccttattgctcgctgactttgtttttcccactgcttagctttgctggtccatttgtccctgtgttttccatttgcattcaggcctttgactcttgtgtgcatctctgcccttgtggaactttgatgattattttattttatttttttatttaagttctaggatacatgtgcacaacgcgcaggtttgttacatacgtatacatgtgccatgttggtgtgctgcacccattaactcgtcatttacattaagtatatctcctaatgctatccctcccccctccccccaccccatggcaggccctggtgtgggatgttccccttcctgtgtccaagtgttctcattgttcagttcagaactttgattattttagcctctctgagccttgaaatattttcttgccctcacattgaagtcactttaacttttgttgtgaaagcttcgtatagattctctcaagcgtttcctctttgatcctttattctcatcttagcacgttgtagtttataaccacctgtttctgtcttgatagtagcatcctagtcttcagtggaccccccccatatatatatataatggttaactgtatcttctatatttttattataaaataaaaggtacagaaagctgcctaaaacaaactgtatagtgaactattaagacaaacagccttgcctctgtatttcagctgtgccttgtcctgtagctgctggccgcctcacatcacagattggtgtggctgcctttattttatttatacacaccaaaaccaaagatggtcaatatgcctttcttttttttgttttttgagatggggtcttactctgtcagccaggctggagtgcagtggcgcagtctcggctcactttaacttctgcctcctgggttcaagtgattctcttgtctaagcctcctgagtagatgggactacaggcacgtgccaccgcacctggctaatttttgtatttttagtagagacacggggtttgccatattggccaggctggtcttgagctccagacctcaagtgatccacctgccttggcctcccgaagtgctgggttacctgtgagccactgcgcccagccaatatgcctttcttttaaattgccaactagagtgtgacaagaaagcctttggcctctcgtttgatcaggtttcttgaagaagcttttcgtgaaagatagagtggtagttatttatgtttcagagacttttaaaaaatccatacacaagtctttcaggatcttctcattccttttttagttatttcttttaaaaagtagtctgatatcttaccttacaggttggagaccctgatggattctgcatcgttttaggatttgcctctgattcttgctagtgttctcttttctgtcattatggggtttgccccgttttctctaatgtgctattcctgtgttttggttttgagttcttggttgcatgtgacctgactgcttctggagacagtacagtgcttgtcgtctctcagctgctgcttctgtgtctcaggagggctgagggctgccctccctcgggagcctccgtgcttcctcaggctttgctctttgttctgtacctctcttcacgttacctttgggtggtggttttcattcctgtgccgcctgcttctgggccagtgatccaggtgtctggtgaccacccgggcacagctgcttggctgctgtgggcacctcagcttcccatgtcctgtagggaactcacccaccggccttgctctccacacctcttactcctgtgtcccctttctcggggatgctgccccctcctgctgtcctgtcctctgttaggggtgaatcttgaatccatcttatctcttactctccctccctctcccagctcagtcgggctctcaccctctgtgacccacctcacaacttcacctgtttcattgcactttgcatccgacctcgccttcattccttagttgtctggaaatgctccaggcctctgctgcttctcacctcattccccagaaacagtcaggttctgtctcttaccagaggtaactgagctgctgctggcctcatagctcctgtcgccctcactgcgggtttggttttcctcttatcacagtggtctgaagtgcttggatagtctaggacatccagccccctccccagacagggactccttagggcgtctctgctcccaggctggccttggcccttctggggtgctcaggaaatgggtatgctgtgtgtgggcagtggttggctttaacactagtcatcatgtgtaaggtgatttgaataagtctaaggaaaattgcacttatttttggtgtattttctttcagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggca

SEQ ID NO: 2717 - DNA, 34041 bp, Homo sapiens
cccgcgcgcggacactgtccccgcacggtggtccctcgttggtgcgtggcctgacatccggctggaggcctcgggtgctccgaaagcggtaccttcgggggcccccccgcacccattggtatgcacttcccgcttgttggagtggagggcttttccccaggacctgtcctcccttttcttagctccttgggcattctcttcctgagggtcacatgattttatcctcgagaaggcttcttttgactcatttccacctcctttcctcccaaatcctttgaatccccaatgtttgttttccgtgggtttccaaagagctgctctctaatactttaagtcccttttattcgtcaatttcgggcttactggaaaatggtgaactgccccttgagttgcaccaggcctgaaactgtattccgtgcacctctaaggtggctgcccttcttctcgtgagaatccaggtcatctctcacccacatatcccctccgttttccttctgtctatttgcaggtactcacgattcagaactgtggcattctgggcattaaggctctttgttttgaggggaaacaacatctttctgaattttgccttgggagttgcatacgctcctcccagagaatccgtttccccattttattaggtttctttttctgtgttgtgtattttctcccctttacaagtcttcaattcaggaccgctgcctggcagccattgctgctgttgaaagtatcaattgtcctgatactgtaatatgagctttacagtgtgatgccattttacatatggttggactttttggtgggtgttgccagattcctatttcaggaaattgacttgtttaaatgcagattgtgagagggagggaaaatggcaagatgtgagatttttattgaatagtcttctaccttagcccagtcacccaactgcttttttgaatcttctctgatatggatgattaaatgtagttctattttgctgtgaaaagtttgggagttttcagttcttttgtctttttccatcttcttgcaacagatttggaaaacagattcttaacctgtgccattttcagagtcagtcacctagttttgttttatttgagaagcacctgagtttgaagcaatgcaaaatatgagatccttcatggttttgtattacatcgttggaaatggatgtaaattccaaagattcagcaaataagagtatagccattagccacaagggtttttttggtttgttttttgttttttactttgagacagcgtcttgttctgttgcccaggctgaagtgcagtggcatgatcatggctcattgtggccttaacctcctgggctcaagccatcctcctgcttcaacctcctgcattgctgggactaaaggcacgtgccactatgccaggctaatttttcaatttttatttttttaaatagagatgggatctcttatgttgcccaggctggtcttgaattcctcctggtctcaagcgatcttcccacttcggcctcccaaagtgctgggatatagacgggagccattgtgcccgacctggcagtcgtctactaagagctttggtaactcattagcctcgtggctctgaggtaggtggtagtattccattttacagatgagaaaactgggacacgtttgcccggtcaaatggctagtgcgttgtgaaatagaaatgtaaactcagaattgctagcttcatagcttttgcggtggaccactgtgtttttctgaattatttacgttctgttagttatttcttcattgctctaagaccaagcataagtttgatcttttgtgttcaagactgacttacttgaggcgaaaatttttagatactgtggaagtacttccaaatattgagcatgagaatgacctggtaaaagtgcagattcagtgggcccagttaagctcctcatattcaaatacaggtgactcaaagaccacactcagaaaaaccggtttacactgggtggggagaattatattaaggtagttttgaaacttattttagggaactaagtagacacatattcatgctataggatttatattttgttttgatgtttgatgtttgtcgtgattcccttcattatcttctctggctgataaatcatgaaaacccatctttccagtataagacctgctaaaggaatgaacaggatactgattgttcttccttccatttgtttcttctgtactatctaggggtgcccctgttaggtggagaagcaggctgggcgcagtggctcatgcctgtaatcccagcactttgggaggccaaggcgggtggatcacctgaggtcaggagttcgagaccagagaccagcctggccagcatgttgaaaccccgtctctactaaaaaatacaaaaattagctgggcgtggtggtgcatgcctgtaatcccagctactcaggaggctgaggtgggagaaacatttgaacctgggaggtggaggttgcagtgagccgaaattgtgccagtgcactgcagcctgtatgatacagtgagactcctcaaaaaaaaaacaaaaaaaaaggagaagcagcttgttgactgccgaaccctcctagagtatacttcagtcttatctctgagagaattcaactaagactaaatcttttttatttattgttgggaggtttgggtatggaatggtgccacctttctggtgaaaccctatctctactaaaaatacaaaaaaattagccgggtgtggtgacgcgtgcccgtagtcgcagctactcgggaggctgaggcagataattgcttgaacccgggaggcagaggttgcagtgatcgaagatcgcgccactgcactccagcctgggcgacagagcgactctgtctcaaaaaaaaaaaaaaaaaagccttactctgataccgcactacttgtctaaaggtgcagatagatactagttgtcatttgaaagtcgaaggagctattcaggttatcttaggcattcttgtggtcctggttgtagtcgtgttctgtcacgcgtttcctagagcagtgtagttcccaaaccggcccttgtcccagacttactgcatcagaatccctagcgatgaggctaggcatgtgtatatttaagttcttcaaaagttttgcatcaggtggggaggggggtatgtctcgcagggctgaaagaaataccaaataaagattgattttaaaatgatggaaaccaagacgctaatgatggtaatgtagctaccattttctgagtgcttatttgtcttggacactatgccgagtattttataagcatcttggttaagtctcatagctatcctgtgaggtaggtgttttttatccccaatttccagatgagaaaacaggctcagtgaaattgtccttttgtccaaggccatatagtgagttagtgatggagttgggttttgattcctggtgtcttgacttcagatccagtgttcttggtccacattttggggtgggggaaggtatgtgtgatgtaatccagagctgtggttctcaagtttttaaaactttccctcaacctaccattgcatgatataggtctgcaaaggggtctaaaattatattttaaattttattgaggcataattaaatagagtaaaatgtacaattttggcaaatgtagacactcatgtaacaagagaacatacatttttatcaagggctccaggtgttgagcatatgtgcagcaggtgtgcagaaggtgtggaagccctgtgatcagagtgctccacagtagtgtggacaacaaacttatcctttgaagatgactcgcaaggcatgttgtagcatgccagggagacctttggggcttgttgattttggactcctacaaatctaaccttcataatacagtttttgtttgtagcttgacaacactagcctagaaaatggatcattttttcttggctttccgaggagcgttgctgttggcagtatggaactggagccggggccctgttaggctgcctttattaggctcagcatttcagcttcagggaattaggacggattgacccctgggagctgaggaaaaatgttagattgctatagctttgtggcccattgggagaggcaagatgggagttttttttttgtttgttttttgtttttttttttttttttttagaggagtttcactcttgttgcccaggccagagtgcagtggtgcaatcttggctcactgcaacctctgcttcctgggttcaagcaattctcctgcctcagactcgcaagtagctgggattacaggcatgtaccaccatggccaactaattttttgtgtttagtagagatgggatttcaccatgttggtcaggctggtcttgagctcctgacctcaggtgatccatttgcctcagcctcccaaagtgctgggattacaggtgtgagccaccgtgcctgaccgaaaagatgttgtttgtttgtttgtttttgagacagtttcactcttgttgcccaggctggagtgcaatggcgtgatctcggctcaccacaacctccacctcccaggttcaagtgattctcctgccttagcctcccgaatagctgggattacaggcatgcgctaccacgcctggctaattttgtatttttagtagagacaaggtttctccatgttggtcaggctggtcttgagctctggacctccggtgatctgcccacctcagcctcccaaagtgctgggattacaggtgtgagccaccgcacctggcctgaaggtgttttttaacctattgatttatcaactttttatttatttatttatttattgagacgaagtcttactctgtcgcccaggctggagtgcagtggcaggattttggctcactgcaacctctgtctcccaggttcaagtgattctcctgcctcagcctcctgagtagctgggactacaggtgtgtgccaccgtgcctggccagtttatcaactttaagtggaaccaaagtaaatacagcctgtcttcttagatatataataaatactaagcaataagcagggactaaaaatcgtccccttatgcagctgtgtaaaatggtacagtatattactttaggggccatgtgtaagaatcatgcagttggataatatggttgtttagtgttggtgtccctgccttctatctggggagaccatagcaggaagagatgtatgttgttaaaaatattttgctgactgtgtatgctggctcatttctgtaatcctagcactgtaggaggctgaggtgggaagatcacttgagaccacgagttcaagaccagcttgggcaacatagccagacctcgtctctccaaaaataaaaagggcatgcatggtggctcacacctgtaatcccagctactcaggacgctgaggcaggagaatcactcgaacccaggaggtggaagttgcagtgagccgagattgcgccactgcactccagcctgggagacagggcgagactccatctcaaataaaataaataaataaataaataaataataataaacaaattagcagaatgtcgtggcacatggtcgtagtcccagctacttgggaggctgagacaggaggattgcttgagcccggaggattgcttgagcccggaagattgaggttgcactgagctatgatcatgccactgcactcgagcctgggcgacagagggagaccctgtctccgtttttttttttttctttttttttttctcaaaacatttcaaaaaataggaggaggaagatagactaggctattgtagagcatcaggcaatgaaaagaatggctattttgattatttaaaagagcggtgatgttttttggacttaaagtttgtagccttgtgagcttttctcaggttcataatttggggtatcttcaggcactgttcaggtaagactgactgggatgtgaaaacttttctaaattgcggcttaaagtttgctttctaaaaatgaaacccatctcagttttttagtagttcgttacattttgtgtgtttatatttcctgaatgtagaatttgttgttgaatttgctgattttacggtatgtggtcttttataagtatctagtccctgagtttaaaactattttgggaataagaataattattaaagtacctctttcaatgttaggccaagatattgctttcctagaacagcctagacatggatttgcgatgtcattaaccatctgtggtctggtaaaagtgtagttcataatattggaaaattgagcacacttttaaaagtaaactgtgtgtttctttttttttttttgagacggagtcttgctctgtcgcccaggctggagtgcagtggtgcgatcttggctcactgcaagctccttctcctgggttcatgccctttctcttggctcagcctcctgagtagctgggactacaggtgcccgccaccacgcctggctaattttttttttttttttttttttgtatttttagtagagacggggtttcaccatgttagccaggatggtctctatctcctgacctcgtgatccgcctgccttggcctcccgaagtgctgggattacaagcgtgagccaccatgcccagcctactgaactatgtatttcccattggaaagtgtgatgttgtgaaatatatatattggtcttttgcccatttcctggcatacaactcctgaaatccttagaaactccacagtgatgtccttttgtgtgctaaggagttaactgatggctggaagcctctggacttagtcatggaaagaacaagacaggattagagggttgggactttcactcctctccagcctctggggaggggtgggggcttgaaggttaagttgatcaccagtggacagtgatttaatcaattatacctactaatgaagcctccattaaaaacccaggaggacagggtttggagagcttctggatggccaaacaagaggttccaggagggtgcagtgcccgagagcacagaagttccgtgtccctcccctatactgtgtactatgcgtctcttcctctgaatcttttgaaatatctttataataaaccagtaaatgtgtttcttaggttctgtgatccagtctagcaaattaatccaaaccaaagaggggtcatgcaaactccaacttgaagccagttgatcagaagttctggaggcccagattggcaactggtgtctggcagaggtgtggtggaggagcagtcttgagggacttagccctcgacctgtggcatatgatgctatctccaggtacatagtcgttggaattgcattggagggcacccagctggtgagtgctgcagaattggttacttgctttgtgtgtgggctcacagaagtcttctgtgttgatcgttgctgtggtgtgagagcagaggaaaaactttgtttttccacactcttaaaggatttcagtcgttgagacctattatgggaccttgtgctttgcatacgttttgaaatgtggcctaagtcaagtataggttgtctagactgagtaccttggaggtcttaatatcaggaaatatgttaagggctgtgaatagactgaaatatctgaaaattaatggccaggactcactaactagaaggcaggggccttctcttatcagtgagctctaggctggatgtgttagctcacgtctgtaatctcagtactttgggaggctgaggcgggtggatcgcttgagcttaggagtttgagaccagtccgggcaacatggtgaaacctcgtctctacaaaaaattagctggttgtggtggcctgcacctgtagtccagctacttgggaggctgaggtgggaggatcacttgagccagggaggttgaggctgcagtgagcctgaacctggtgattgtaccactgtactctagcctggatgacagagtgagactgtgtctctcaaaaaaacaaaaacgaaaacaaaacctgggtgcagtggctcacgcctataatcctagcactttgggaggccgaggtgggcgaattagttgaggttacgagttcaagaccagcttggtcaacatggtgaaactgtctctactaaaaatatgaaaactagctgggcatggtggtacgagcctgtaatcccagctactcgggaggctgaggcaggagaatcgcttgaacaactgggaggcggaggttgcagtgagctgaggtctgtcgctgcactccatctgagcaacagagcgagactccatctcaaaaaaaaaaacctcttggttttaattggttatattggattttgttttttggaatctgttgagataatcatgatttttttcccttcatcttactaattggaatttctaatgtaaaagccattgctgcattactgagaagaatctcttttggctatggcctattaattttactgtacaactagattccattttttattttattatttatttattttgagatggagtctttctgtcacccaggctagagtgcagtggcacgatcttggctaactgcagtctctgcctcccgggttcaagcaattctcctgcctcagcctcctgattatctgggattacaggcgcccaccaccatgcctgactaatttttgtatttttagtagagatggggttttaccatgtcggccagactggtctcgaactcctgacctcaggtcatccactcgcctcggcctcccaaaatgctgggattataggcatgagctgcctcgcccttaggctttcttgctgagtatatttaataaatatgtaaggctagatgtttccgtttaagtactactttgggtatatcctattggtttctatatattgtattctcactgtcattcatttaaaaataaattttgttttgatttcctttttaatcccagagttaatagtttaaaaatttcaaagtagatagatttatttctttgtttgttggattaatttctaattttgaagttttgcagtaagtgaatgtgacttgttctttggaatttgaagttctttaagctagtgcagttaatttttgtgagtgctttatgggtttttaaaggaatgtttgcatggttttgtttgttttgggaaacagtcttgctggtcttgagtgtttttttttgtttgtttgttttgggaaacagacttgctgttgtctaggctggagtgcagtggtgcgacctcggctcactgcaccctctgcctcccgggttcaagtgattctcctgccttagcctcccgagtagctggaattacaggtgcccaccactgcacctggctaattttttatatttttagtagagacggggtttcaccatcttggccaggctggtctcaaactcctgaccccgtgatccacctgcctcggcctcccaaagtgctgggattacaggcgtgagccaccgtgcccagccgggtttttttttttttgagatggagtctcgctctgtcatccaggctggagtgcagtgatgtagtgtaggctcactgcaacctccacctcctgggttcaagtgattctgctacctcaggctcccaagtagctgggattacaggcatgtgccaccatgcccggctaattttttgtatttattggagacggggcttcaccatgttagtcaggctggtctcgaactcctaacctctggtggtccacccatcttggcctcccagagtgctgggattacagatgtgagccattacatccggctgttttttttttttttccccagagttctatttgtgtttactagatccaccttattagccatgatattaaaattctctttctaccataattttgtaggtgtgtgtgcaatctacaaattcctgaggtctgtgtcattctcatactgacttgtagatgtgtcagtttctctgttagtgttttcgaagtatgtgttatgtgcataaggaacatggctattacattcatcagttgtacttttttttttttttttttttttgagatggagtctcgctctgttgcccaggctggaatgcagtgctgcgatcttggctcactgcaagctccgcctcccggcttcacaccattctcctgcctcagcctcccaagtagctgggaccacaggcacctgccaccatgcccggctaatgttttgtatttttagtagagacggggtttcaccattcacaggatggtctcgatctcctgacctcgtgatccgcctgcctcggcctcccaatgtgctgggattacaggcgtgagccactgtgcctggcccatcagttgtactttttatgcacatgagagagttttttttttgtcccttcttaatgcttttttgtttgtgttgtttggtctgctagtattgtatctgcttgctgttaacatttgcttgatacagtggagtagcattctccaggcatttattttagtcatttaaattcaagtgtataaattcagcaagtgagttaagtgaatggtgccagcgattctacccagtgtttccgtcagtaactatatgattatgagtgagtatagggatgagaatggtgactctcctttcccctgtagggaaaggaaggggcgtgattgtctggaggggcacctcttgtaatgtgagcatagctctttgccaaatgaaacactggtcttgaaacaaggtatgacctttactgtactatggctcttaaatgtaaatcagctgctctatctagtattcatctctagtgaggtgcttaagagtgcttaacatttttataatgtgtaatacttttgactaaatgccattttcatctttcaaagcattcaactcctcctcatggtgtgactccattgtgggtgatttaccatttttccttcagtttacttgtataatcttgtttgaggtatctttttacatcaacatatacttgaatttctccttttctctcctaattcctggttaagctcacagaatttcctcttcagtctagaagagaaatttgacctatttgtgattactgataagtgcagtcattcccatcatttatttatttattaaattatttttaagttttttttgagatgaagtcttgctctgtcgcctaggctggaatgcagtggtgcgatcttggctcactgcaacctctgcctcctgggttcaagcgattctcctgtctcagcctaccgagtagctggggttacaggtgtgcaccaccacacctggctaatttttctatttttagtagagatgggggtttcacgatgttggccaggctggtctcgaactcatgacctcaagtgatccacctgccttggcctcccagagtgctgggattacaggctttattatttatttatttatttatttaagaggtaggatcttgctctgctgccaggctggagtacagtggctgtatcacagctcactagcctcaaactcttgggctcaagcgatcttcctgcctcagcccctggagtagctgggactacaggtgcacgtgatcatacctaaatttttttttagagatgtggtcttgctgtgttgtccaggctggtctcccaactcctggcctcaagtgatccacccaccttggcctctcaaagtgttggaattacaggcatgagccaccacacctggctgttttgtatttactgtacttttccccatttcttgtcaatcagcttttttgaactgattgctttattttttttctaatgtgaaagtcattttttttttctcctctggagttacctctaaattttgacacatttaaactatcacttctatattcttgtgtagaattaatcagaatctatcttttcttcccttttccaacaagacagaactgctgcttgctttcatttccttctcccttctcttccctcttcaacttcctatgtcgaaatcatgtaagtattttagtttcagattgcttatttttgtaaaagtcagtacttttgtttatttcttaaagctcttggattaaaaaaaagtttcttaaagctcttggatgttttaaaattatggcattcatctaccaattatgttagagaaggtctttgaaaagtaaagttgatcccttacatatgtgaaaattgtttttgcactcccgcttgaaagcttatttggttggctggatataagtttcaaaatcattttccttataactttgaagccagtgctccgttgtcttctggcatctgtgctgctgatgaaaagtctgatactgacttttatgtgatttatgtatctttataggaattcagttttttccttatgatatcttgaaatttcaataggatgtgtctaagttgtcttccccttctctgctgaccgataaacactgttcagcccttagagtaacctgatgattggtgtcttccctttccccaaggaaatttctggaactaacataagatgttggtccttctggttctatattctctccctctctcttttttttttttttttagttagagacagagtctcagtctgttacccaggctggagtgcggtggcatggtcatagcttgctacgaccttgacctcctgggctcaagctatcctctcacttcagcctctcaagtagctgtgactacaggtgtgcgcctggctaattttttatttattttttatttttgagacggaatctcactctgtggccagactgtagtacagtgggacaatcttggctcactgcgacttccacctcccaggttcaagcgatttccagccaatttttgtatttttagtagaggtggggtttcatcatgttggcctggctggtctcgaactcctgacctcaagcgatccacccacctcggcctcctaaagtgctaggattacaagcatgagccaccgcacctggcctagttttttttttttcttttaaagtagagatggggtctggctgtgttgtcctggctgatcttggactcctggcttcaagtgatcctcccatctcggcctcccaaaatgctaggattacaggtgtgagtcactgcacccagccaggttccattttctctatattgactatattgacctttctttcatacttgaaaagcatttggggataatcttttaattttgttttctatttgttttttctgtgcccattttgctgttaaatatatctgtcaagttttattttagcaattgttttttctcttttataacagcgtctttaatgttgtaatttacatacaataaactgcatccatttaaaatatacagttccatgagtttcgacagatgtgtatagacacacacacacacacacacacacacacacacacacacacacacaccccttttacccccaaacaagagttgggttaccagagtttttccctcctcctgtgcagtccaaccccagctctcaagcccatgatttgcttgctttcagatgtaaaaatgattagcttgccttttttttttttttccccctttttgagacggagtctccctctgtcgcccaggctggagtacagtggtgcaatcttggctcattgaaatttactcctcctcctgggttcaagtgattctcctgcttcagcctcccgagtagctgggattacaggcatgcactgccacaccgggctaatttttgtatttttagtagaaacgaggttttgccatgttggctagtctggtcttgaattcctgacctcaggtgatccgcccgccttagcctcccaaagtgctggaattacaggcatgagccacgacgcccggcttttttttttcttcttttcctttttttttttttttttgagactgagttttgctcttgttgcccaggctggagtgcaatggcatgatctcggctaactgtaacctctgcctcctggttcaagtgattctcctgcctcagcctcccaagtagctgggatttcagcgcgttccaccacgcccagctaattttttttttttttgagatggagtctcactccgttgcccaggctggagtgcagtggtgtgatctcggctcactgcagcctccatctcctgggatcaagcgattctgctgcctcagctttcttagtagctgggattagaggcatgtgccaccacgcccggctaattttttttatttttagtagagacgtggtttcaccatattggtcaggctgatctcgaactcctgaccttgtgatccggccgcttcagcctcccaaagtgttgggattacaggcgtgagccactgcgcccagcctaatattttgtatttttagtacatatgtttagtacatacgtacatactttagtacaatatgatttcaccatattggtcaggctgctcttgaactcctgacctcaggtgatctgcctgccttggcctcccaaagtgctgggattacattcttgagccactgtgcccggccagtttgcattttcaaaagtttcatataaatggaataatatagtatgtagccttttgtgcaaggtttcttttactcaccctatttttgagattcatgaatattaaatatgtagtagtttgtcccttttttttggttttcagagcattctttcccacaattaggaaattaacatggacaaactgtatttaaattttgccaattttggctgggcatgatgactcaggcctgtaatcccagcactttgggaggccaaagtgggaggattgctggaggccaggagttggagaccagcctggacaacacagtgagaccttgtctctccaaaatagctggcatggttgtgttcctgtagtcgtagttacttgggatgatgaggcaggaggattgcttgagcccaggagttcaaggttacagtcagttgtgattgagttgtgattgcactccagcctgggaaacagagcaacacgctgtctctaaaaataaaaataaaaggtgaaaaataaatagaaacagttttgcatggattcttttgtacgttgtttatttagttgtatataattttatcgtgttaatttttgcagccacacacatctggcaatcgttttttaatttttgatttttctctatggtagctttttttatggatgagttatgattttacctctgagaatatttttgattctgtttattcctgcaactctttcttcagatatttagtttctcatttttgtagtgtttatttcccttgtagtttttctagtttgtaaaagtgataatctctggtttgagaattcctgttcttctgccagtggattcagtgtctgtttaccagttggtcaggattgattttaggggaggtatgagatacgtggcaaaatatggggtaaaatgtctccttatttcttctgggtaatagcagccacctgagtgccatcctgattctggggctccagtgcctgtttccagtgaagactttgcttctgtcagtgttggggatagaacatggttattggtagagggagtggcctgtccacttgtgccaaacacatttccccaccatcgcttgtgactgcaccactgcaccagacctgcttttgtttccccatggtagccgccctgaacctacggcttggatagaatacccctacgttctctctctcaccttcatagctgatcccagttttaatagcattcctcttttgaggcttatgcatggttattgcctctgtaaacctagttctgctgctgctatctcttttttttttttttttttgagacggagtctcgctctgtcacctaggctggagtgcagtggcatgatctccgctcactgctccgcctcccgggttcatgccattctcctgcctcagcctgctgagtagctgggactacaggcgcccgccaccacgcccggctaatttttttgtatttttagtagagatggggtttcaccttgttagccaggatggtctcgatctcctgacctcatgatcctcccgcctcggcctcccaaagtgctgggattacaggcgtgagccaccacacccggcctgctatctcttcttgtttcccagaattattttagaaaataatatatcaaatatatcaataaacccacacccttttttttttttttttgaggtggagttttgctctgtcacccaggctgtagtgcagtagtgctgtcttggctcactgaaacctccacctcccgggttcaagcaattctcctgcctcagcctcctgagtagctatgattacaggtgcccgccaccacgcccggctaattttgtatttttagtagagatgggggtttcaccatgttggccaggctggtcttgaactcctgacctcaggtgatctgccctcctcatcctcccaaagtgctgggattacaggtgtgagccaccgtgcccggcctaaacccacatctttagtaatttctacgatttagattgggaggggaagcatgtacagatgctttttgacttacgatgtttatgctacattccataaacccatcagaagttcaaaatactgtaaatcaggctgggcgcagtggttcacacttgtaatcccagcactttgggaggctgacctgggtggactgcttgagcccaggagttcaagaccagcctggcaacatggggaaaccctgtttctacaaaaaatacaaaaattaggtgggtgtggtggcatgcacctttagtcccagctgctcaggaggctgagataggaggattacttgagcccaggaggcagaggttgcagtgagctgagattgtggcgttgcattctagcctgggtgacagtgagaccttacctcaaaaaagagaaaaagaaaatactgtaagtcaaaatgcatttaatatacccagcctattgaacatcatagcttagccaaacctaccttaaatgtgcttagaacccttatattagcctacagttgggcaaaatcttctagcataaagctagatgatttaataatgaataatataaaagataattattttacaataaaatgtcgaatatcttgtaatttattgaatactgtactaaaaataaaaaaaacaataaatacttgaagtagagtttctactgaatgcttattgcaccattgtaaatttgaaaaatcattactttgagccctcattaaattgggaccttccatatgtctgtgcagtccactttgatccaatctcttcaggccttttttttctttgagacggagtgtcactctgtcgccaggctagagtgcagtggtgcgatcttggctcactgcagcttctgcctcatgggttcaagcgattctcctgcctcagcctccggagtagctgggactacaagcgcacgccaccacagccagctgatttctgtatttttagtagagatagtttcaccatgttggccaggatgatcttggtctcttgaccttgtgattcacctgccttagcctccccaagtgttgggattacaggcgtgagccaccgtgcccagccctgccttttttttttttttttttttttgagacagagcctcactctgtcgcccaggctggagtgcagtggtgtgatctcagctcactgcagtctccacctcccaggttgaagcagttctggtttagatttcctgagtagctggtactacaggtgcacgtcaccatgcctggctaatttttgttttagtagagatggggttttaccatattggtcaggctggtctcaaacttctgacctcaggtgatccacccaccttggcctcccaaagtgttgaaattacaggtgtgagccactgcgcttggcctaaaggacattttgggaaccggtgttaatgtctattgaaaccttttatttttggaatatcagattttgaaagataaattgaccattggaggttatatgttacataggtttgggaatttcctgtttctagtttgctgctaaaccagaactctgaagtctcaatgtttttttttaagccgataggaaagagagattttcattctgaatctttgtttttcacagttgaggcttacgagtagtcatcttgttatttttaaaacacttcatagtgcggtttgcgcttgtctgacagaatggttgggttggctcaatactttgatatttttctttttcgtctttgccgtagtattttttttttaagttatgcatctaaatcaagacagaatcacatttctttgccccaaaacccttttgcctagaattatgttctttggaaaccctagcgtttgaaataagttgctactgtggtaagggtaaatttaattttcagaaaaaagctgttctgacttatttttcttccccatttagtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacagtatgcattttttagcttatatacaatttatggtaatttgattgttaaaaataatgccagtagcaagtggtgaaataatttccatctctaatggaacttgaattttcttgagtcaaatgaagattaaaggtacgctagtgataggagttggccatctagaggtggttgtctagttcagatgtatggacgacaatcagaaccactaaaagggtagcattttattgctcctttagtatgaaaaattagggcatctgctatacgttgaggaagaaactacctaaaaggaacatcattagatcatgaacaatgagattgaaatataattaaaatcatttcatgtcataaaattgttttcagtcttgtctaccacataatttctcttgtctccctcagttgtttgctggcatgttcactaactgaaaaaaataaggaactctggtcaaaagtggtgttttcaggctcagggctggtctgagatgggtgactgcagagccctcctctcccagaatgctttctgatgtgttctgtgctgcacacttaactggagtctcgccaccatgtctggcccctggggaatgctgccaggcgctctatcttgctttcattgagtgaacactggagaacattgtgagcaagaccttgaggctaggtcctttcagggtggatggtgggggtaggccggagaactgacaaatgaataagccaagatcctgaccgtcagggtgcaatacagattgaaaatgtcttcagtgactgactgtttttctgttgctaaatgagagaatattagtctgaaagagattctgcctttttgttttgttttgttttcttgagatggagttttgttcttgttcccaggctggaatgcaatggctcaacacaacctccacctctcgggttcaagcgattctcctgcttcagcctcccaagtagctgggattacaggcatgtgccaccacgcccggctaattttgtatttttagtagagacagggtttctccatgttggtcaggctggtctcgaactcctgatctcaggtgatctgcctgcttcagcctcccaaagtgctgggattacaggggtgagtcaccttgcccggcccagattctgcctgttattctgcatgtcttttagtagagatggggtttcaccatgttgtccaggctggtctggaacacctgacctcaagtgatctgcctgcctcggcctcccaaagtgttggaattacaggtgtgagccaccgttcctggcctcaactttttgactaacatgccttggagttcttcccacttcagaacataaagatcctcttcatttttgttttgttttgagacggagtctcgccctgtcacctaggttggagtgcagtggtgccatctcagctcactgcaacctctgcctcctgggttcaagagattctcctgcctcagcctcccgagtagctgggtttacaggcgtgcaccaccatacccagctaatttttttttttatctttagtagagactgggtttcaccatgttggccaggctgatcttgaactcctgaccttgtgatccacctgtctcagcctcccaaagtgctgggattataggcgtgagccaccgtgcccggccgatcctcttcatttttagttgctatacagtgctccataatacgaataataatttagtcattcctttattatttaaatggaattaattgattatgaaacagttcaaattttgactgctaaaattcccctccctcccaagaggctgtagctagtttagatagtgaaaaaaatcttaccttctaactggatactttcagccttttggcttcagtttgttaaataatgtgtggcctcttttgatactgctccaaagccttgagatggtcctctgtcacagtccttgtggctcccaccctgtgtcacaaggtggtttctgatagtgctgtggcctgagcttggtatcagccccattgtccctgtaagcagagatctgaatttctgtttgaaggttgataaatgctgtggttttttttttttgttttttttgttttttttttggtcacacttattcagctgctgcagtagtttctatgtagagtgtatttgggtctgtagtagcaggagtctgtctcagcactgtgtccctaggtttgctcctaaatctgttctgtaaagcatgcacaaataatacacatctgtgagtgcactttcatggttgtttcacgtagtggggatgccttattgaatggaatttttgtttctgttggcttattaaaaagtctgagtacattcttatttcattacagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactaggtaagttgtatataaaactcactgtttattcttagtatcctaacgggctgagttttcaggtattacatgtaactacaccttcaagaacctgttaggtgaaagtgtttctggattatgcaaacaaatgtttctctttgaaaattctgattttatgacctagttttctttaatctctactgttcaagatttattatcctaggtgtttcttaaaagatcacatcagcagactcattgtagcctttgccctcagatagtttatggtgtgcatacacaaagtagctaaagttattaggcagcatctgtaaggagaaggcacgggaaaggacctagctctgaaacctgtgtaaatttcatgcttccacacacatgtgtgtgtagaataatgatgtattctatgtatgtgatttagaagttgatatgtactgatcagtagaaaaattattgagggaaggtagtatgaaaagagaggattagccgggcgtggtggctcatgcctgtaatcccagcactttgggaggctggggcgggtggatcatgaggtcaggagttcaagaccagcctggccaacatggtgaaaccccatctctactaaaaatacaaaaattagccgggcgcagtggcaggcgcctgtgaatcccagctactcgggaggctgaggtgggagaattgcttgaattcagagggtggaggttgcagtaagccgagattatgccactgcactccagcctgggtgacagagtgagactccgtctcaaaaaaaaaagaaaagagagtattagggccaggcacggcagcttatgcctgtaatcccagcactttgggaggccgaggcgggtggatcaccagaggtcgggagttcgagaccagcctggccaacatggagaaaccccatctctactaaaaatacaaaattagccgggcgtggtggcacatgcctgtaatcccatatacttgggaggctgaggcagaaaaatcacttgaaccaggaggcaaaggttgcggtgagccgagatcgtgccattgtactctagcctgggcaaaaagagctaaactccatctcaaaaaaaaaaaatgaggattagatggaagaagagaatgtttcggcttaagggtcagaggtcacttcaggaaaaacaggcatctagggattgggataaacaatttttttaaaaaaacagttgtgatttaaatagaggagtaatttttttgtgacaaaacacgttgcaggaggagtatgtttgggggtgtactgataagccagggtgacaaggtgcttggatgagaatgactcagggaatgtacttggagaagggaaagggaggaggtgttagcatggccccaggcgtgtcaggctaatttgcacctgaggctcttcatacttggcagacagccagactgcactggggacatgggccctgtgttttgtactttgcatgttggctcacatgcatatgtaccttaaaggtgtatatcaggcaccttatcttttcacagacttgtttcctaccagtggcatttgcatgattgggttggatatgtgaatatggttttggggttcataaatgttaacttcttgttcttatttttaaaaatgttataatactgtgttaattgtttttaatcatagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaaggtaagggggcatgtgtgttctaagaaatacaggcgggccgggcgcggtggctcatgcctttaatcccaaaactttgagaggccgagatgggcagatcatgaggtcaggagtttgagaccagcctggccaacatagtgtaaccctgtctctactaaaaatacaaaaattagctaggcatggtggtgcgcgcctgtagacccaggtacttgggaggctgaggcaggagaatcacttgaaccctggaggtggagggtgcggtgagctccagcctaggtaacggagtgagactctgtctcaaaaaaaaaaaaaaaaaaaaaaaagacataaaataataatattgggcatattttttaaaaaagctctattgagatataatttacgtactataaagtcagctgtttgaagcgtacaatttagtggtttctagtatatttacaggattgtgcaaccatcactgtaatcccaattttaggacatttttatcatcctagaaagaaaccttgtgttcattagctacgactctccattccccccacagcccctgccaaacagtaatttattttcaatgtaggtttgcctcttctgaacatttcatataagtggtatcatacagtatatgatcttttgtgattacttcttcatatagcatatgttttcaaacattcacattacagtgtgaatcagtactttattcctttttattgccaaataatatttcttttttctgagacggcgttttactctttttgcccaggctggagtgcaatggcgtgatctcggctcaccacaacccccacctcccaggttcaagcaattctcctgcctcagcctcctgagtagctgggattacaggcatgcgccaccaagcctggctaattttgtattttttagtagggaaaggatttctccatgttggccgggcaggtctcgaactcaggtgatctgccgcctcagcctcccaaagtgctaggattacaggtgtgagccaccgcgcccggctgccacataatatttcattacgtggataatactacattttatccatttattggttgatgaacatttgggttgtttccattttttggttataatgttgaacatttatatgtaagtctttgtatgtatgcacacacacacacacatatatatatatatattttttttttttttttgagacggagtcttggtctgtcgcccaggctggagtgcagtggcgtgatctcggctcactgcaagctctagctcctgggttcatgccattcttctgcttcagccttccaagtagctgggactacaggtgcctgccaccacgcccggctattttttttgtatttttagcagagatggggtttcactatgttggccaggatggtctcgatctgctgacctcatgatccgcccgccttggcctcccaaagtgctgggattacaggcgtgagccactgcgcctggcctgcacatatatttctaattctattgggtatatacctgagagtagaattgctgagtcatatggtcacttaatgtttaatcttttgaggaactgctacactgttttccaaagtggcagtcccattttacaatcttagcagtttatgagcgtttatatttcttgtcaacatttgttattatctgtcttcttggttttagttgtcttaataggagtgaagtgatatcttgtagcgtttttattttttaagaggcagggtctcgccctgttgcccacatgagagtgcagtgttgcgatcataactggctgcagcctgtgtctcctgggctcaggtgtttctcctgcctcagtctcctgagtcactaggactacagctgtgcactgccttgcctaattttttttttgtagagatagggtcttgctatgttgcctaggctgtcctggcctcaagtgatcctcccaccttggcttcccaacatgttgggattacaggtgtgagccatcactcctggctgaacattttttttgtgtgtgtggcagggtctctctctgttgcccaggctggagtgcagtgacaccatcttatctcactgaaacctctacctcctgggttttagtgattcttctgcttcacctcgcaagtagctgggattacaggcacacctgtaaattatgccaacatgcctggctaatttctgtaattttagtagagatggggtttggccatgttggccaggctggtctcgagctcctgacctcaagtgatccacccaccttggcctcccaaagtgctgggattacaggtgtgagccactgtgcccagcccgaacatcttttcatgtgtttactggccatctgtctgtagtctttggataaatgtctgctgaagtctattgctaagtttttagttggattgtctttttattattgagttctggatacaagtcccttattagatacataattcgcaaatgttttgtcccattttgttagttgtcttttcacttccttgatggtgtcctttgcagcatggaaattttaaattttgatgaagttaatcttatctatcttctgtcacttgtgcttttggtgttatgtgtaagaaatctaagatcatgaagaattgcctaatttaagatcatgaagaattgtttattttcttttaagagttttatagttttagctcatatatatatatgtgtgtgtgtgtatttttttctttttttcttttttgagatggagtcttgctctgtcaccaggctggagtgcagtggtgcgatctcggctcactgcaacctccacctcccgggttcaagcgattctcctgcctcagcctcctgagtagctgggactacagtgcgtgccgccacacccagctaatttttgtatttttagtagagacagggtttcaccatattgtccaggatggtctcgatctcttgacctcgtgatccgcccaccttggcctcccaaagtgctgggattacaggcgtgagccaccacgcccgccagttttagctcttatatttagctcttatatttgatccattttgagtaagtttttgtgtatggtgtgaggtagagctccaagttcatttctttttgcgtgtggatatccagttgtcctagtaccatttgttgaaaagatgattctttccctgttaaattctcttggcccctttgtcaaaaattagttgaccatagatgtttgggtttactcctggactcttaagttatgttccattgatatatatgtctgtttttataccagtaccatactgccttgatactgtagcgttgtattaagttctgaagtaagaaagtgtgagtcatccaacttgttcttttttcgagattattttggctattctgggtaccttgagaatatgaattgtagggttaacttggcaaggtctgtaaataagacaactgggattttaatagagattacattgaatcttttggccatcctaatacaaagtcttctgatccaaaaagatggaatgtcttcccattgatttagatctttgctttctttcagcagtgttttgtagattttattgtacaggtgttaatacttttgttagatatatccgtaagtgttttattctctaatgctattataaatgaaatcattgtctccattttgagatcgtttagaagtacaattgtttttcgtatattggggcacatggcttttactaatagaaaaatcatatgtatacatgcttgtttactaagttttaggcacttggtcaatgctgttgattttctgtttgtaacatttgctcgttggtcatcacttccttttctgattggaaaattattgtagcagttctgctgagcatgtactttgaagtactttatcttctagggaaacctgaaattcttaagcagctcactctgggactcagctgtctgtgctttactctgctctgatagagcagtttaccagatgtgcatgtggccatctgagtggaacagctgtgcagttgagatgaattgctgttagaggtgttgtcctggaactgtctggttgcaggagcaatggtgccttccagtgcatctgatgagattctaactgaatatgtgaatatctggtatccaagctagatttcagtagaaaccgcagggaaagctgtctgctcatttagaatgttggagggctctgtttgaagtttgcatttctctttgaacagatgctccattgcaaaataaaaggtttgaagatttcaacaatgttgccctaaaagctaattttatttcaataaagtaacattcaagttctgttgggctttgttgctgttggtttagcaatgggattttttttcccccatcacagctttggaaacatgatgagcaaggagaagcgagaggctgtcagtaaagaggacctggccagagcgactttgatcaccatcaccaacaacattggctcaatagcaagaatgtgtgcccttaatgaagtaaggggacatggatttctttaattgctctaaggaaaatactgaacttaagtgggccccatcacgtctgttttctcagaacagtgcctaaatgtagtcatttggggtggggtttgttttagcacgaagttaaaactcttcaaatacagattaatcttcttttttttttttttaaactgaagataaacattgctacttgtctagaggtaaaatgacatcttttgaggagaaagtagaggaagagtggaaggtagccagtgttccagatattggggactgttgggggtgatgatggataacgatgctgaatgtagactccacactcactgctgagctctagaggccctagggaggaatccagaggaagtcacggaagctgggagaagactgagcaggccgaggggtgccctccttggctcccccacctcagcagagctgcgtctttgtgctttcagcttctttacagtgctgccttgtagcattcaggtcaagcagcattgtacagggctatgaaagaaccaagaatgggctgcccttgggaaaagaggatctaggatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcataacttcttttttctttattgtatgttccctttcctgtgcttacgtattttcagaaattttagttggtgtgcataccacaatttgtattttatacttaaatatacatttcatggttgtatatttatttgatcaagttcttttatatcaaataacagagcttggcatttggttgcttgctcataactcggcagtaagcatttttaagcatgaagttattctttggttgaattttattcttgatatggggcttaggagtgagatttctggtctacagaaatgatcatgctcatgaattttgacatttatcgtcatgatgctttgcacaagggctgcaccaatttagatcatctttagcggtgaatgagtggattaattttactacaactactgatggtggtggtggaatttcagttgcttttttttgcgaggttaataggtctaaaattttacttttgtttgatgactagtggtttgaatttttcgctgcctgttatattgcttgtatactttgcctgtttgtgtcactgtccttttggattggagtcatactgtttttttttgtttattttaacttatctgtataaaacattgtattcaaaactagttattgttggtcagatttaatacaaatgtttttcctaatctgttttcttctcctgtgacattatctagcatgctttgcagtgggtccagagttgtctggggatcaagtttaagtagccctggaccaactggactaaatttgatcagcagtcaaattgttgctaagagctatgcacatggtgctgtatttggggtagcttttatgagaaaatagaaattaagatgaaaactaattgcctttttttggtgtgctcagaacattaaccaggtggtatttgttggaaatttcttgagaattaatacgatcgccatgcggcttttggcatatgctttggattattggtccaaggggcagttgaaagcacttttttcggaacacgaggtaagctgacttgttcgttgtggtatattatgtacacagagggcttgtgggtcacactgtcatggaacttgaggtagagggtggaggtgaaatgggctgcagtgtttcttttgttttttgtttttttgagacggagtctcgctctgtcacctaggttggagtgcgtggcacagtcttggggctcactgcagcctccgcctcctgggttcaagcagtcctcccacctcagtctcttaagtagctgggattacaagtgtgcgcccccacaccctgctaatttttgtactttcagtagaaatggggtttcaccatgttggccaagctggtctggtctcaaactcctgaccttaagtgatctgccagcctcagcctcccaaagttccaggattacaggtgtgaaccactgtgcctgaacttttttggtagtttaatttcgtaacatttgaaagctgtttcttccctgatactaatgcaaggtaaattttgggttaatttaattgtaagcttaaggaattttagagaaaaacccttgaacattcccctatatttctgatgccatatttttgtctgaactatcctctatattttttctattgcactgactgtgtcattactctgggttctggttttttcatttttttcagtgccagtttttatatattgttgtaattcttgtgccagttatttaagatgcatgttgtaaaaatgaatagatgagtaaacctctcagactagaaccatactatcataagaacttaagtacaattgtagacaggctggaaatgatgaaatggaaaagaatcaaattgctcaacctcatagcctgtcttggaaagcactcttatttttcctatttggggaaaaagaagcagaggtatggaaaggcgtgtaggggttctttcttcccttcttggttgtggggcagttgaactattctttcaactgttcttggattttagatactgttattatgaacatttttcagaattgtattgcatatttagtttaacagtctatatgaattaaaggaaatcaaagtccagataatagcacagatttgaagtgctagagattactttttcctttaaagttactttaagtttttctttttaaattgctttagttcatagttgaagtccaaagtacacaaatccccatatcaaaaagcttaaaattgaagtcatctaacttagttttaaaattctaacattactgtatttgtaaaccagcaccgaattgccattaagtttcttacagttcatgtttctgtatacatctttttttgtgatctgacttattttattttgctttatattagaattttttaaactcgaatgttagatctttttctgctttatttctgcctcttgtttaaccttttcctaggtagaacatggagattagttttttaagttaaccttaaaaaaaaaataggctgggtgcggtggctcacgtctgtaatcccagcactttgggaggctgagatgggcagatcacctaaggtcaggagaccagcctggccaaccatggtcaatgtggcaaaaccctgtctctactaaaaatacaaaaattagctgggcgcaatggcgggcgcctataatccccagctactcgggaggctgagacaggagaatctcttgaatctgggaggcggaggttgcagtgagctgagatcgcaccactgtactacagcctgggcaacagaacgagactctgtctcaaaaacaaaaacaaacaacaacaacaaaacaaacaaaaacaccaaacaggccaggtgcagcggctcacgcctgtaatcccagcactttgggaggccgaggtgggcggatcatgaggtcaggagttcaagaccagcctgaccaacatggagaagccctgtctctacaaaaaatacaaaaattagctggacgtggtggcacatacctgtaatcccagctacttgggaggctgaggtgggaaaatctcttgaacccgggaggcagaggttgcggtgagccgagatcgcaccactgcactccagcctgggcaacaagagcgaaactccatctcaaaacaaaaaacaaaacaccaaaccgatatcatcataatagttataagccttcgtgaaattcttggttgcattttgtccttattgctcgctgactttgtttttcccactgcttagctttgctggtccatttgtccctgtgttttccatttgcattcaggcctttgactcttgtgtgcatctctgcccttgtggaactttgatgattattttattttatttttttatttaagttctaggatacatgtgcacaacgcgcaggtttgttacatacgtatacatgtgccatgttggtgtgctgcacccattaactcgtcatttacattaagtatatctcctaatgctatccctcccccctccccccaccccatggcaggccctggtgtgggatgttccccttcctgtgtccaagtgttctcattgttcagttcagaactttgattattttagcctctctgagccttgaaatattttcttgccctcacattgaagtcactttaacttttgttgtgaaagcttcgtatagattctctcaagcgtttcctctttgatcctttattctcatcttagcacgttgtagtttataaccacctgtttctgtcttgatagtagcatcctagtcttcagtggaccccccccatatatatatataatggttaactgtatcttctatatttttattataaaataaaaggtacagaaagctgcctaaaacaaactgtatagtgaactattaagacaaacagccttgcctctgtatttcagctgtgccttgtcctgtagctgctggccgcctcacatcacagattggtgtggctgcctttattttatttatacacaccaaaaccaaagatggtcaatatgcctttcttttttttgttttttgagatggggtcttactctgtcagccaggctggagtgcagtggcgcagtctcggctcactttaacttctgcctcctgggttcaagtgattctcttgtctaagcctcctgagtagatgggactacaggcacgtgccaccgcacctggctaatttttgtatttttagtagagacacggggtttgccatattggccaggctggtcttgagctccagacctcaagtgatccacctgccttggcctcccgaagtgctgggttacctgtgagccactgcgcccagccaatatgcctttcttttaaattgccaactagagtgtgacaagaaagcctttggcctctcgtttgatcaggtttcttgaagaagcttttcgtgaaagatagagtggtagttatttatgtttcagagacttttaaaaaatccatacacaagtctttcaggatcttctcattccttttttagttatttcttttaaaaagtagtctgatatcttaccttacaggttggagaccctgatggattctgcatcgttttaggatttgcctctgattcttgctagtgttctcttttctgtcattatggggtttgccccgttttctctaatgtgctattcctgtgttttggttttgagttcttggttgcatgtgacctgactgcttctggagacagtacagtgcttgtcgtctctcagctgctgcttctgtgtctcaggagggctgagggctgccctccctcgggagcctccgtgcttcctcaggctttgctctttgttctgtacctctcttcacgttacctttgggtggtggttttcattcctgtgccgcctgcttctgggccagtgatccaggtgtctggtgaccacccgggcacagctgcttggctgctgtgggcacctcagcttcccatgtcctgtagggaactcacccaccggccttgctctccacacctcttactcctgtgtcccctttctcggggatgctgccccctcctgctgtcctgtcctctgttaggggtgaatcttgaatccatcttatctcttactctccctccctctcccagctcagtcgggctctcaccctctgtgacccacctcacaacttcacctgtttcattgcactttgcatccgacctcgccttcattccttagttgtctggaaatgctccaggcctctgctgcttctcacctcattccccagaaacagtcaggttctgtctcttaccagaggtaactgagctgctgctggcctcatagctcctgtcgccctcactgcgggtttggttttcctcttatcacagtggtctgaagtgcttggatagtctaggacatccagccccctccccagacagggactccttagggcgtctctgctcccaggctggccttggcccttctggggtgctcaggaaatgggtatgctgtgtgtgggcagtggttggctttaacactagtcatcatgtgtaaggtgatttgaataagtctaaggaaaattgcacttatttttggtgtattttctttcagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggca

SEQ ID NO: 2718 - DNA, 34762 bp, Homo sapiens
ggggtggatgaggaggctcgggcccttccacccacgcgtccattgggcggcgccgccatcactctcttctgggctacaccgccttctcttcctccgcggaacccggatcccctcctccaccaccctctccccgccccgtcacgatagcctctcattggacggaggcacggtcaatcctcctcgagttagggagccgactggacgcgaggcctttgggccgtccccagcctcgtcggattggcttcctgcgcgttggcgcaacggaagaggcggccggccgagggcgcgcctctgctctggctggactgccgcggaggaggcgagaaggaatccgacgctggggggcttgctcgggcggcagcgactgctgctgcggatgggagggggccggctcggcgcgcccatggagcgccacggcagggcttccgccacctccgtctcgtcggctggggagcaggcggccggggaccccgaagggcggcggcaggagccactgcggcgccgggcgagcagcgcgtcggtgcccgcggtcggggcctcggctgagggcacgaggcgggatcgactgggctcttacagcggccccacctcggtctcccgccagcgcgtcgaaagcctgaggaaaaagcggccgcgtaagtgttccgtggggcgccctcccggcccgccctgcccccccttccggcccaccctgtccccttccggccccgccgccgtttttcccgcgcgcggacactgtccccgcacggtggtccctcgttggtgcgtggcctgacatccggctggaggcctcgggtgctccgaaagcggtaccttcgggggcccccccgcacccattggtatgcacttcccgcttgttggagtggagggcttttccccaggacctgtcctcccttttcttagctccttgggcattctcttcctgagggtcacatgattttatcctcgagaaggcttcttttgactcatttccacctcctttcctcccaaatcctttgaatccccaatgtttgttttccgtgggtttccaaagagctgctctctaatactttaagtcccttttattcgtcaatttcgggcttactggaaaatggtgaactgccccttgagttgcaccaggcctgaaactgtattccgtgcacctctaaggtggctgcccttcttctcgtgagaatccaggtcatctctcacccacatatcccctccgttttccttctgtctatttgcaggtactcacgattcagaactgtggcattctgggcattaaggctctttgttttgaggggaaacaacatctttctgaattttgccttgggagttgcatacgctcctcccagagaatccgtttccccattttattaggtttctttttctgtgttgtgtattttctcccctttacaagtcttcaattcaggaccgctgcctggcagccattgctgctgttgaaagtatcaattgtcctgatactgtaatatgagctttacagtgtgatgccattttacatatggttggactttttggtgggtgttgccagattcctatttcaggaaattgacttgtttaaatgcagattgtgagagggagggaaaatggcaagatgtgagatttttattgaatagtcttctaccttagcccagtcacccaactgcttttttgaatcttctctgatatggatgattaaatgtagttctattttgctgtgaaaagtttgggagttttcagttcttttgtctttttccatcttcttgcaacagatttggaaaacagattcttaacctgtgccattttcagagtcagtcacctagttttgttttatttgagaagcacctgagtttgaagcaatgcaaaatatgagatccttcatggttttgtattacatcgttggaaatggatgtaaattccaaagattcagcaaataagagtatagccattagccacaagggtttttttggtttgttttttgttttttactttgagacagcgtcttgttctgttgcccaggctgaagtgcagtggcatgatcatggctcattgtggccttaacctcctgggctcaagccatcctcctgcttcaacctcctgcattgctgggactaaaggcacgtgccactatgccaggctaatttttcaatttttatttttttaaatagagatgggatctcttatgttgcccaggctggtcttgaattcctcctggtctcaagcgatcttcccacttcggcctcccaaagtgctgggatatagacgggagccattgtgcccgacctggcagtcgtctactaagagctttggtaactcattagcctcgtggctctgaggtaggtggtagtattccattttacagatgagaaaactgggacacgtttgcccggtcaaatggctagtgcgttgtgaaatagaaatgtaaactcagaattgctagcttcatagcttttgcggtggaccactgtgtttttctgaattatttacgttctgttagttatttcttcattgctctaagaccaagcataagtttgatcttttgtgttcaagactgacttacttgaggcgaaaatttttagatactgtggaagtacttccaaatattgagcatgagaatgacctggtaaaagtgcagattcagtgggcccagttaagctcctcatattcaaatacaggtgactcaaagaccacactcagaaaaaccggtttacactgggtggggagaattatattaaggtagttttgaaacttattttagggaactaagtagacacatattcatgctataggatttatattttgttttgatgtttgatgtttgtcgtgattcccttcattatcttctctggctgataaatcatgaaaacccatctttccagtataagacctgctaaaggaatgaacaggatactgattgttcttccttccatttgtttcttctgtactatctaggggtgcccctgttaggtggagaagcaggctgggcgcagtggctcatgcctgtaatcccagcactttgggaggccaaggcgggtggatcacctgaggtcaggagttcgagaccagagaccagcctggccagcatgttgaaaccccgtctctactaaaaaatacaaaaattagctgggcgtggtggtgcatgcctgtaatcccagctactcaggaggctgaggtgggagaaacatttgaacctgggaggtggaggttgcagtgagccgaaattgtgccagtgcactgcagcctgtatgatacagtgagactcctcaaaaaaaaaacaaaaaaaaaggagaagcagcttgttgactgccgaaccctcctagagtatacttcagtcttatctctgagagaattcaactaagactaaatcttttttatttattgttgggaggtttgggtatggaatggtgccacctttctggtgaaaccctatctctactaaaaatacaaaaaaattagccgggtgtggtgacgcgtgcccgtagtcgcagctactcgggaggctgaggcagataattgcttgaacccgggaggcagaggttgcagtgatcgaagatcgcgccactgcactccagcctgggcgacagagcgactctgtctcaaaaaaaaaaaaaaaaaagccttactctgataccgcactacttgtctaaaggtgcagatagatactagttgtcatttgaaagtcgaaggagctattcaggttatcttaggcattcttgtggtcctggttgtagtcgtgttctgtcacgcgtttcctagagcagtgtagttcccaaaccggcccttgtcccagacttactgcatcagaatccctagcgatgaggctaggcatgtgtatatttaagttcttcaaaagttttgcatcaggtggggaggggggtatgtctcgcagggctgaaagaaataccaaataaagattgattttaaaatgatggaaaccaagacgctaatgatggtaatgtagctaccattttctgagtgcttatttgtcttggacactatgccgagtattttataagcatcttggttaagtctcatagctatcctgtgaggtaggtgttttttatccccaatttccagatgagaaaacaggctcagtgaaattgtccttttgtccaaggccatatagtgagttagtgatggagttgggttttgattcctggtgtcttgacttcagatccagtgttcttggtccacattttggggtgggggaaggtatgtgtgatgtaatccagagctgtggttctcaagtttttaaaactttccctcaacctaccattgcatgatataggtctgcaaaggggtctaaaattatattttaaattttattgaggcataattaaatagagtaaaatgtacaattttggcaaatgtagacactcatgtaacaagagaacatacatttttatcaagggctccaggtgttgagcatatgtgcagcaggtgtgcagaaggtgtggaagccctgtgatcagagtgctccacagtagtgtggacaacaaacttatcctttgaagatgactcgcaaggcatgttgtagcatgccagggagacctttggggcttgttgattttggactcctacaaatctaaccttcataatacagtttttgtttgtagcttgacaacactagcctagaaaatggatcattttttcttggctttccgaggagcgttgctgttggcagtatggaactggagccggggccctgttaggctgcctttattaggctcagcatttcagcttcagggaattaggacggattgacccctgggagctgaggaaaaatgttagattgctatagctttgtggcccattgggagaggcaagatgggagttttttttttgtttgttttttgtttttttttttttttttttagaggagtttcactcttgttgcccaggccagagtgcagtggtgcaatcttggctcactgcaacctctgcttcctgggttcaagcaattctcctgcctcagactcgcaagtagctgggattacaggcatgtaccaccatggccaactaattttttgtgtttagtagagatgggatttcaccatgttggtcaggctggtcttgagctcctgacctcaggtgatccatttgcctcagcctcccaaagtgctgggattacaggtgtgagccaccgtgcctgaccgaaaagatgttgtttgtttgtttgtttttgagacagtttcactcttgttgcccaggctggagtgcaatggcgtgatctcggctcaccacaacctccacctcccaggttcaagtgattctcctgccttagcctcccgaatagctgggattacaggcatgcgctaccacgcctggctaattttgtatttttagtagagacaaggtttctccatgttggtcaggctggtcttgagctctggacctccggtgatctgcccacctcagcctcccaaagtgctgggattacaggtgtgagccaccgcacctggcctgaaggtgttttttaacctattgatttatcaactttttatttatttatttatttattgagacgaagtcttactctgtcgcccaggctggagtgcagtggcaggattttggctcactgcaacctctgtctcccaggttcaagtgattctcctgcctcagcctcctgagtagctgggactacaggtgtgtgccaccgtgcctggccagtttatcaactttaagtggaaccaaagtaaatacagcctgtcttcttagatatataataaatactaagcaataagcagggactaaaaatcgtccccttatgcagctgtgtaaaatggtacagtatattactttaggggccatgtgtaagaatcatgcagttggataatatggttgtttagtgttggtgtccctgccttctatctggggagaccatagcaggaagagatgtatgttgttaaaaatattttgctgactgtgtatgctggctcatttctgtaatcctagcactgtaggaggctgaggtgggaagatcacttgagaccacgagttcaagaccagcttgggcaacatagccagacctcgtctctccaaaaataaaaagggcatgcatggtggctcacacctgtaatcccagctactcaggacgctgaggcaggagaatcactcgaacccaggaggtggaagttgcagtgagccgagattgcgccactgcactccagcctgggagacagggcgagactccatctcaaataaaataaataaataaataaataaataataataaacaaattagcagaatgtcgtggcacatggtcgtagtcccagctacttgggaggctgagacaggaggattgcttgagcccggaggattgcttgagcccggaagattgaggttgcactgagctatgatcatgccactgcactcgagcctgggcgacagagggagaccctgtctccgtttttttttttttctttttttttttctcaaaacatttcaaaaaataggaggaggaagatagactaggctattgtagagcatcaggcaatgaaaagaatggctattttgattatttaaaagagcggtgatgttttttggacttaaagtttgtagccttgtgagcttttctcaggttcataatttggggtatcttcaggcactgttcaggtaagactgactgggatgtgaaaacttttctaaattgcggcttaaagtttgctttctaaaaatgaaacccatctcagttttttagtagttcgttacattttgtgtgtttatatttcctgaatgtagaatttgttgttgaatttgctgattttacggtatgtggtcttttataagtatctagtccctgagtttaaaactattttgggaataagaataattattaaagtacctctttcaatgttaggccaagatattgctttcctagaacagcctagacatggatttgcgatgtcattaaccatctgtggtctggtaaaagtgtagttcataatattggaaaattgagcacacttttaaaagtaaactgtgtgtttctttttttttttttgagacggagtcttgctctgtcgcccaggctggagtgcagtggtgcgatcttggctcactgcaagctccttctcctgggttcatgccctttctcttggctcagcctcctgagtagctgggactacaggtgcccgccaccacgcctggctaattttttttttttttttttttttgtatttttagtagagacggggtttcaccatgttagccaggatggtctctatctcctgacctcgtgatccgcctgccttggcctcccgaagtgctgggattacaagcgtgagccaccatgcccagcctactgaactatgtatttcccattggaaagtgtgatgttgtgaaatatatatattggtcttttgcccatttcctggcatacaactcctgaaatccttagaaactccacagtgatgtccttttgtgtgctaaggagttaactgatggctggaagcctctggacttagtcatggaaagaacaagacaggattagagggttgggactttcactcctctccagcctctggggaggggtgggggcttgaaggttaagttgatcaccagtggacagtgatttaatcaattatacctactaatgaagcctccattaaaaacccaggaggacagggtttggagagcttctggatggccaaacaagaggttccaggagggtgcagtgcccgagagcacagaagttccgtgtccctcccctatactgtgtactatgcgtctcttcctctgaatcttttgaaatatctttataataaaccagtaaatgtgtttcttaggttctgtgatccagtctagcaaattaatccaaaccaaagaggggtcatgcaaactccaacttgaagccagttgatcagaagttctggaggcccagattggcaactggtgtctggcagaggtgtggtggaggagcagtcttgagggacttagccctcgacctgtggcatatgatgctatctccaggtacatagtcgttggaattgcattggagggcacccagctggtgagtgctgcagaattggttacttgctttgtgtgtgggctcacagaagtcttctgtgttgatcgttgctgtggtgtgagagcagaggaaaaactttgtttttccacactcttaaaggatttcagtcgttgagacctattatgggaccttgtgctttgcatacgttttgaaatgtggcctaagtcaagtataggttgtctagactgagtaccttggaggtcttaatatcaggaaatatgttaagggctgtgaatagactgaaatatctgaaaattaatggccaggactcactaactagaaggcaggggccttctcttatcagtgagctctaggctggatgtgttagctcacgtctgtaatctcagtactttgggaggctgaggcgggtggatcgcttgagcttaggagtttgagaccagtccgggcaacatggtgaaacctcgtctctacaaaaaattagctggttgtggtggcctgcacctgtagtccagctacttgggaggctgaggtgggaggatcacttgagccagggaggttgaggctgcagtgagcctgaacctggtgattgtaccactgtactctagcctggatgacagagtgagactgtgtctctcaaaaaaacaaaaacgaaaacaaaacctgggtgcagtggctcacgcctataatcctagcactttgggaggccgaggtgggcgaattagttgaggttacgagttcaagaccagcttggtcaacatggtgaaactgtctctactaaaaatatgaaaactagctgggcatggtggtacgagcctgtaatcccagctactcgggaggctgaggcaggagaatcgcttgaacaactgggaggcggaggttgcagtgagctgaggtctgtcgctgcactccatctgagcaacagagcgagactccatctcaaaaaaaaaaacctcttggttttaattggttatattggattttgttttttggaatctgttgagataatcatgatttttttcccttcatcttactaattggaatttctaatgtaaaagccattgctgcattactgagaagaatctcttttggctatggcctattaattttactgtacaactagattccattttttattttattatttatttattttgagatggagtctttctgtcacccaggctagagtgcagtggcacgatcttggctaactgcagtctctgcctcccgggttcaagcaattctcctgcctcagcctcctgattatctgggattacaggcgcccaccaccatgcctgactaatttttgtatttttagtagagatggggttttaccatgtcggccagactggtctcgaactcctgacctcaggtcatccactcgcctcggcctcccaaaatgctgggattataggcatgagctgcctcgcccttaggctttcttgctgagtatatttaataaatatgtaaggctagatgtttccgtttaagtactactttgggtatatcctattggtttctatatattgtattctcactgtcattcatttaaaaataaattttgttttgatttcctttttaatcccagagttaatagtttaaaaatttcaaagtagatagatttatttctttgtttgttggattaatttctaattttgaagttttgcagtaagtgaatgtgacttgttctttggaatttgaagttctttaagctagtgcagttaatttttgtgagtgctttatgggtttttaaaggaatgtttgcatggttttgtttgttttgggaaacagtcttgctggtcttgagtgtttttttttgtttgtttgttttgggaaacagacttgctgttgtctaggctggagtgcagtggtgcgacctcggctcactgcaccctctgcctcccgggttcaagtgattctcctgccttagcctcccgagtagctggaattacaggtgcccaccactgcacctggctaattttttatatttttagtagagacggggtttcaccatcttggccaggctggtctcaaactcctgaccccgtgatccacctgcctcggcctcccaaagtgctgggattacaggcgtgagccaccgtgcccagccgggtttttttttttttgagatggagtctcgctctgtcatccaggctggagtgcagtgatgtagtgtaggctcactgcaacctccacctcctgggttcaagtgattctgctacctcaggctcccaagtagctgggattacaggcatgtgccaccatgcccggctaattttttgtatttattggagacggggcttcaccatgttagtcaggctggtctcgaactcctaacctctggtggtccacccatcttggcctcccagagtgctgggattacagatgtgagccattacatccggctgttttttttttttttccccagagttctatttgtgtttactagatccaccttattagccatgatattaaaattctctttctaccataattttgtaggtgtgtgtgcaatctacaaattcctgaggtctgtgtcattctcatactgacttgtagatgtgtcagtttctctgttagtgttttcgaagtatgtgttatgtgcataaggaacatggctattacattcatcagttgtacttttttttttttttttttttttgagatggagtctcgctctgttgcccaggctggaatgcagtgctgcgatcttggctcactgcaagctccgcctcccggcttcacaccattctcctgcctcagcctcccaagtagctgggaccacaggcacctgccaccatgcccggctaatgttttgtatttttagtagagacggggtttcaccattcacaggatggtctcgatctcctgacctcgtgatccgcctgcctcggcctcccaatgtgctgggattacaggcgtgagccactgtgcctggcccatcagttgtactttttatgcacatgagagagttttttttttgtcccttcttaatgcttttttgtttgtgttgtttggtctgctagtattgtatctgcttgctgttaacatttgcttgatacagtggagtagcattctccaggcatttattttagtcatttaaattcaagtgtataaattcagcaagtgagttaagtgaatggtgccagcgattctacccagtgtttccgtcagtaactatatgattatgagtgagtatagggatgagaatggtgactctcctttcccctgtagggaaaggaaggggcgtgattgtctggaggggcacctcttgtaatgtgagcatagctctttgccaaatgaaacactggtcttgaaacaaggtatgacctttactgtactatggctcttaaatgtaaatcagctgctctatctagtattcatctctagtgaggtgcttaagagtgcttaacatttttataatgtgtaatacttttgactaaatgccattttcatctttcaaagcattcaactcctcctcatggtgtgactccattgtgggtgatttaccatttttccttcagtttacttgtataatcttgtttgaggtatctttttacatcaacatatacttgaatttctccttttctctcctaattcctggttaagctcacagaatttcctcttcagtctagaagagaaatttgacctatttgtgattactgataagtgcagtcattcccatcatttatttatttattaaattatttttaagttttttttgagatgaagtcttgctctgtcgcctaggctggaatgcagtggtgcgatcttggctcactgcaacctctgcctcctgggttcaagcgattctcctgtctcagcctaccgagtagctggggttacaggtgtgcaccaccacacctggctaatttttctatttttagtagagatgggggtttcacgatgttggccaggctggtctcgaactcatgacctcaagtgatccacctgccttggcctcccagagtgctgggattacaggctttattatttatttatttatttatttaagaggtaggatcttgctctgctgccaggctggagtacagtggctgtatcacagctcactagcctcaaactcttgggctcaagcgatcttcctgcctcagcccctggagtagctgggactacaggtgcacgtgatcatacctaaatttttttttagagatgtggtcttgctgtgttgtccaggctggtctcccaactcctggcctcaagtgatccacccaccttggcctctcaaagtgttggaattacaggcatgagccaccacacctggctgttttgtatttactgtacttttccccatttcttgtcaatcagcttttttgaactgattgctttattttttttctaatgtgaaagtcattttttttttctcctctggagttacctctaaattttgacacatttaaactatcacttctatattcttgtgtagaattaatcagaatctatcttttcttcccttttccaacaagacagaactgctgcttgctttcatttccttctcccttctcttccctcttcaacttcctatgtcgaaatcatgtaagtattttagtttcagattgcttatttttgtaaaagtcagtacttttgtttatttcttaaagctcttggattaaaaaaaagtttcttaaagctcttggatgttttaaaattatggcattcatctaccaattatgttagagaaggtctttgaaaagtaaagttgatcccttacatatgtgaaaattgtttttgcactcccgcttgaaagcttatttggttggctggatataagtttcaaaatcattttccttataactttgaagccagtgctccgttgtcttctggcatctgtgctgctgatgaaaagtctgatactgacttttatgtgatttatgtatctttataggaattcagttttttccttatgatatcttgaaatttcaataggatgtgtctaagttgtcttccccttctctgctgaccgataaacactgttcagcccttagagtaacctgatgattggtgtcttccctttccccaaggaaatttctggaactaacataagatgttggtccttctggttctatattctctccctctctcttttttttttttttttagttagagacagagtctcagtctgttacccaggctggagtgcggtggcatggtcatagcttgctacgaccttgacctcctgggctcaagctatcctctcacttcagcctctcaagtagctgtgactacaggtgtgcgcctggctaattttttatttattttttatttttgagacggaatctcactctgtggccagactgtagtacagtgggacaatcttggctcactgcgacttccacctcccaggttcaagcgatttccagccaatttttgtatttttagtagaggtggggtttcatcatgttggcctggctggtctcgaactcctgacctcaagcgatccacccacctcggcctcctaaagtgctaggattacaagcatgagccaccgcacctggcctagttttttttttttcttttaaagtagagatggggtctggctgtgttgtcctggctgatcttggactcctggcttcaagtgatcctcccatctcggcctcccaaaatgctaggattacaggtgtgagtcactgcacccagccaggttccattttctctatattgactatattgacctttctttcatacttgaaaagcatttggggataatcttttaattttgttttctatttgttttttctgtgcccattttgctgttaaatatatctgtcaagttttattttagcaattgttttttctcttttataacagcgtctttaatgttgtaatttacatacaataaactgcatccatttaaaatatacagttccatgagtttcgacagatgtgtatagacacacacacacacacacacacacacacacacacacacacacacaccccttttacccccaaacaagagttgggttaccagagtttttccctcctcctgtgcagtccaaccccagctctcaagcccatgatttgcttgctttcagatgtaaaaatgattagcttgccttttttttttttttccccctttttgagacggagtctccctctgtcgcccaggctggagtacagtggtgcaatcttggctcattgaaatttactcctcctcctgggttcaagtgattctcctgcttcagcctcccgagtagctgggattacaggcatgcactgccacaccgggctaatttttgtatttttagtagaaacgaggttttgccatgttggctagtctggtcttgaattcctgacctcaggtgatccgcccgccttagcctcccaaagtgctggaattacaggcatgagccacgacgcccggcttttttttttcttcttttcctttttttttttttttttgagactgagttttgctcttgttgcccaggctggagtgcaatggcatgatctcggctaactgtaacctctgcctcctggttcaagtgattctcctgcctcagcctcccaagtagctgggatttcagcgcgttccaccacgcccagctaattttttttttttttgagatggagtctcactccgttgcccaggctggagtgcagtggtgtgatctcggctcactgcagcctccatctcctgggatcaagcgattctgctgcctcagctttcttagtagctgggattagaggcatgtgccaccacgcccggctaattttttttatttttagtagagacgtggtttcaccatattggtcaggctgatctcgaactcctgaccttgtgatccggccgcttcagcctcccaaagtgttgggattacaggcgtgagccactgcgcccagcctaatattttgtatttttagtacatatgtttagtacatacgtacatactttagtacaatatgatttcaccatattggtcaggctgctcttgaactcctgacctcaggtgatctgcctgccttggcctcccaaagtgctgggattacattcttgagccactgtgcccggccagtttgcattttcaaaagtttcatataaatggaataatatagtatgtagccttttgtgcaaggtttcttttactcaccctatttttgagattcatgaatattaaatatgtagtagtttgtcccttttttttggttttcagagcattctttcccacaattaggaaattaacatggacaaactgtatttaaattttgccaattttggctgggcatgatgactcaggcctgtaatcccagcactttgggaggccaaagtgggaggattgctggaggccaggagttggagaccagcctggacaacacagtgagaccttgtctctccaaaatagctggcatggttgtgttcctgtagtcgtagttacttgggatgatgaggcaggaggattgcttgagcccaggagttcaaggttacagtcagttgtgattgagttgtgattgcactccagcctgggaaacagagcaacacgctgtctctaaaaataaaaataaaaggtgaaaaataaatagaaacagttttgcatggattcttttgtacgttgtttatttagttgtatataattttatcgtgttaatttttgcagccacacacatctggcaatcgttttttaatttttgatttttctctatggtagctttttttatggatgagttatgattttacctctgagaatatttttgattctgtttattcctgcaactctttcttcagatatttagtttctcatttttgtagtgtttatttcccttgtagtttttctagtttgtaaaagtgataatctctggtttgagaattcctgttcttctgccagtggattcagtgtctgtttaccagttggtcaggattgattttaggggaggtatgagatacgtggcaaaatatggggtaaaatgtctccttatttcttctgggtaatagcagccacctgagtgccatcctgattctggggctccagtgcctgtttccagtgaagactttgcttctgtcagtgttggggatagaacatggttattggtagagggagtggcctgtccacttgtgccaaacacatttccccaccatcgcttgtgactgcaccactgcaccagacctgcttttgtttccccatggtagccgccctgaacctacggcttggatagaatacccctacgttctctctctcaccttcatagctgatcccagttttaatagcattcctcttttgaggcttatgcatggttattgcctctgtaaacctagttctgctgctgctatctcttttttttttttttttttgagacggagtctcgctctgtcacctaggctggagtgcagtggcatgatctccgctcactgctccgcctcccgggttcatgccattctcctgcctcagcctgctgagtagctgggactacaggcgcccgccaccacgcccggctaatttttttgtatttttagtagagatggggtttcaccttgttagccaggatggtctcgatctcctgacctcatgatcctcccgcctcggcctcccaaagtgctgggattacaggcgtgagccaccacacccggcctgctatctcttcttgtttcccagaattattttagaaaataatatatcaaatatatcaataaacccacacccttttttttttttttttgaggtggagttttgctctgtcacccaggctgtagtgcagtagtgctgtcttggctcactgaaacctccacctcccgggttcaagcaattctcctgcctcagcctcctgagtagctatgattacaggtgcccgccaccacgcccggctaattttgtatttttagtagagatgggggtttcaccatgttggccaggctggtcttgaactcctgacctcaggtgatctgccctcctcatcctcccaaagtgctgggattacaggtgtgagccaccgtgcccggcctaaacccacatctttagtaatttctacgatttagattgggaggggaagcatgtacagatgctttttgacttacgatgtttatgctacattccataaacccatcagaagttcaaaatactgtaaatcaggctgggcgcagtggttcacacttgtaatcccagcactttgggaggctgacctgggtggactgcttgagcccaggagttcaagaccagcctggcaacatggggaaaccctgtttctacaaaaaatacaaaaattaggtgggtgtggtggcatgcacctttagtcccagctgctcaggaggctgagataggaggattacttgagcccaggaggcagaggttgcagtgagctgagattgtggcgttgcattctagcctgggtgacagtgagaccttacctcaaaaaagagaaaaagaaaatactgtaagtcaaaatgcatttaatatacccagcctattgaacatcatagcttagccaaacctaccttaaatgtgcttagaacccttatattagcctacagttgggcaaaatcttctagcataaagctagatgatttaataatgaataatataaaagataattattttacaataaaatgtcgaatatcttgtaatttattgaatactgtactaaaaataaaaaaaacaataaatacttgaagtagagtttctactgaatgcttattgcaccattgtaaatttgaaaaatcattactttgagccctcattaaattgggaccttccatatgtctgtgcagtccactttgatccaatctcttcaggccttttttttctttgagacggagtgtcactctgtcgccaggctagagtgcagtggtgcgatcttggctcactgcagcttctgcctcatgggttcaagcgattctcctgcctcagcctccggagtagctgggactacaagcgcacgccaccacagccagctgatttctgtatttttagtagagatagtttcaccatgttggccaggatgatcttggtctcttgaccttgtgattcacctgccttagcctccccaagtgttgggattacaggcgtgagccaccgtgcccagccctgccttttttttttttttttttttttgagacagagcctcactctgtcgcccaggctggagtgcagtggtgtgatctcagctcactgcagtctccacctcccaggttgaagcagttctggtttagatttcctgagtagctggtactacaggtgcacgtcaccatgcctggctaatttttgttttagtagagatggggttttaccatattggtcaggctggtctcaaacttctgacctcaggtgatccacccaccttggcctcccaaagtgttgaaattacaggtgtgagccactgcgcttggcctaaaggacattttgggaaccggtgttaatgtctattgaaaccttttatttttggaatatcagattttgaaagataaattgaccattggaggttatatgttacataggtttgggaatttcctgtttctagtttgctgctaaaccagaactctgaagtctcaatgtttttttttaagccgataggaaagagagattttcattctgaatctttgtttttcacagttgaggcttacgagtagtcatcttgttatttttaaaacacttcatagtgcggtttgcgcttgtctgacagaatggttgggttggctcaatactttgatatttttctttttcgtctttgccgtagtattttttttttaagttatgcatctaaatcaagacagaatcacatttctttgccccaaaacccttttgcctagaattatgttctttggaaaccctagcgtttgaaataagttgctactgtggtaagggtaaatttaattttcagaaaaaagctgttctgacttatttttcttccccatttagtttttccatggtttggactggatatcggtggaactctggtcaagctggtatattttgaacccaaagacatcactgctgaagaagaagaggaagaagtggaaagtcttaaaagcattcggaagtacctgacctccaatgtggcttatgggtctacaggcattcgggacgtgcacctcgagctgaaggacctgactctgtgtggacgcaaaggcaatctgcactttatacgctttcccactcatgacatgcctgcttttattcaaatgggcagagataaaaacttctcgagtctccacactgtcttttgtgccactggaggtggagcgtacaaatttgagcaggattttctcacagtatgcattttttagcttatatacaatttatggtaatttgattgttaaaaataatgccagtagcaagtggtgaaataatttccatctctaatggaacttgaattttcttgagtcaaatgaagattaaaggtacgctagtgataggagttggccatctagaggtggttgtctagttcagatgtatggacgacaatcagaaccactaaaagggtagcattttattgctcctttagtatgaaaaattagggcatctgctatacgttgaggaagaaactacctaaaaggaacatcattagatcatgaacaatgagattgaaatataattaaaatcatttcatgtcataaaattgttttcagtcttgtctaccacataatttctcttgtctccctcagttgtttgctggcatgttcactaactgaaaaaaataaggaactctggtcaaaagtggtgttttcaggctcagggctggtctgagatgggtgactgcagagccctcctctcccagaatgctttctgatgtgttctgtgctgcacacttaactggagtctcgccaccatgtctggcccctggggaatgctgccaggcgctctatcttgctttcattgagtgaacactggagaacattgtgagcaagaccttgaggctaggtcctttcagggtggatggtgggggtaggccggagaactgacaaatgaataagccaagatcctgaccgtcagggtgcaatacagattgaaaatgtcttcagtgactgactgtttttctgttgctaaatgagagaatattagtctgaaagagattctgcctttttgttttgttttgttttcttgagatggagttttgttcttgttcccaggctggaatgcaatggctcaacacaacctccacctctcgggttcaagcgattctcctgcttcagcctcccaagtagctgggattacaggcatgtgccaccacgcccggctaattttgtatttttagtagagacagggtttctccatgttggtcaggctggtctcgaactcctgatctcaggtgatctgcctgcttcagcctcccaaagtgctgggattacaggggtgagtcaccttgcccggcccagattctgcctgttattctgcatgtcttttagtagagatggggtttcaccatgttgtccaggctggtctggaacacctgacctcaagtgatctgcctgcctcggcctcccaaagtgttggaattacaggtgtgagccaccgttcctggcctcaactttttgactaacatgccttggagttcttcccacttcagaacataaagatcctcttcatttttgttttgttttgagacggagtctcgccctgtcacctaggttggagtgcagtggtgccatctcagctcactgcaacctctgcctcctgggttcaagagattctcctgcctcagcctcccgagtagctgggtttacaggcgtgcaccaccatacccagctaatttttttttttatctttagtagagactgggtttcaccatgttggccaggctgatcttgaactcctgaccttgtgatccacctgtctcagcctcccaaagtgctgggattataggcgtgagccaccgtgcccggccgatcctcttcatttttagttgctatacagtgctccataatacgaataataatttagtcattcctttattatttaaatggaattaattgattatgaaacagttcaaattttgactgctaaaattcccctccctcccaagaggctgtagctagtttagatagtgaaaaaaatcttaccttctaactggatactttcagccttttggcttcagtttgttaaataatgtgtggcctcttttgatactgctccaaagccttgagatggtcctctgtcacagtccttgtggctcccaccctgtgtcacaaggtggtttctgatagtgctgtggcctgagcttggtatcagccccattgtccctgtaagcagagatctgaatttctgtttgaaggttgataaatgctgtggttttttttttttgttttttttgttttttttttggtcacacttattcagctgctgcagtagtttctatgtagagtgtatttgggtctgtagtagcaggagtctgtctcagcactgtgtccctaggtttgctcctaaatctgttctgtaaagcatgcacaaataatacacatctgtgagtgcactttcatggttgtttcacgtagtggggatgccttattgaatggaatttttgtttctgttggcttattaaaaagtctgagtacattcttatttcattacagataggtgatcttcagctttgcaaactggatgaactagattgcttgatcaaaggaattttatacattgactcagtcggattcaatggacggtcacagtgctattactttgaaaaccctgctgattctgaaaagtgtcagaagttaccatttgatttgaaaaatccgtatcctctgcttctggtgaacattggctcaggggttagcatcttagcagtatattccaaagataattacaaacgggtcacaggtactaggtaagttgtatataaaactcactgtttattcttagtatcctaacgggctgagttttcaggtattacatgtaactacaccttcaagaacctgttaggtgaaagtgtttctggattatgcaaacaaatgtttctctttgaaaattctgattttatgacctagttttctttaatctctactgttcaagatttattatcctaggtgtttcttaaaagatcacatcagcagactcattgtagcctttgccctcagatagtttatggtgtgcatacacaaagtagctaaagttattaggcagcatctgtaaggagaaggcacgggaaaggacctagctctgaaacctgtgtaaatttcatgcttccacacacatgtgtgtgtagaataatgatgtattctatgtatgtgatttagaagttgatatgtactgatcagtagaaaaattattgagggaaggtagtatgaaaagagaggattagccgggcgtggtggctcatgcctgtaatcccagcactttgggaggctggggcgggtggatcatgaggtcaggagttcaagaccagcctggccaacatggtgaaaccccatctctactaaaaatacaaaaattagccgggcgcagtggcaggcgcctgtgaatcccagctactcgggaggctgaggtgggagaattgcttgaattcagagggtggaggttgcagtaagccgagattatgccactgcactccagcctgggtgacagagtgagactccgtctcaaaaaaaaaagaaaagagagtattagggccaggcacggcagcttatgcctgtaatcccagcactttgggaggccgaggcgggtggatcaccagaggtcgggagttcgagaccagcctggccaacatggagaaaccccatctctactaaaaatacaaaattagccgggcgtggtggcacatgcctgtaatcccatatacttgggaggctgaggcagaaaaatcacttgaaccaggaggcaaaggttgcggtgagccgagatcgtgccattgtactctagcctgggcaaaaagagctaaactccatctcaaaaaaaaaaaatgaggattagatggaagaagagaatgtttcggcttaagggtcagaggtcacttcaggaaaaacaggcatctagggattgggataaacaatttttttaaaaaaacagttgtgatttaaatagaggagtaatttttttgtgacaaaacacgttgcaggaggagtatgtttgggggtgtactgataagccagggtgacaaggtgcttggatgagaatgactcagggaatgtacttggagaagggaaagggaggaggtgttagcatggccccaggcgtgtcaggctaatttgcacctgaggctcttcatacttggcagacagccagactgcactggggacatgggccctgtgttttgtactttgcatgttggctcacatgcatatgtaccttaaaggtgtatatcaggcaccttatcttttcacagacttgtttcctaccagtggcatttgcatgattgggttggatatgtgaatatggttttggggttcataaatgttaacttcttgttcttatttttaaaaatgttataatactgtgttaattgtttttaatcatagtcttggaggaggaactttttttggtctctgctgtcttcttactggctgtaccacttttgaagaagctcttgaaatggcatctcgtggagatagcaccaaagtggataaactagtacgagatatttatggaggggactatgagaggtttggactgccaggctgggctgtggcttcaaggtaagggggcatgtgtgttctaagaaatacaggcgggccgggcgcggtggctcatgcctttaatcccaaaactttgagaggccgagatgggcagatcatgaggtcaggagtttgagaccagcctggccaacatagtgtaaccctgtctctactaaaaatacaaaaattagctaggcatggtggtgcgcgcctgtagacccaggtacttgggaggctgaggcaggagaatcacttgaaccctggaggtggagggtgcggtgagctccagcctaggtaacggagtgagactctgtctcaaaaaaaaaaaaaaaaaaaaaaaagacataaaataataatattgggcatattttttaaaaaagctctattgagatataatttacgtactataaagtcagctgtttgaagcgtacaatttagtggtttctagtatatttacaggattgtgcaaccatcactgtaatcccaattttaggacatttttatcatcctagaaagaaaccttgtgttcattagctacgactctccattccccccacagcccctgccaaacagtaatttattttcaatgtaggtttgcctcttctgaacatttcatataagtggtatcatacagtatatgatcttttgtgattacttcttcatatagcatatgttttcaaacattcacattacagtgtgaatcagtactttattcctttttattgccaaataatatttcttttttctgagacggcgttttactctttttgcccaggctggagtgcaatggcgtgatctcggctcaccacaacccccacctcccaggttcaagcaattctcctgcctcagcctcctgagtagctgggattacaggcatgcgccaccaagcctggctaattttgtattttttagtagggaaaggatttctccatgttggccgggcaggtctcgaactcaggtgatctgccgcctcagcctcccaaagtgctaggattacaggtgtgagccaccgcgcccggctgccacataatatttcattacgtggataatactacattttatccatttattggttgatgaacatttgggttgtttccattttttggttataatgttgaacatttatatgtaagtctttgtatgtatgcacacacacacacacatatatatatatatattttttttttttttttgagacggagtcttggtctgtcgcccaggctggagtgcagtggcgtgatctcggctcactgcaagctctagctcctgggttcatgccattcttctgcttcagccttccaagtagctgggactacaggtgcctgccaccacgcccggctattttttttgtatttttagcagagatggggtttcactatgttggccaggatggtctcgatctgctgacctcatgatccgcccgccttggcctcccaaagtgctgggattacaggcgtgagccactgcgcctggcctgcacatatatttctaattctattgggtatatacctgagagtagaattgctgagtcatatggtcacttaatgtttaatcttttgaggaactgctacactgttttccaaagtggcagtcccattttacaatcttagcagtttatgagcgtttatatttcttgtcaacatttgttattatctgtcttcttggttttagttgtcttaataggagtgaagtgatatcttgtagcgtttttattttttaagaggcagggtctcgccctgttgcccacatgagagtgcagtgttgcgatcataactggctgcagcctgtgtctcctgggctcaggtgtttctcctgcctcagtctcctgagtcactaggactacagctgtgcactgccttgcctaattttttttttgtagagatagggtcttgctatgttgcctaggctgtcctggcctcaagtgatcctcccaccttggcttcccaacatgttgggattacaggtgtgagccatcactcctggctgaacattttttttgtgtgtgtggcagggtctctctctgttgcccaggctggagtgcagtgacaccatcttatctcactgaaacctctacctcctgggttttagtgattcttctgcttcacctcgcaagtagctgggattacaggcacacctgtaaattatgccaacatgcctggctaatttctgtaattttagtagagatggggtttggccatgttggccaggctggtctcgagctcctgacctcaagtgatccacccaccttggcctcccaaagtgctgggattacaggtgtgagccactgtgcccagcccgaacatcttttcatgtgtttactggccatctgtctgtagtctttggataaatgtctgctgaagtctattgctaagtttttagttggattgtctttttattattgagttctggatacaagtcccttattagatacataattcgcaaatgttttgtcccattttgttagttgtcttttcacttccttgatggtgtcctttgcagcatggaaattttaaattttgatgaagttaatcttatctatcttctgtcacttgtgcttttggtgttatgtgtaagaaatctaagatcatgaagaattgcctaatttaagatcatgaagaattgtttattttcttttaagagttttatagttttagctcatatatatatatgtgtgtgtgtgtatttttttctttttttcttttttgagatggagtcttgctctgtcaccaggctggagtgcagtggtgcgatctcggctcactgcaacctccacctcccgggttcaagcgattctcctgcctcagcctcctgagtagctgggactacagtgcgtgccgccacacccagctaatttttgtatttttagtagagacagggtttcaccatattgtccaggatggtctcgatctcttgacctcgtgatccgcccaccttggcctcccaaagtgctgggattacaggcgtgagccaccacgcccgccagttttagctcttatatttagctcttatatttgatccattttgagtaagtttttgtgtatggtgtgaggtagagctccaagttcatttctttttgcgtgtggatatccagttgtcctagtaccatttgttgaaaagatgattctttccctgttaaattctcttggcccctttgtcaaaaattagttgaccatagatgtttgggtttactcctggactcttaagttatgttccattgatatatatgtctgtttttataccagtaccatactgccttgatactgtagcgttgtattaagttctgaagtaagaaagtgtgagtcatccaacttgttcttttttcgagattattttggctattctgggtaccttgagaatatgaattgtagggttaacttggcaaggtctgtaaataagacaactgggattttaatagagattacattgaatcttttggccatcctaatacaaagtcttctgatccaaaaagatggaatgtcttcccattgatttagatctttgctttctttcagcagtgttttgtagattttattgtacaggtgttaatacttttgttagatatatccgtaagtgttttattctctaatgctattataaatgaaatcattgtctccattttgagatcgtttagaagtacaattgtttttcgtatattggggcacatggcttttactaatagaaaaatcatatgtatacatgcttgtttactaagttttaggcacttggtcaatgctgttgattttctgtttgtaacatttgctcgttggtcatcacttccttttctgattggaaaattattgtagcagttctgctgagcatgtactttgaagtactttatcttctagggaaacctgaaattcttaagcagctcactctgggactcagctgtctgtgctttactctgctctgatagagcagtttaccagatgtgcatgtggccatctgagtggaacagctgtgcagttgagatgaattgctgttagaggtgttgtcctggaactgtctggttgcaggagcaatggtgccttccagtgcatctgatgagattctaactgaatatgtgaatatctggtatccaagctagatttcagtagaaaccgcagggaaagctgtctgctcatttagaatgttggagggctctgtttgaagtttgcatttctctttgaacagatgctccattgcaaaataaaaggtttgaagatttcaacaatgttgccctaaaagctaattttatttcaataaagtaacattcaagttctgttgggctttgttgctgttggtttagcaatgggattttttttcccccatcacagctttggaaacatgatgagcaaggagaagcgagaggctgtcagtaaagaggacctggccagagcgactttgatcaccatcaccaacaacattggctcaatagcaagaatgtgtgcccttaatgaagtaaggggacatggatttctttaattgctctaaggaaaatactgaacttaagtgggccccatcacgtctgttttctcagaacagtgcctaaatgtagtcatttggggtggggtttgttttagcacgaagttaaaactcttcaaatacagattaatcttcttttttttttttttaaactgaagataaacattgctacttgtctagaggtaaaatgacatcttttgaggagaaagtagaggaagagtggaaggtagccagtgttccagatattggggactgttgggggtgatgatggataacgatgctgaatgtagactccacactcactgctgagctctagaggccctagggaggaatccagaggaagtcacggaagctgggagaagactgagcaggccgaggggtgccctccttggctcccccacctcagcagagctgcgtctttgtgctttcagcttctttacagtgctgccttgtagcattcaggtcaagcagcattgtacagggctatgaaagaaccaagaatgggctgcccttgggaaaagaggatctaggatccagttggtgcagcttatggcttgtccctgtgtgtatagttgttaaattattcttttatttttatttttaagaagttattctttagataataataggcatgtagcttaaaaggaaacctcaaaagacacaaaggatttgtctcattttaaattaaaaaaatactgtatcagcatcaagtaattaaacatttgttggaatatcataacttcttttttctttattgtatgttccctttcctgtgcttacgtattttcagaaattttagttggtgtgcataccacaatttgtattttatacttaaatatacatttcatggttgtatatttatttgatcaagttcttttatatcaaataacagagcttggcatttggttgcttgctcataactcggcagtaagcatttttaagcatgaagttattctttggttgaattttattcttgatatggggcttaggagtgagatttctggtctacagaaatgatcatgctcatgaattttgacatttatcgtcatgatgctttgcacaagggctgcaccaatttagatcatctttagcggtgaatgagtggattaattttactacaactactgatggtggtggtggaatttcagttgcttttttttgcgaggttaataggtctaaaattttacttttgtttgatgactagtggtttgaatttttcgctgcctgttatattgcttgtatactttgcctgtttgtgtcactgtccttttggattggagtcatactgtttttttttgtttattttaacttatctgtataaaacattgtattcaaaactagttattgttggtcagatttaatacaaatgtttttcctaatctgttttcttctcctgtgacattatctagcatgctttgcagtgggtccagagttgtctggggatcaagtttaagtagccctggaccaactggactaaatttgatcagcagtcaaattgttgctaagagctatgcacatggtgctgtatttggggtagcttttatgagaaaatagaaattaagatgaaaactaattgcctttttttggtgtgctcagaacattaaccaggtggtatttgttggaaatttcttgagaattaatacgatcgccatgcggcttttggcatatgctttggattattggtccaaggggcagttgaaagcacttttttcggaacacgaggtaagctgacttgttcgttgtggtatattatgtacacagagggcttgtgggtcacactgtcatggaacttgaggtagagggtggaggtgaaatgggctgcagtgtttcttttgttttttgtttttttgagacggagtctcgctctgtcacctaggttggagtgcgtggcacagtcttggggctcactgcagcctccgcctcctgggttcaagcagtcctcccacctcagtctcttaagtagctgggattacaagtgtgcgcccccacaccctgctaatttttgtactttcagtagaaatggggtttcaccatgttggccaagctggtctggtctcaaactcctgaccttaagtgatctgccagcctcagcctcccaaagttccaggattacaggtgtgaaccactgtgcctgaacttttttggtagtttaatttcgtaacatttgaaagctgtttcttccctgatactaatgcaaggtaaattttgggttaatttaattgtaagcttaaggaattttagagaaaaacccttgaacattcccctatatttctgatgccatatttttgtctgaactatcctctatattttttctattgcactgactgtgtcattactctgggttctggttttttcatttttttcagtgccagtttttatatattgttgtaattcttgtgccagttatttaagatgcatgttgtaaaaatgaatagatgagtaaacctctcagactagaaccatactatcataagaacttaagtacaattgtagacaggctggaaatgatgaaatggaaaagaatcaaattgctcaacctcatagcctgtcttggaaagcactcttatttttcctatttggggaaaaagaagcagaggtatggaaaggcgtgtaggggttctttcttcccttcttggttgtggggcagttgaactattctttcaactgttcttggattttagatactgttattatgaacatttttcagaattgtattgcatatttagtttaacagtctatatgaattaaaggaaatcaaagtccagataatagcacagatttgaagtgctagagattactttttcctttaaagttactttaagtttttctttttaaattgctttagttcatagttgaagtccaaagtacacaaatccccatatcaaaaagcttaaaattgaagtcatctaacttagttttaaaattctaacattactgtatttgtaaaccagcaccgaattgccattaagtttcttacagttcatgtttctgtatacatctttttttgtgatctgacttattttattttgctttatattagaattttttaaactcgaatgttagatctttttctgctttatttctgcctcttgtttaaccttttcctaggtagaacatggagattagttttttaagttaaccttaaaaaaaaaataggctgggtgcggtggctcacgtctgtaatcccagcactttgggaggctgagatgggcagatcacctaaggtcaggagaccagcctggccaaccatggtcaatgtggcaaaaccctgtctctactaaaaatacaaaaattagctgggcgcaatggcgggcgcctataatccccagctactcgggaggctgagacaggagaatctcttgaatctgggaggcggaggttgcagtgagctgagatcgcaccactgtactacagcctgggcaacagaacgagactctgtctcaaaaacaaaaacaaacaacaacaacaaaacaaacaaaaacaccaaacaggccaggtgcagcggctcacgcctgtaatcccagcactttgggaggccgaggtgggcggatcatgaggtcaggagttcaagaccagcctgaccaacatggagaagccctgtctctacaaaaaatacaaaaattagctggacgtggtggcacatacctgtaatcccagctacttgggaggctgaggtgggaaaatctcttgaacccgggaggcagaggttgcggtgagccgagatcgcaccactgcactccagcctgggcaacaagagcgaaactccatctcaaaacaaaaaacaaaacaccaaaccgatatcatcataatagttataagccttcgtgaaattcttggttgcattttgtccttattgctcgctgactttgtttttcccactgcttagctttgctggtccatttgtccctgtgttttccatttgcattcaggcctttgactcttgtgtgcatctctgcccttgtggaactttgatgattattttattttatttttttatttaagttctaggatacatgtgcacaacgcgcaggtttgttacatacgtatacatgtgccatgttggtgtgctgcacccattaactcgtcatttacattaagtatatctcctaatgctatccctcccccctccccccaccccatggcaggccctggtgtgggatgttccccttcctgtgtccaagtgttctcattgttcagttcagaactttgattattttagcctctctgagccttgaaatattttcttgccctcacattgaagtcactttaacttttgttgtgaaagcttcgtatagattctctcaagcgtttcctctttgatcctttattctcatcttagcacgttgtagtttataaccacctgtttctgtcttgatagtagcatcctagtcttcagtggaccccccccatatatatatataatggttaactgtatcttctatatttttattataaaataaaaggtacagaaagctgcctaaaacaaactgtatagtgaactattaagacaaacagccttgcctctgtatttcagctgtgccttgtcctgtagctgctggccgcctcacatcacagattggtgtggctgcctttattttatttatacacaccaaaaccaaagatggtcaatatgcctttcttttttttgttttttgagatggggtcttactctgtcagccaggctggagtgcagtggcgcagtctcggctcactttaacttctgcctcctgggttcaagtgattctcttgtctaagcctcctgagtagatgggactacaggcacgtgccaccgcacctggctaatttttgtatttttagtagagacacggggtttgccatattggccaggctggtcttgagctccagacctcaagtgatccacctgccttggcctcccgaagtgctgggttacctgtgagccactgcgcccagccaatatgcctttcttttaaattgccaactagagtgtgacaagaaagcctttggcctctcgtttgatcaggtttcttgaagaagcttttcgtgaaagatagagtggtagttatttatgtttcagagacttttaaaaaatccatacacaagtctttcaggatcttctcattccttttttagttatttcttttaaaaagtagtctgatatcttaccttacaggttggagaccctgatggattctgcatcgttttaggatttgcctctgattcttgctagtgttctcttttctgtcattatggggtttgccccgttttctctaatgtgctattcctgtgttttggttttgagttcttggttgcatgtgacctgactgcttctggagacagtacagtgcttgtcgtctctcagctgctgcttctgtgtctcaggagggctgagggctgccctccctcgggagcctccgtgcttcctcaggctttgctctttgttctgtacctctcttcacgttacctttgggtggtggttttcattcctgtgccgcctgcttctgggccagtgatccaggtgtctggtgaccacccgggcacagctgcttggctgctgtgggcacctcagcttcccatgtcctgtagggaactcacccaccggccttgctctccacacctcttactcctgtgtcccctttctcggggatgctgccccctcctgctgtcctgtcctctgttaggggtgaatcttgaatccatcttatctcttactctccctccctctcccagctcagtcgggctctcaccctctgtgacccacctcacaacttcacctgtttcattgcactttgcatccgacctcgccttcattccttagttgtctggaaatgctccaggcctctgctgcttctcacctcattccccagaaacagtcaggttctgtctcttaccagaggtaactgagctgctgctggcctcatagctcctgtcgccctcactgcgggtttggttttcctcttatcacagtggtctgaagtgcttggatagtctaggacatccagccccctccccagacagggactccttagggcgtctctgctcccaggctggccttggcccttctggggtgctcaggaaatgggtatgctgtgtgtgggcagtggttggctttaacactagtcatcatgtgtaaggtgatttgaataagtctaaggaaaattgcacttatttttggtgtattttctttcagggttattttggagctgttggagcactccttgagctgttgaagatcccgtgatcattacctggggaggggttcctgaaaccttccacaatgggatctgtggactttcatttttttaagagacttactcaatttcatgactgtactacctgaaacaaagtgagaaaggacaggtgtatttttctaagtcatcaagataaatccttaagaattcagtctaaattagcaaccaggaaggaaaaatatattaaaaacaacaaaaaagtggcacatgtccaggcagtgtgaggatttgctgtatataagttgcctgctttgtatttttgaaatctctgcatcactcattggaagtgcttctgaagagagctgctctgtgttcagttgactggttttgtgtcctgtttgaacttgctgaatgtaaggcaggctactatgcgttataatctaatcacaatttgtcaatatggtcttggcaatcatctgtgcattactctggtttgcattaagcctgtgtgtgaacttactgtaaaacatgttttatttcaaggttctgcaaaattaattgggcaggttaattgtgtacctgaaacttaacaagcagtttttggaagggca

SEQ ID NO: 2719 - DNA, 539254 bp, Homo sapiens
tataaaggacttgtctaggggagagcctgtaggtactccattgtctggtaaagttcatatgactgcattctttttgcaaggggggtggagggagagcggggaaggagggggtgtcagctcaactgtaaaagctgcacagattttttttctttctctctctctgcctctccatagattgtttctgtttcatgccctgtctcatttcgcatagctaaaaaagaatgctaattaagatcccttgtcttaacctgaaaaataatgactcggctgtaattagaaatctggtgagagtttaaaaattctggtaggggaccaaaaacatcagttacggtgcttaggaagaaaatgaagaattatttttctgaaatcaaggtaaacatgggagaggggggttccccccatctttttaaccaattttaaccaatggtgttctactgcagatgagaagatactgtatttcaaaaactattttaaccatcaaattgaaggaacacaaatcagtagcaatagaagccttcttaatcctccttaggatgcaattcagatgaaagaactgctttttctatttttctttttgtgtgtgtgtgttatagatggatctgagaacgctgtctgggcttggtaccaagagctggtatttcacagcagcgaccgcctcacagacgagctgtgggaagcaggagggagactctctcttagggtgccactactatggagacacagctgggctgaacaagatttgcttcaaacgacaacaagagagacagaaagtatctggttcaaccgctgcccgagcaggcaggcaccagaagagctagcagccaatccggccatgctcgaagccagctctgcagctcagccaatcagtgacatcattggtgagaaactcatttacatcatgcagtaatgaactttgtttaacatagacttccccctttcctgtcacccccccccctttccatattaggtccttccattaattattctgctggcataatttaaaccgctatgcaaaaatgtggctacattctctctgatggcttttacctcccccccccccccccccattggtgtctgccgtcactgaaagtgattctgggtacaattctattttgttttgaacttgcaaaaattatcttctctttcttaaaaaaaattcttaacaacattaaacctctgtttatattgtctgatccctcttcttatgaatgaatacatgcttctccaagttggggttcagaattgtacaaggcaacagagaataaggtgtgcattgccatggaagttgcaggtttttcaaacaatctgtatcttagaacttcctttaacgtttccagattttatgctgcagtggccattttacatacagtgctttatccaaaaagcacttgtatgcatctgtcacatggaggaaagttcactcttgttatatttcattctccactgctctcagccaacattgtcattttattaatgaatagaactgaggtcatttctggacaaatctcccccttcccatcccagcacaatgcacctgatttgcatccatttactagaaaaaatgaatacaagaaccagcttgaaaagaagttaagggaccagcttacgtattatttcagaatatattgcagtaatacagtttgtttttttaaaatgtgtaatatttaacatttgccttagtgtttctataaaaatgcctgctatccatttgcaatgtaatacctttagcaaatttataggattgttacataaccaaagtagatcaaattaaataacgttcacaaatgagttcatttatctgcagaaaacctgtggaaatacaattttgccttgcacatttgtatttagttgtcagggataaagtcattttttctatagataacttaaagaggctggaacatgtggcatgtgaagatttcaggttgctttataaaatcccagagagcaaaactgggtcacacttcaatgcaatttctattaagtcatatctttattgcatatttgcgttaaaggcgcacagttttctagcagagaaggtgaagtttcattgtctttcttttaaaaggatgttttgaatataattattcaaaaacatggaattttaaaaatattgacaagggtttcataatagtgcatgattcatttaagaagcttagagaatgcaatgataggcatagtcactttttaaagcatatgaaggatttagatgggaaaccatggcccttttaattcatgaggtattccatcatcccatcatcagtattcagggggcgactgtcctgaatcagtcacgagctcccctgctgcagatcctgtaatttgaatcatgtgtaataatatattatcctactgggggccttctttcagtaggagaatggtttatacattctgctgtaagagaacttttggcttctagccgactcacagctattactcacataggcaatcacgatcgtcttccttaaggaataacatctgcacaacctccagagccaaaaatctgcaacctcccgcacagtatgaattatgatttcttggaattgggaacacttgacaaactgaagtagaaaaatggaaggtttaaaggaatggatcaacattttattgagtgtgccatgtggcgacagcgcaaactcccattcctttgaaatgatggagaatggtgaggaaagggggccaaaaatatacctacatgtgttcatttgatttttagacacagccgaaatgtaatgtgttttatgaagacgtggctgcctctgtgtttttctgtggacatcctagcaaggtcctgtaaagggcgtagcaacgtggagaaataaatggggggcgaaggtggtcgtgaaagcagagaaattgtctcccctcgagaaggaagcaatgtaatgtagcaggaaccattttgaccccggagttaaaaattatagtgtacctccgactctttctcttgttatcaccttgatcagatcacttaatttctttccattttctcctgcattcaaaaattcaagacaatgccagcatagagattttctctttgtgtgaaatgccttcccattttttaagagtctagatccttttttgcttcaaggaccaagttaaatgtctcctcttctgtgaaatctctccaaatcatcacgaccagaatctctcacttctccaccccttttcatctcctttattgcctgtgtgccagtcagtattgctgtagggccacatgtgtgtacgtctttgccactagactgaaagccccttggggacagagaccacattgaattcttccacccccagctctaagaataatgaatgatgctcctaaggttcaaatccatgttttaattaatgaattataagtacattataaattgcagagggagggtcatacaaattctggggattacaattattgttgtcaactattaccactatgtaccagttgatgtcagctttacctcatcaatgttaagccttttatttcactggcccttcataataaatctcagattaaatggtccttgtattatttttcttaaatagccagtcataaggaaatgcaaatcattttgtttattaaatataaaattgagccaacttagttggtgtttaaaaacttaaaaataggtgaaatttatgtagattcaagcaaccatgataagcaaattacagtatccagctctactgttcatgatatgaaaaattacttggaaaaggtaagcagttaacatggaatgttgaaatgctttacaaagcataataaatcaggaaatatagaatcccatgtcagcgttataattaatgtatgtatttttaatctgtaaactagtacaataatcttgagtgatttctagatgtttttgatataatctgataacataatgccaaagcatgattgattttatgttagttatctatttaagtttatacttttggttattatactactgctaagaggaaattaatgttttggcaaaaatgatatttttgttaatgtttgaaaatcgtctttagatttaaaaatatattttaaactgtttttcactaccttttatgagaagagaatgaaataattagaaaatatatatatctttacttttatatctggaaaaatagaaatttcagagcttgaaatcagcttaagtctttattttgtaaaagtattagagaggaaaagtatctcgcccaaaatacgtactttcaagttcccgggacagctaagactggtgtcaagaattcggaaagactgggtcaatatttttttaccctaccaaataatcttcatgttaaaaaccagcaagataggattatacaattttatagtactaacataaattacatttacttatgtaatccaatactgtatgtagaattcacatatcatagggaaaaatgggagactggaccttattgagctgtatttttccactatcctacaataatgcaattgggtcctaataaataatcatttatattagtattctttaaaaataattatggttatgatgaagtaaaaatggaaatgatatctgggttcactttgctagctctgaattcagttaacacagatattatatcttaatgacaagattggttaaatagatttgggtgggtcagtttgaactttttttaaccaatgaattatactgttattcttaatcttttttattctgcttaagtctccagttatcccaaagatgagatatttgcatctagccaattatttaaaaatataattctggaccttgtaaatactgagagatgaattgtgcccacttagaaacgaatgtttctcaaagacaataaaaatagtaggactgtccagcatcttctgtttagaaaattacagttaagagttcagagagtgactgagaaaatgtaaagcatcttaaagaaaatgttactttacttcctaatttaagacgtggtaactgacagccgtgtgcatttgaatactattttgtttttctaaatttattaaagtaatgataaacaagatagaaataatgtaacacccccccatactggtacttattgataccataattgtacggtccttattccaaaattaattattgaattaggaaagtggagtaaatattagggcataggcttacacagcaaaactagtaagtttgtgattgagaattgcttatttgtaagatggcaaagaaatagataaaactgacctaaaacatttgcatattctggctttttttcctgcttaacccttacgacatgatttaaaagcagtatcaatatatttcggtgtttaccgagtatttccacgaactgaagataacacatcttgttattgatcagtgaggttgctctgtaactggttgctgaaccaagaggaggaacaaaaggctttgagttaatggctaatatttgctggggcctaatatttccactatatgccatatgctacactatgtgctatgcacacattctttcatttaattctcaaatcaatcctttggtataattactatccttattttacaaaactgagaaaattgagtttcaaaaaggctaagccactcctcaaagtcacatgactaacaagcagcaaaagagggatttgaacgaaggattctgacttgagagaatgcattcctaatcattccaaactgaataatcagtacatgtgattttgctgtttgctgtagaaacagattttttatatatattacattcattaatggtgtatctggttcagttttttaaatgttcacatatatttttaccttagcattttataggtcagtttgaaagctattgagttcgcaataatatctacattaatattttcttcatattttggtatttctgcacccaatcagatcatttaggtaatacataccaaaacaatttctaaacagtgacataccagacaaatgtaaggtcatgttagtagtaaaatgtctttgtaagtctgaattactaaaaataagtattagactaaatgtttccatttcctctttttcctagatattttacttattaaatataacacctattttatgacaaaattaattctcattaatttggcagttgcagaatgtcactttggcttatttagaccctgactatccagacatgtaaggtagttcaggttctcactcctgtttacacatcttgtgtctacaacccactgcaatccacaggatgttaaaagaatcttacaattactgaatatgtagtaatatattttatgcctaatgctagattttttagtttttatctacagtggtcaagactagagggcatagctgacaagttgttgactttcagggaatcagcttaatttggggaagggaaaggagaaaacagaattgtgtagtttcttagcttcctgatgaaatgttgtccagtttctttctcaattttctatttctttctagaacaatgttgtacacttaccatatgtcagaaactgtgcaggcaataaaatgatcctctcatgaactccaacttcaacattgttattgattttcataatgaaaacactatatcaatatatgttcatgtataattgaggtgtttagtttggttacataatttatggtaccctcttttaaaaaaatctagaaaagcagaagttttgacccctatgattctcatttgaatgaaactccactccactgtgctctccactgtgcctttgcctcttctatgatcctgatacctagaactcaatacactgctccttggaaggtttgaggaatgcagggtgaaggaggactatcatctctgtgtttgggggccactaggcccatggatgtggtgcaaagacctcaatagcaggtttaaggatcatattctgattttgcccatgccttacgctattctcggtacagttagaatttgatattattttttctcgcaagattccttgatgttcgcattactaataattacctttgtgggaaagaatcaaggtcaacatagcagttcctttcattgcttctgaacttactgagaaagcacttaaagtataggacttaagcactagtaaagtacttaaaacatttattttcagaatgttaatttttacacagtgaaaactagagataatagtgtcaatgactacttagtgatcacttaactccatgaggtactgtgagaagtggttaggagcataaaatctctgtacagatgcctggttctgattctgaacttcatgacttagtagatacataaccttggacaagttacataacttccccgggccccagttttctcatctgtgcaatagtacataccttaaaagactgtgaggattctagtgcatttttgcaaaggatggcattataaagatgtgcaaattcatgttctttactcttcgaagtatggaatgtagagagtatgtgtttgtatatatttaaataaatattaatgcagtgtagttaagtgctataccagagatgtatttatgcttcataaatacttttaaagtttaattttacttcacctctttaaccaagttttgtttttatttgaacaagttgtcaaccattgttataatcatcagttttatcccatcaaatattggtttcatttaaaaagttgtttaaaaagactctatgttattttaataatatctatataagtttacaatttcaggcaactaataatattcaatccattgattctactttttcctccattgctcagtgtatatatcagaaaatacaaatgtccgaagtcacatgtaaaaatacatgaaaccatttattctgatttttgcaaagctcgatggtagagctaatattttagaccatgataccctagaatgaccagaggttaggttcctagttagtggcattctgtaaagacaattaatccatagtccaagtgtctaatgttcaagaatcagatacttgatcacgtagactgtcctttaacaatctccattgtactcaggaagaaaataatagattctaatccgaagacctgacctaaaaccctttgtaagtgctccaagcctcacttttcttattatgaaatggggatagtaatgcctaactggaaagataattgtgtgggctaaataagaggacctgtggagtactgttaggttttctcttctgtaagttttgcaaagtctgttcaagtgtgtgtttcaatgtcaatgagagcaacaggacttcaaataaaatgcaagcttctgaggaggcaaactctagtatgatgtattctatagaatagagaatgacaagattctttaaaaatatttctcattaaaacccccattagttcaaatgatttcaggggattgtgaatgcaagttaattaaatcagaattctttctcatcttatcctgggaatgactgaaactaaaaatggtttcattttaaaaagaggttcatgagctcgctccctctctccacctccatctctatctctgtctttccctgcctctgagagaaactgacgtatttgggtagagaagagcatcagtaagtgtttccagtgattgaggcagagggatgttcaaaggcatgagtatttttagattaatagtaacgatgcaactaattttcaggtgtctcattaaggtgaaaaataatatactataaatagcatcatatttggacacctatgtgccaattttatgatgcttttacaatttcatctaatctattacaatttgttattactcccttcaagttttatccatgctttcatggtactaataatgaagatgacgatcaactgaactttgccatgatattttgtaggtgtacctgttgtttgaactatgtatataaatcataaagcaaagaaattacacattctgtttgggatatcttatagtaatattgccttttaataatccccgtttctccttttatttaacagcaattacccaacatcctattaaacatcaacagagatcgtcttgcatgtcattatagtgcaataagatctgtttagcttttcagctcttacaagatattcattttgcagtggagttaagcttttctattaccttcctaggatgatggtttaggagtctttaaaaatttttattaaactcattttagttattttttccctttgttagttaattgatttttctaggactgagaaagtgggtttttaacatatctcttctctagggataggcttcagtatgggggctgttggagagaccatataccccatttctccggggatatgtctagtttatgcctattgtaccagggtaattattgatggtgccctctttcattttcagtagtgacccatttttcattagaaattatgtggccattctataatataaagttaatttctgaatgttttggtaaagattatatttttggatatgcaaatctgttgtcatcatgaaagtatttgtactttgcagattgtgtaacatgagtttaggttttgcaaatgtggtcactacagtaatagataattttgttgatatgtgttagacatgcaatgagtaattgttgatctaaactcactcatttgagcatcagatttcattagtactctagtctagactaacagcaggaagaagtccagcatgtcaattcatttaacaaatattggttgagcactatgtgccaatcattgctataagcactgagggacacagcagtaaagcaaatagacaaagtccgctgtgctcataaagcttgtgttctgaggtcctttatagggtaataatatatatttattaagttataccaatgacattttgctctcttatacaaattgctttgacaaaaggaaggtttcatttaaaatccagcctgtttttattcagactgctccatgatgtaggctaactttataccatgaattcctactgggtacgtttttctttctctcactcagtagcttacctgacatcttaggccctcctggagttgatggtgccagctgcccatgatttttatgttttatttagtcaagaagcagctcagaaatcctaataacttgagatcttcttatgttctagctaacacacaaaggtacatggaaaatgtactaccttatttgtttttggaaacttttcttttctccctgagaacaggttattgtcatttttgcctatatatataaaattcatgtttttaaatgtatcctcgagcttttcaagtgatttctctcctgtggaagcaccttctcttgttatttggctttttataaagcccacgaatattttaaaattttaaatgacttatgtgcataaaaaaataagcaatttatatattaagaatacatatttaagcaatttatctgttaagagtacatatttaaaatgagaacaattatatcataaaaccagaactgtttggagtttgacatagacttgagacaattgtttaattcctttattttttaaatgtgcccagaaaatgtgtaaagaaatggtattcaacttgctcagatttacagagtagtttgtgatagactcagaaaaaaaagattttttaaaatttgaatttttaaagttttgattataaaaatattttctctgctctaaatttgaaaaattttagagttatatgaaagaaaattgaaatatttagttattttactctgtataaattaccatagttgcacaaattctaaaaatacatatgtcttttgaataatattgaagtttcactatataaatatttatatcttgtttttaaacatgaagagagaaaatattatgtggtatgatataagggatgcacatttagatgaaaaataaaggaagaaagaattgataagacaggcatttaaaaacctaggtatttttgaattacaacttcacaaattatatgaggctatataggatatatatagaagtgaatatgaatatgtcaatgtcatttcataaaaatgttttgtggtacactgaagagagacatgtcaaagtgacaatgctgtcatagatgtggatgccctttcttgctcctgggaagtagtatctcttccctccacatatactctgggttataccctctcttaaatcctcatggaatttttccatcgatgatccttctcctgtatcatcaccttcctctcaaccagttcttccctcccagaactcaaaaatgaccaactttcactcatcctaagtaaacagatgaggaaaacaataatagccaccccccataaacctatttcctcttgtatctcttacttatccattctgttgctggacacgaagtcaggagagctgagaaaagactctaactcactcgggacaagtagtgtaacttctttgcactccagcagaattgatagttttatatttcataaaatataaaacggtgttaaaaagctatagtttttttttttccaaaagtactttgtccaccttgaacaccacataaatgtaaaggagaagagaggaaatatcctctacaagctactttttaattgttatttttagggagctctaaagtaactctaaaggtgtttttgacataatataattaccatttacagccatgatctcatttccatttatttattttgagattctgttcccactcagggttctaatggtgcaggggtggtagtagggtcaagttattttaaataacgatcaaggaaacaatctatttttaaaggaaataagctctttgtgctattgaacaaagatcgctgcacttgaagtctatttgttactccaaaattatttcaatgagagtaggaatcagatgatctcatatctattgctagctatgccactagtcatttgtgtgacattggaaaactggtgtttattggtttatcaggatggacaggagaccagatcaggactttcaacaacttttcttaaagtagaattctttcttaaataaaatcgactcggaatctcaaaatatttttagaaagtgcaatgaccctgtttggattagggttgggaacctcagagctgtattcttttactcctcatgcactttaggtggtgcctaagatgccctcattacagcctcgtaactccatgagaataaagccactagagtagataattgttgacattgcttagagtttgaaaattagactgttttttttttgttgttgttttgttttggttttgcttcttttggtcagccattaattaatataaattaaacttccactagatggcagtagatcaaatctttgatcttgacaatcttcagtctaatatttaaaagcacatatttggacttcttacacaaattttagaagaattttattgtcttatattttaaactttaaaattctttttcaacctctgaattttcacttggtattctgttttcaagacattacgaactattggttagtccagtctttatgatgtctggtaaaaaatattacttgctctgattatagaaatttttaaaaattgcataatgttcaagtgaacacattttcatgagcatctaaatttattattcatacagtcttgattttacagcttcactggaaggctaatttttaacccaaaatttacagtgacctggtcattcattttgctatcccataacgcccactcccttccacagcaatgcaattccaatgatagtctgcattgtgtatactcttaactttgcagagaggggatgctttcaaattatattagatgatgggaatttgtgataaggataactagcgaaatgaggtatctcaggaagctgcttcatatccctaaggttaaaggtatagtaatttcttggaggtacagagcaacaccttcctttgggattcagcaggtcctcctggaacccaacagctctggtaccctcatgccaacaatgagcctcccagaagttgcctctgctcctctttttggataccacttatttatactccccaggaaagaagaactggttgagtcagtttgttgtagttgtacacagatcatcccttaagtgcagtctcttgctaagtaagtcccctgagttggttagacccgactgaggacagcttattctttaactagtgtattagtctgtctcatgctgctaaaaagacatccctgagactgggtaatttatcaaggaaagaggtttaatagactcatagttccacatggctggggaggcctcacaatcgtggcagaagatgaaggaagcgcaaagggacgtcctacatggtggcaggcaagggagcatgtgcaagggaactcctctctataaaaccatcagatcccgtgagacttattcgctatcatgagaatggcacaggaaagactcgcccccatgatacaattacctcccatcgggtccctcccacaacactcgggaattatggaagccacaattcaaggtgagatttggatggggacgcagacaaaccatatcaaatagccaacataaaaggtcaaagtttatgcctgttttccaggtgaaactagtgatagctctagctccccattttactctcaaagtgatcccaattcaaaagctcaatgatatgatcacctgaacacacagttatctttaccttgagaactaagtctgatcttcaagccagagtcgtagacacaagacttgtctaatgaaaataattgtctgtggcaactttcttaggaaggagctgtgggacacaggtatttagagttgtatgaactgccaattatgtagtccttagaagaaaagaaaagagaaattaaagatgaaagctaactttaaactcaaattcctacctcactggttcaattttatccactagataccatctttttctaatgcattgtggaaaagagtattattttcattgttaaggatagtataaaactagaaaagaaattaagtggcttgcctgtatcacattgtaaatatcagagagaattccaaaattagaactttagagatggttagtcacaatctattaggcataagtagtagactgagtcttttaattatcactctgtataataattcacatgccaccaaatgtattggaaatagttatctttccatcaaaactattacccccaattttttaagtaatcatatttttagattttaaatacattttctcccacattagtcctctatcactttaatgagtatagttaatatggtgaatcgtagattctaaagccctttctctttttttttgccctcagaacagatttataatgaaaaaaaaacttaagtgactgaaatgttcaacctgaggaagagaagccagactcactggtcccattcctcagaatgtagtttctttcagagagggctgtgatgaaattttggcctatctcaatgtacaacaccagaaagagagatgatattataatttgagacattttgtttagaacgatttcatgcattcttctaatcagaatgggctattgaaaacatttgtgctaagcctgtcctctggaaatcatttatttcatttgtggtatttcaaacatcatcgtgctgagttggagggcagtggccattatagtcatacaaataatactgtatcactttgtttaaagtatagaaagacccgcttgttggttgaaaacctcctatgtctttctgaaagattagcttctgttcaccaaattccatgttattttccttctcctgaatacaaagaaagagtagatttcttagccgctaaacggttaggtggcagcatgtgactaattctggctcatgaaatttgatcagaaggcatcagagtcacttcaccgactctggcctgtgtcctgagatggccaagctccagcatggaaacagcctggatttctaagactctgcttggaaaggagccgcaccaaagtgaaggatgaagtgaaatacactgagtactaagtgaagatgaaagatttttatgacataagttactgaaatttcaagattcatttgttaccattgtatagcctggattttcctgactaccataggaaatatatgaagtttagctttataatttaattttatttttctgacttagcttagtctttgccgtagctgagattctttcaagcaagtagtgagtgagatggatcattacttaagtgttcattacttaaatgttcattccaatattacaccgaattggatgatatcttgtatcatatgtttatgtggccagactgatcagtgacagtttggaagacatgtatctggtgcagctaaattttgtgagccagaattagtcacatttcatgagccagaattagtcacatggtgccacctaactgtttaggggctaagaaatctactctttccttgtacgccggagaaagaaaataacgtgagatttggtgaacagtacaaaagacatgaattgagattatcatccaaatcatttttaacctgcctaaaatatgagaaatcatttagaacatatagaatctgtaggcaaatgtaagctgtaaatccgtatagtaagagaaggaaaaaggcagtaatattttgtagtttgtgattttaaaaaatcaacgtataatcttagagttctcagattttatttgtaaagtaatagtgttgtggaactagcaaataatcattaagtttctgtgatacattaactctttcagcataagaacatgtgaatatttgccttgtagatacggcgatgagaggttctggtttatttgggggcagtctcagtttatatcttttgtttcattacaattcttaatagtgtcgcttttcattcaaatattacactgaattagatgatatcttgtatcatgtgtctatgaggctagactgatcagtgacagtttggaaaacacgtatctggtgcagctaaatttctttttttttcctcagttctgtggaacataatacggcatgaaaatatcattatatgaggatgttaccacatccccatgtaatgggatcagcccacaaaatatttttgaatccataacttagtgaaagcattgtgatgagtacatctaaaataaacatttctaggtttctgtggatggactcaggaacctaatcatcaggtatataaaacattaaatcaaatgaaaagtgcagtctagttttcaataactaacttgccaaagagctttaggacgtaactgtttgtcatttcagcataagcagtggtttttaaatgcagctttcagttgtattaattgtgtaggtattttattttttattatggagaattttgaaaaataccaaaattacataatagtatatcaaactaccttgcagctattaaccagtccaaatagacatcaaccaattgtgagttctgtcctatccatacccccatctaaatttccccctatattattttgaagtaaatccagacatcatatcatcttatttttacatattttagcatttgtccccaacaagatgtacactttggtaaacatagttttatgtggtttctgtataatagcatagattgaacaaatatttgtcaaaacaaatttgggttgaagtttaacatgtcagcatttacccacattaaatagtcattatctcttggactaacagtttcccaatatcaccttaatcagaacaaattacctttaaatattccaaaagtaaactctaaatttccctttagacaatttagaggggtatgtatacgctccaatccagagatcaaggagctctgaaatggattctgcagctgtctccctttgaaattctttgctctgacactccagataacagtacgacttagctttcctgggaagcaaataggctgctcttcaaagggtgaataccttagactgacaggttaacttcaagaatgtaattctaataaatggaatttatggggcaaatgttaaaaacactaaaaaataccttttattggcctgtttattgagactaggaaggaacatcatgttacaaacaaattctgttttctttgtgctaaaacattcctatgtcatcttttaataaacttaactggatttataggaaaggaaaagtattccctttgttttatacttcagaaaataattaaaacacatttctgatttgtatgaaaagagaaagccagacaaaatttttaaaatttatcaaatgtaaaattgaaaggaaaagaggaaatcttggtacaggttatatttgtagcaaaattagagaaatttggaaggttgcaacatattgtttatgtattgtaccagtttcctggaacttactatctatatacataatatgttttttatttgtatgtaaatgatgtaaaatgattaagatggtagagctaatacggtttcttgaagaaggaggacattagggttagagcttatattaattgaatcacaggtctttttttggctccttatatcagtggatatagatggcattaacttaatttaggcatttgatttagattacagtgcaggagtaagaagcatatttaagggaatagctctgttttcaccacttagcagccatataaccaaggttaaaccttgcttctctaattatgtaatgatagtaatttaacctataaagggactgcaaggattaaatagaactgtcttggtaaatatttttaaaatgagctctattttcatgtttatgcataataaaaatactcacattttaagtgtacaatttgtgtccttggcaaatacatatagtcatgtagccaacatcataatcatgatggaaaacatttccatcaccttggaaaattcccttgagtccctttgtggtcaatcggctccacctaccctcagcttctgcaactactgatttgcattctgtcattacaattttgcattttctggaatttcatgtaaatggaataacacagtatacagacttttgtgtctggctttttctacttagcataatgctttggagatttattcagatccttgagggtatcagtagctcatctgatttattgctgagcagtctcctgtattgactgcatatatgacaagtggatggacactgagattgtttccagttagggaatgttatgaataatgttctgtgaacattaaagtataaggcttttgtggataaagctctgatttatcatagctaattgtgtagaaatgggattactgggttgcgtgttaagttcctgcttaactttttaagtaacttacaaggtatttttttttttaattggctaaaccatttgcagttccctcaaccacataccacttgctccacaacctcaccaaccattggtattggtcattaaaaaaaattatcccttctaaaatgtgtatgtaatggtatctcattgtagctttaacttgaatttgtttggttttcaaatcaggtaatttggactgataaagtaagttgagaagtattttattttctatttttcagaagcatgtgtgcaaaattgatattatttttccttaaatgtttagtagaattcaccagtgtcatctaggctaatactttgtagactaatactttcagcctgtttccttgtgcttattgtccattcgagtatcttcttcaggatgctcatttttactgcatcttttttctttctgttgggttttaagaattctttaaatatatatgacgtaaatcttttgtcatatatatgtctgcagatgttgttcctagtctgtggcatgactttttattaccttaacagtgttttttgataaatgaaaacctttaatattaatgatgtccaatttaacaattgatatttcataatttgcactttttgtgtcctggccaaagattgtttgcctaagccaacatcaccaagaccttctcttatatttccttttacatgttgtataatctattatgtttaattctatgaacgatttcaggttaatttatgtatatgatttgaagtcagggtcgatgttcattttatttgtgcataaatactcattagagtattctttgttgaaacgactatgcgtcctttgttgcataacctaggcacgtttttcaaaaaataaattgatgagaggccaaggcaggaagatcatttgaggtcaggagctcaagaccagcctggccaacatggtgaaaccccgtctctactaaaaatacaaaaattagccaggcctggtggcacacgcctgtaatcccagctacttagaaggctgaggcacaagaatcacttgaagcaacccaggagggaaaggctgcagcgagccaagatggcacctctgcactccagcctgggtgacagagtgagactctgtcttaaaaaataaaaaatcaaatcaaaataaataaataaatggataatatctgtggactacctattctgttgtattgatcttatgtcaattgttaaaccacattgcttcgataattctagctttataatacatcttagaatcaagtggtgtaaattttccaacatcgttcttttaaaaaattaaggctattttggatctatgccttgccatttgattttataatcaccttgttaatttctgcataaatgcttgctgaacttttcattgggatttcataaagctatagatatatatggagaaaattaaaaccttttctagtgttgtatcttgtaattcgtgaacatgatatccctctcactttttaaaatttttttagctctccttaattccaccaagccatattttggagattttaatatacaggcctagcatgaagtttagtaagtatactatccctatatgcttcacgtttgttcattctattttaaaagacattttaatttaaatatttagttgagccttactagtatatagaaacataactgatttttgtgttttcatcttggattccatggctttactacgctcagttccagtaacactttttatgggtgtctttgcgttttcaacataaatgatcatctcatctgtaaataatgtcagtttcattttttcctttccaacatgtattacattttatttatttatcatacttttaatcatattatttttgccctattgcactaattgggactcccaatataattttgaaaaaacactggtaagaacaaatatcttcacattgcccctgatcttagaggaaatcattcagtctttcacaaaaatgatgttagccaattttgctggatgtttttatcaggttgaggaagttgctttccattcatagtttggaggtaaattttattatgactgaattgtgaatttatcaaatgctctattctttatctgttgagatgagcatatgctttttcttttttatgtaataatatgctggattatactgattactggatattaaatcaacctccatagggctgagataatgtactattgttttgtctttttttgcatttttggatattgtttactaaaattttgtttgggatttttgcaactatgtttaggtgacttataggtctgtttcatgtaaatatgtatacatgtatttattcatttattcaaatattgcctttgtttggttttcaaatcaggtaatttggactgataaagtaagttgagaagtattttattttctattttttggaagcatgcatgcaaaattgatattatttttccttaaatgtttagtagaattcaccagtgtcatctaggcatggagctttttttgtaagaagaatatcaattatgaattcaatttgtttagtagttttaaggctatctatctagttctctgtgacttgttgaggaatcttttgtcagtttatgtatttcaaggagttaggccactacatccaagatgttgataagcctatagtttgctcataatattaccttttaatcattttaatgtctgtaaaatctgtatttatgtccattttcttcattattgatgttgggtatttatgtgttttatttcctgattagtccaattaatgctttagcattttttccctctgttcaaggaaccagattttagtttcattgatgtactttatttttttctctttttcttgatttttttcactcaactttattgtcttccttctaattacgttgggtttaatttgtttttctatttttgtttcttacagagaaatcttagctcactggtttttagatcgttattcatgctgtatagttcccttgaaacacttattcagctgcatcctacaaatttcatatagtatgttttcatttagcttacattttatctcatttattcttacttatggtttatttacagatgtgttatttaatttttggacctgatgatttcccaaatattattgatttttaaattaaatctcatttatttatttatttatttttttgagacggagtctccctctgtccccctggctggtgtgcagtggtgcgatctcggctcactgcaagctccgcctcctgggttcacgccattctcctgcctcagcctccggagtagctgggactacaggcgcccaccaccacgcctggctaattttttatatttttaatacagacggggtttcaccgtgttagccaggatggcctcgatcttctgacctcgtgatccgcccgcctcggcctcccaaagtgctgggattacaggcgtgagccatcgtaaattgattctttagtgaccacagaacttcatatgatttcaattttcttaaatttattgagactggtcaatcttttgttcaggcactttatacccttgctaattttctgccttctctttctatcaactactgaaagtgttcatatcttcaattataatattggatatgtgtagttctttttcaatctttatcagttttaaacctctggtattagtgtatccacatttaggttttttatgtatactgatgaattgatcccttcaaaattacgaatatcattctctgtaaaaaatatttaattgaccaagattgtaaataaagtgtacagcacaattatcatatatgtataccttatataatgattaccacaatgaaattagttaacacatctattaccatccaagccgtatattagatttgctggaattgttcatcttataaagtttgtatttttataacatttcttgttataaactctactttgtcttatataaatatgaacactctagcttctttttaaaagtgtttgctttgtgtgtttattttaatccttttgcttttaacctatatgtcttcatatttaaaataggtttcttctagataatgtcttaggtattggtttttgattcaatctgacaagcactgctttttcattgtttttaattgagatgttcagacaatttaaatgtatcattattttcagtatagttgtgtttacatttatggtattgcagtttttttctacttgtctcgtccattcttgttcctttttctcttttcccttctttatttttgattaattaagattttaaaatttattttatttttaccattagttttacttttgtgttttttattggatacgctaaggtttctaatatacatctttaccttgcaatagtacttttccaaataatattataccagttcatgtatacagtaagaatcttataacaatatacttctattttcaaactttccatcgtttctactatttttggtgaaaattttatttctctgtatactacaaacaccacaatatatttttaaagcacacaattaattttatagattaaaaagtgtttacatttactcactttatttccatttccagtgctcttcattcacttgtacagatacagatttttgtctgattttattttccttctgtctaaagaatgtcctttgacattttttgtagtgcagttctattgagggttaattccctcagtggttatttttatggaaaaaaaaaagtattaatttcacctcagttttgaaaaaattttcactgggtaagacttgtaggttggcagtttctttttcttatgcagtattttaaaggttgtgttagttttaagtactttctaaggagtttgccgtaattcttatctttgttcctcagtatgtaatgtgtctttttttcttctgactgcttttaagaggttaactttagtagtaattttcagcaatttaattttgtaatgtctcaatgtgcttttctttagtttcattctgcttgggacttgtcgggctgcttggatctgtagtttgataatttctcagcctttatttcttcaaaaatctgttttttattccttctaactcttctccttttggtactccaattatatgtaagatagactatgcaatattgtcttacaggtcacttattttctgttcattttggttcccagactttttcctctctgtgcttgctttattttgaataatttctgtataatgtcttcaatttcactgaccttctttttctgcaatgtataatcagctattaatcttatccctaatctcagctcactgcaacctccgcttccagattcaagtgactctttgcctcagcctcttgagtagtttggatgacaggtgcacaccaccatgtccagctaatttttgcagttttagtagagactgcttggctgtaccaaagccaggctatttccaactcctggcctcaaatgatccacccaccttggtctcccaaagtgatgagattacaggcatgtaatctcattccttggcctaaatatctttatttttatttatttatttatttatttgagacagagtttcactctgtcacccaggctggagtgcagtggcgcgatctcagctcactgcaacctccccctcttcggttcaagggattctcgtgcctcagcctcccaagtagctgggactgcaggtacgtgccaccatgtctggctaatttttgtaatttttagtagagacagggtttcgctatgttggccaggctggtctcaaactcctggccacacatgatctgcctgctttggcctcccacagtgctgagattacaggcatgagtcaccacaccaggcctacgtatctttaaataatggatatgtgactgcacgactgcagcatttgtatccagatagataatcaattcatctataaaccagctatcaagtaactgtctaaatatttaaaatacagttcttgtttagctcattcttagttttgatcacctttttttgttgggtggtggggagccctgctggtcactttgaaaatatactacggtcaaatcttctgatatcctgaaggtttctttcagctggactaagctcccaactccaggcaagcccaagtttgtggcctcccgcattagtgctctttctatctaccagagtcgacagtatttgttcggctcagtatctgagtgtagctcactccagttaactagagttgttgacttttgcagaaatagaagcagtgggatccaaccgatatttagctacaatgcgaaaatgagtgcagttggtacctgatgtccaagtacaatgcactgaagtgtcaagattttcacatactttctgataaattgattctccatattctgtcccatcattgacattaatgtgtagttgaaagtctccagtcctgtatagcccagcgagaagttattccttgtcagctttgatttgacactgtcaaaggtcatctggtacccagcaagccagcctcatcaccaaagacagccaaaccatggatttgaagtcctgaaaaataaaagtcaacatcacaaccaaagtgtatatattctccttgtaacaggacttgatcttatcacttttctctcctgtgtttggtgagaaggtagtatctaatgtcagtttcaaaccttgaaaaacctggtctttaactgtgatttctgttcccagagtgttctgttcccagagtgttctacttttctgtgaaagtcagatcataatcacaccatttatatttggtctccaacgtcccagtaattttaccagtgtctgtatgagatgaaccagatgttgagaattccatgccactgcgtgactttttttttttcacatccagtttcaccaaccctgaaccaaatcctttgtggaaagtatctctgacagctatgccaaggtcagcatacgatggaggaatacattggccacactgaggtctgtttgtaggtcaccatggtgaagacttgggaagagataatctggtggtctccagatggggggtgctcccactgctgtgctcacagctgaggccactgggtttgcctgctgttgggtcacagctgcctcgactggaggacaaagtggaggcacatttccacttgcagcctgaatgttttccaaatgtaaaaatatttttgagctgtattagtcagtgttctgcttagaaacagaatcagtaagatagatagcagtaagataggtaggtagatagatagatagatagatagatagatagatagatagatagatagaagacaaaatgagccagccgtggtggctcacacctgtaatcccagcactttgggaggccaagatggaagggtcatgaggtcaggagttagagaccagcctgaccaacatggtgaaacttcgtctctactaaaaatacaaaaattaggtgggtgtggtggcgggcacctgtaatcccagctactcaggaggctgaggcaggagaatcgcttgaacctgggaggtggaggttgcagtgagccgagatcatgccattgcattccagccggggtgacagagcgagactccgtctcaaaaaaaaaaaaaatgaaatgtattatggaaattgactcacacagttatggaggtcaagaagtcccacgatctttcatctgcaacctggacaactaggaaagtcattgttgtaattcagcttgagttggagggactgattgtgtaaatcttagtccaaggccaaatggctgagaaccaggggcctccttggtataagttccatgcccaaaggcctgagaatcagaagctccgatgccctagggcagcataacctggatgttccaccttaaggaaagagagctaaattcttcccttcctctgcttattttgttctatctgggcccacaaagtattggatggtgcacatccatattggtaggggcggatattctctacttagtctactgattcaaatgagaagctcttcaagaaacaccctcacagacacaccagaaataatattttaccagctatctgggtatcccttaacccagtcaagttgacttataaaattaaccatcacgttagccttatttctagtcgtaaattcttggtaaatatttgttgaatgaacaaatgtcatattcttttccaacaacaatagctatgtttctaataataattgttaccgagtgtttagtaagtaccaaactctagactacgtttttatgattgaacctcatttagttctcacaactaattgtgatggaaaaaatgataaggaaactgaggcttagaaacatgaagtaacttgcctgaagttagacaactgatcagaagattgacccagagagcttgtctccagaatccagtctgaatcacaatctactgtgcctttattttagccacttatgaacaaataaatttagtaaccctcttgctaaatatctggcacacatggtttggttgtataggattgaaaattttttttgtacagatatcacttttcattagaattgttgtagtgattagcatgcttatattttcccaaatgtgccatctctcatctcaaattctaaagtcaatgagttgtctttaggagaaagaactggtttatatcttttaggctcaattcttggagtgatcaatcctgctaatgctcatcttctttccagttagtaaggtctgggtccttgcacttttttggattctctttttaaatgtaatagaaaagaagtagctctgggcttcgtccagtatgttcctgaattgtgatgcagttgtctgtagtaaggatatcaataactgtggaagtggcgtttccctctaacctcctgggaacaacatttttcactgtgtgggtttgtctgtgatggagagagctgcaacaaaaactgtggttgccaccatttttacataggatggagggatagatacttttcattgcgattcaaaataagtaatttctggcagaaataaaaaggattctcttgctgtacttattccatagctagtgattaatattaatattacacctccataaccagaggcctttactgtgcatgacattggcaatgatacatcctaaaaaaatttgggaagtatgaggatgcttgagatatgccatgttttccttttttcctttctaattttctgctttcctctctccttttctttgtgggctgtgtgtgtgtgtgtttgtgtgtgtgtgtgtgtgtgtgtacactttggtgtgtctcttaacaaagtcttttcatctcaagctccctgatatatgtggaatttgtccacccctctctgcctctgttttctctcgtagcttctatcattcccagcgtgaactataacctcctaactggtgtcttcacttgtgttctgtttccctattgttgattcaccgcatatcatttaaaagatgttttacaaatgaaaatctgagcattcctgttgcttaaaaatatttggtggctacctcaaatccttaatatttctaatcttcatgattatgttcctgaaaatactctctagctgcattcatttactagatcattagattttgtgtgtttttggctgtcatcatagtaagatatttgtgtcatcagtacatatacacacacatacacacacgtgcctaaaacaaaagtttcacaaaaatacctaccttttctacacacacatatccacgtacctatgtgacatagatgtataatatatgtgtgaatatttagtatatattactccccattacatgggaccaggaaatatgtttgtcctatttgggtacttatggccaacattttgaattttgcccagtacagaataggtactcaggatatatttgtttttaagaacccataagctaaaataaactttacaaaagaatgctatgttaagaagccataagctaaaataatcttcataaaagaatgctatataagtgtttcaccctcaggagtttccaataaaataattttttgtaggaaaagcaaagctaagaaaatattctctatttctatttattgatgtgattttatgtgttaactaaatgtcacacttataataattttcctttgaaatcaataatagtagttatttcagtgatagagtttcacatattgcagattttaatatatactatacaaatgtaggaaaacaaaccacattaaaaaatgtatgtgttgctttgtttaaggtagaacattacattcattttgttctgatatgtttggctttaggcagagatatattttcatttactagacaagattcatcattgtagaatccattaactaggcactgagtacctaaaagctttaggtgtttagaggatgtttggaaaactgatgaaatgggaatctgagctgcacaggtaggatccatttaatttggggcatgcaggagtcagccttaagggagattcattatgatggttaataaaaccatctagcatatgtaattggtgtgggattgtattgataaacttcctttctagagtatttgagctggctattgagcctttcagctttcaatgttggataaaatttatattagcctcaagcattaaaaccaagtagcttcatgtgtttactatttgttggtctttatacagtccaactttataccaggatttgaataaggcaaaagtgcattatttaatcttcagagatatcaacatatatccagtatggtgattgatagatttcctaaagtcatctattatttgcttttcttaatatcaactgtggctattgtctcttctaaaattatttaaaagaagaataggattatttcttagtgcttttttataattaaaaaaacaaaaggaaaatagactcaaaaattgatagtagttggggtccaatctttgcatttttctattaaactcttgaactcatatggataacatgttcttcttacaattacttactagttaggaatcgactaagttgcaatgaagagatttttaaattatggaaatttgaaagaattcttgaaaacagttattttaacaattatcccagtaaattgaaataatttatagcatgcttttctatttcctgcccagcctttaaacttttattttgcagtaatggtattatttttctttctcagcaagatatggagatgataattgtttattccagccatgatcttcatatttgtgatccttccctgaccagctgtgctagagtatgttgttagtgctattctgggaatcatgtaaaagacttggtcacttaatgtcaggaggtgatcttggataaagtcacttagaaaaaggacaaggcaactcctaatcttaagaaaaaacagatgaataagagtataatatatactcagtatataacagctgccttttctctcaatcttgccagcatttgatattttttttttggtctttttgctagccattctatttgtagttctctgatgattagaaacattgagcatttttttcatatacctcttggtcatctttatgtcctcttttgagaaatgtgcactcagatcctttgcccactttgtagtaggattatttgtttattttttgctgttgaattatttgagttccttgtatattcttgatattagtcccttgatggacacatagtttgcaaatattttctcccaccctacagatagtgcaatgcctccagctatattcttcttgcttaggattgctttggctgttcagggtattttgtagttatgtacacattttaggattgttttttccatttctgtgaagagcattattggtattttaataggaattgaattgaacctgcagattgctttgggtagtattgtcattttcatggtattaattattgtggtccataatcatgggctatctttccatttgtttgtgtcctcttcgatcactttaatcagtgttttctactttttttgatagcggtctctcacctcgttggataaatgtattcctaggtattttttttggtagctattataaatgagattgctttccagattctttttcagctggtttattattggttttaaggaatcctattgatttttatattttgattttgtatcctacaattgtactgattttgttatcagttttaaggggttttggtgcagtcttcaggtttttctagatataagatcatgttgcctgcaaagagggacactttgacttcctcttttccagtttggattctttttatttttctcttgcttgattgctctgtctaggactttcagtactatgctaaataggagtggttaaagtgtgcattcttatcttgtttccagttcttgaggaaaggctttcagctttttcctattcagtgtaatgttagctatgggttttatcatatatggcctttattgtgttgagatattttccttctgtgcttaatttgttgaaggtttttattaggaaggtatgtttgattttatcaaatgctttttcctgcatctattgagatgatcagatagttcttgtcctttattctattgatttgatgtatcagatttgtcaacgtgcctatgttgaaccatccttgcatctgtgggataaattccattagattttggcacattatctttttaacatgttgtaagatttagtttgctagtattttgttgaggatttttgcatcaatattcatcagggatattggcctgtgattttcttttgttgttgttgttgtgtctttgtctggttttgttttcaggctaatactggccttatagagtgagttagaaagaattccctctttttaattttttggaatagttttagaagaattggagttagtttttcttcaaatgtttggaagaattcagcaataaagccatcagtcctgggcttttctttgttaggagactctttattacttattcaatcttgttactaattaatggtttgttcaggttttctatttcttcctggttcaatattggtaggttgtatgtgttcaggaacatatccatttcctctaggttttccaatctgttgccatgtagttgttcataataatctcgaataatctttcttatttctgtggtatcagttgtaatgtattttttgtttctgatcttattttattttctttctcttttcttaatctagctagcagtttatcaattttatcttttttaaaaaaacaactcttcactttatctttgtatttttttagtctatactttgtttagttctgctctgatctttattatttattttcgtctaattttgagattagttttttcttgctgttctagcttcttgaggtgcataattaggctgtttatttgaaatctgtctactttattgatgtaggtgtttattgctacaagcttccctcttagcattgcttttgttgcatctcataggttttgggatgttgtgtttccattttcatatgttttaagaaattttaaaattccttcttaatttcttcattgatcaatggttgttcaggattatgttgcttaatttacacacatttgtaaatttcaaacgtgtttcaaatttcctcttgtcattactttctatttttttccattgtcatttgataagatgtttgatatgacttagatttttaaaaattttttgagactttgtcttgtggcttaatatgagatctatcctggacaaaagctctagtttcttataggtggactggagacagaaaaatcagtctttggcaaagacaaacagagcagataagtagaaagaagtgagcaatattacaaattcagaaagacagaatgagttgctggtttcattgttccccatgactatgttaattcctcttgaaaggtatgtgtataatctagaaaacatgagatatttctgaatccagaaatagtaggagtagcttcctgttgctaatggcgctgtgctgtcagcttactaatcttggttgctaacaaattatgtcagtgatgttgtgatcctggagcaagctgttatactgaaactttccaattttccagacagctttctgtcatagaagaggctgtagtttcctccatggtgcacttctgaattgtgacgttaggagttcttcctgaaggctctgcctagaatatttttgttcatttctcccagtgattctgtaagtcatttaacaccctgtgatacacaagttgggtctgaaaataccaagtgtggattattttctctgaaactgaactttaacaaatacaataattatagcatttagaaaactataaggtgatactatgtatttattcattcatatgtgcttgagagtcattggtaaacagacaataccctcatggaatttacatgctagaggaataagacagacaataagcaataaacagaaaagaataagtacataatatatcatgtgaaaaggtagtaagagctaagaaagaagaagtggaaagtgtatctgtagttttaaataaggtaggcagggtaggtgacatctgagcaaagactcaattgaaggagattttgtattgttatttcaatattgtttcattatacaagcttcaagatgaaacttcagtttctctttaatattttatctataataacactatataaccttttaaaaatttcatatttgtctcatatttgtcaagtgtcttcattcatcttcttcagataacggatatgcaggctttaatacaagtatttgcgcagattatcaggtggttagattttcctttcttatatctcatttacagccagagcaatttaagagtaggttgaaactgataaggaattaagtaaagaccattaggtaacagttatagaagtaatactttaaattttggcgatcataacaataacaaaagagaattttgcatagggtgaaagtttcagatgattatgagtagcaagaaagctcagaaatcataaatgttgacaattcttagaacgtatgaatctcttacataacagcaaagatcattccaatttgtcaaaacctctccaaatggaacagatattttatttgtgatttactaaggccaatgaacatgaagtttttactttctttgttgtggccactccacctttatttgcatggcttaaagttttcactagatattttcgcccttttatcacacgtcacattattgaccaataatgaacttcaaatttactaaaaaccctgtcattggtacttactcaacggtgcctttctacatatttgaaattttaattttgcaaattctaatagctgaattttacttttttcattaaattttatcttgttagattggagtcatttttatgactattgaatctaagtaatccctgactcttttgtcagataagcaatttttgggttcccttgttgtcttctttacattcttctctactctcattcatgagactaatgagtcttcttaaatgtatcaaaatggaagactaaatctggcagcagacaccagaaatgtttcactgactgcccatcaaaatcccacactcataggaatgatactctagacatttatacatcgcccagccatttgtacgtaagaatgaccattctgccatttatacatttactggtgtaaagtagtgttcccactgagtgaatgaacttctgtgtgattcacttgtgtatatttgctacagcattttttctctttttaaagtggagtcataccataaccttgaaatgctattaggattaaataaaataagttagtaaaataatccctaatatatattaaatgtcttatgaatttaagttctcatttctcactttcccttcttttttgttatataaatgtcttctttgaagaaacgtttattcaggtcgtttgcccatttttttattgagttgtgtgagttctttataaattttggatattaaccccttaacagatattttctcccaatctgtaggctaccttttcatttcgttgattatttactttgctgtgcagaagagcttttcagtttgatgccatcctacctgttttctcttgtgcgtgtgttttttttgttttgttttgttttgttttttgagacagagtctcgctctgtcgcccaggctggagtgcagtggcacaatctcggctcactgcaagctccgcctcccgggttcacgccattctcctgcgtcagcctcccgagtagctgggactacaggcgcccgccaccacgcccggctaattttttttgtatttttagtagagacggggtttcaccatgttagccaggatggtctcgatctcatgacctcgtgatccgcccgcctcggcctcccaaagtgctgggattacaggcgtgagccactgtgcccggccattttgtcttgttttgtttgcttttgttgcctaagcttttggtataatatccaaaacgtcattgccaaggccaaccccaaggagctttttcctaattttcttcttgtagttttataatttcaggttttacatttaggtctgttatttattttgatttgattttttgtatatggtataatataagggtccaattttagtgttttgcatgtggatatccagttttttcatcactatttattgaagaaactatccttttcctatagtgtcttcttggtgacctgtcaaaaattagttaatcatatatgcctgggtttatttttgcactctctatgctgttccattgatctgtgtgcctgcttttatgccagcaccatactggggttttttttggttttgtttttgttttttttgttttttttttgatggagtcttgctctgtcacccaggctggagtgcagtggtgcgatcttggctcactgcaacctctgcctcccgggctcaagagattctcctgcctcagcctcctgagtagctgggactacaggcatgtgctactatggccagctaatttttgtatttttagtagagacagggtttcaccatgttggccaggcttgtcttgaactcctgacctcaggcaatccgcccaccttggcctcccagagtgttgggattacaggcgtgagctactgtgcccagtccatactgttttacatactatagctttgtaatataatttaaaattaggcagtttaatgcctccaactttgtttttatttctcaagtttgctttggctattcagtgtcttttgcagttctatataatattagcatttttttccatttctgtgaaaaatatggaaattttgatagagatcgtattgaacctatagatagctttaggtagtacaaatattttggcaatacttacttttccaatcttgtccaaagtgaaaaggaagaagcaaaattatcccttttagcagatgacatagccctgtatatagaaatctttgatgaatccacaaaaaactgttagaactaataaatgaattcagtaaattttcagaattcaaaatcaacataggaaaatcaggtgcatttctttacaccaacatgaaacaaaaatattgaaaatgtattttttctttcaaaacttttactcactttctcatcttacagcaattgattattaactgaaaatcccaaggcacctaacctcatagccttatttattttctaattattttattattgaaaaattaatacatgaacaatcagacatacaatgaaaataaatctcactctttgctatagaacctccatccctctcctcctagcaaaataaaataagattttattatgctagaccagaactatctagtggtcttggaagtcactaaactgtaaaaggaggggaaaacgacataaagataaagaagataatctgctaactttgttgctttcctaaactgagactttaattaaaacaattagaccttgggaatttagcctatcagtctcttatatattgaccgaacaatgtcagatatagacattggtttgcagattaagttcctacaaacatatgattaagaacccctttaaatatgctcttttgtatgaagcacttttcagcataggtacactatttttttgttttaaatttataaaatagaacctcattttgtttgttttcaaatagagctcaagcaaagaggttgccatgattcttacaggatcagaaatagagaaagcagaatcagattgaagagagtggttggctgagatacatttatcaatttgattgaagagacactacagttgtattgtttaacatgatggtttttggaagtacaatatcaggataaaccataataggtatctcattctagaaaccatctttgcaaaatagtttttccaaagtctagggaattaattcattatggatttgtgttttgattagttaaaaatagtattgtatttatcagttataggtacaaactgggagattcttcgtttgatttactggttttaaaacaaagatctttggaaagatttatctttctaaaacaacagaaaagaaagggaagatgggggaatacgtggtgtcttagcctgttttgtgttgctataacagaatatcaaagattgggtaacatataaaggaaagacatctattttttacaatctggagggtgggagtccaatagccgggtgctggcattgaggagggcctttttgctgtgtcatctcatggcagaaggcagaacagcaaaagagcacaagtgctcatgagagagaggaaggaggccaaactcatccttttatcaggaactcactcctgtgataatggacccaatccgatgataagggcattaatctattcatgagggcaaaacgctcatgacctaattaccaattaaaagtctcacctcctaacactgttgcattggggattaagtttacagcacatgaactttgggggacacattcaacccatagtgtatagtattcaagtaaaatctgaattcattcttatttagttagaaagtcaaaccaaaacatttccaccaattcattaaatatttttttggccattttttctgacttttcaattttatatcttaaccagaaagggattgatctaaacaaaccttaaaacacaaagtgaattttgacaaagtttatgagtgtttgcatattttctacaaggttgtatttcttcttccatccacttttaaattaattaaatacatctctttctttcaataatttattcaacaaatatttactgagatttcacaatattctaggcactgtgaatacaaataagaaaaagctgtttgccctcatgaagcaaacaggaggaagaacgatgatcaccatacataccagtaaaacatataaggagacagatgctgataagtacaatggagaaaaatggagcaagaaagagagaaaagggattggaatgacgggctatttcaaacaggttggtttggaaagacttgagtggagacttaacagaggtgagagagtgatgcagtgctgaggaggaaggctttgcatgaaagagaatagcaagggcaggccctgacaccaaagagggcttggcaagtttaagtaacagcaagatggccaacgtggttgtaaggaagagctgccaaggtggactcaaagaaatagccagggtcaaactgcggagggtcctgtaggccactgtcagcacattgacttttattctgaggatctgaagaagtgacattatctcacatattttagaagagtcaacctggctgttgcattgagtgtagagcacagaagcagacatgagggtaaaactagagagacacacacacaattgatcatcaatatttgcaggtttcatatttgtgaatttccctacttggtaataacccccaaatctatacttcatacatgcattacaacacatgcatgtacaatgtgttgaaaaatttgagatgcacaatgcacatgttcgaacaaggtgattctctgccctgctttctggttttagctctcatgcagtaaacaagtgtccttattgcagtctatctggggccacatttatttttgcattttcatgggattttgttgtttaaaattgccctgatgcaaagtgctgaagtgctgtctagtgttgctaagtgcaagaagctgtgatgtgccttacagagaaagtatgtgtgttaggtcaatttcattcagacataagtgatagaactgttgattatgaatttaatgttaatgaatcaacaatgcagtatgcccccaaaatagaggaaattcactaatatgcacatcaggccacaaaaatgataaattaacacttatgtattgaagctatggaaaaaaactcaatttgtgaattcataagatgatgaccaatagaaaaagcatatggaacaacattgttgcgtggctaaatgaaggccatagaaaatttatcatcacattacacagggtcaggagaatgttaaattcttctgggctagtgctggctaactcacagatttcagaaaatgttaaacttgcatgagattcaggttctgcagataaggaggctcaagaattgaaaaatacctgctgtgtcttacgcagtaaaagggtcatgtgaaagaataggttcacaatgctgataagactgcttgttttatgatgacatcagcaaacaaacctatgtaatgcaaatgccctctaaagcccaggctttaaatcattcaaaggccatgcaatgaattatttgtgagaaatatgtattaaataaagtgtctttaaacagaagcacacataaaacaaggttatgaattgattgtttgacaaaaacatgaccagctactgaaacctaaccctgtattttccatagaagcaatggttctatatttgttcattcagcatctgcaataactttttagtacatgactactacaactaatgagaatcaactgtatataaacatatatatttttgtatatgtgtgttttggactcaattgttttgccagcccccaaccaaattcctgtgttgaaaccctaatccccagtaggtcagaatgagactgtatttagagatatgaatttaaagacacaattaagttaaaatgaggcccttaggattggccctaatccagtctgactggtgtccttgtaagaagagattctgacacacaaaagagacatcagaggggcacacacatacagaaatgaccatgtgagggttgaccatctgcaagccagagagagaggcctgagaagaacccaactctgccagcaccttgatcttgaacttccagcttcaatgactgtgagaaaatagattgattttattcacctcgtctgtggtattttattatggcagccctagcaaactaagtcaacatcaggcacatcatgttggtgtcattgaacagccatatgttttatggtggtggtgtgaaatttatgagacacgattaaatttgtgtatattttgaaaaaggagctaaggggattttctgaagaattggatatagcttattagataaaaatggaagtttgcattcaggagaaaatgtattcctattttgttctttcttactattcacatgttgcaccatttttttcccaaagaaaaacaactaagaaaggaaaaaatcttatgatgtgaggataaaaagactgaccaccctagtcctatcactgaaacatttccagtggaatcagtaaaggcatgatgtgttttaggaaatacgatagggttgtttgtgacaatgtaaatgtagttgttcagggttcaattttaaaaaatttaattttaaaacacttagttttgaagagttagaaatatttgcaaggaaaaatggtttcttatttttgattaatattatttttcatggttctctaataagaagaaatcaaacttaactgcataaactataattaaattcaagagtaaatgagtaatgaataagttttaagatctaatgatatatttactctacccatgacacaattatctgaaagcaaattgattattggatataaggactgttttagggaacaaaagcgttgaaaataaatatgcaaacactttctttgtgttgtggattaaaccttactgtttttaaagtattataaaagttcaataataattacatacttagaaaaatgtactttgaaaagtaatttctgtgcattttatttctaccattagtgttcaatttcattatttggattaacattttaatgtaataaagatatatttttgcgagatagtatcttgggacaacttttaagagaaagacattttcatacattcagtttatacttttttgtattgaaatgcaatctacatgtttcactttaataaggaaccaaatagagtcttaactttgcttttgtttccttatctccaattttcattgtggttcttatttatattaaggggattatgtggctactgtaaaatattcttttcataataattgtccacattctaaggctgtattcttctcttcatgttcatatattttgtatttgtttcatagtattccatttcttttatagtgaggaaaaaatctgtttgaagtatctaagtctctaaccctatgattaccttggcaaattaacatttttagctgcagaatagttgttttctaacaaattcttcttccttaattcttttcataagttaccaagtatctcttacagctcccaacaagccctacatcttgaaaatatttaaatattttcaagatcttaaaatatttaattgatattcaatgatatcaattagaatttctgatcaatgttattttgagaaataagagctgcttgatttcatgtagctaaatgttacttttataatttttattttttgtttttaatcttttatctgaattcagacatctacttttcactcttacagctagctttatttactccttgtttttgctctttttctgccacagattaagttttatttctgttctagaaggagcttgttcttgaaaggcttactgtctattgagttattattcacttctgatatttacatgtttaattagcaacactttataaattaccttcataaatattattttatttgaacctgattgatttcatcctgtgaaatgaatgggagattattatcttcaatatgtagataaggtgactgaggttcaaagagattctatgacttactttgggcacacagctgatggaagtggcacgggtagacttaggaatcacccagtgcttctcccttacaagtcttgggctctttccactaccatcctattacctttgcaggcaattgaagcttaggtattctgcaataagcaatacttgcaagattatcaatctttagtataaccatgaatataattcttaataaataatgctatgtaaattaatgtaggcatatgtgaaagtgttttgtgaattatgtctatgcatacacagcatattaatatttcgtctggcaaaatagcactaatgtaattagatataattaagaaatacctgatgccttcaaaattatttcgggccagcatttctttattttcttataaaatataattttggtttatatcaataaatcacacataccttaaaaagatgtatttctacaaagcttatatattaagtagaatataggcttacattattttaacaaagaataaagggatgatggattaaacaaatctcatgtctctctcatgtaaaagtgcaagatgagaacctgttgtggttgcatgggaccggggagggaagggatagatagggaagctctgccccttgaggtcatccaagatcccaaatttcttctacattgttgcttcaccaagcgtttcccttgtccgcctagtcaaaactcgtcactacaaccacagtccaacacaagggaagggaggaagaagtcaaagttacccgcagtggcacaaacctcttctgctccacatccaggaggctgtttcttatttgcatagcttttcctagctgccatgcattcaattaaatatttagggattctgttactaaaagagtaggatgagagaatgggtattggttgatgaataccgttatttcctagcctgatcactcagatacaaatgagtcatttatttattttttgatacatttaaaacatacttttggacatacagtaatccaaagtatttttatattacttgacatagctcaaggaatgtataattctctcttttgggccagttaaatctaattgttatctggcaacgtatacactaaaaggtgagttattaatcactcctcccctgacttacacacaatcacttgtatagtgggacaggataccacaaagatacttcttttcagaaaagccaagaatattatacaaactaaagtcattggttcattagagttatcaaatcctgctgagcagtcagtgctagctcttcctaaactaaccatcattattctgcctttggggagtaactattttgttctagttttctccgtggctcctggattttccatttgggaagtttttgtttgtttgtttgtttttttctattattctctatggattcctgttaggtgagtgttagagttgtcttttccttcttcggaaaagacaaatttcacagtccatttcctgctagtacagatttggagacctagagattgctttgaaagtttaaaagacacaggctttttgaaaatttcccttgtggtttctttgaaaagacaatttccatcaaaatgtaatcgtttcagtcagttccatgtgcaggtaagcacaagcagagattttatttaaccatagatattaattctgaaatctcgtgtttatttactagtcctgtccagctaccaacccacagctgacattacagctaccaggaaaagaatgacaaattacaaaaataacatttgtaaaggtataatacaacagtaaggactcaatatcagagagggcagaaccattctgaagtgatctgaagatcaccagctgcttaaaacttcctagaggcattggccaattctgaatcagggcagagaacaagctcaatgcaagccgaggctatgattaaggaaaaaaaaaatcaacaaagctgttagttgtcatggaaagctgactgacaagttataaacttgagaggattctaacacatggctgagttctgggactactcaagaggtcaaggagccagatcaaaagggaaaacaaaattttctacagatctgtgaatattaaggaaaaaaaaatatcaccaaagagcgagagtggcttactcaagcacacagctaatctccctctgaatagaagtgccaggattgaaggtcaagtggctaagagctgaccttggaacctgtgacagtagagcttgatcttaaaatctttcagggttgaagagaagagtacttggtaaaaaccatttgtcaaaagcccaggacaccatgactgaggagtaggaattaatcagatgtaaacagaggcttagcaaaactattaccaaatcccaaaactgttcagtctctaattagttgtgatcatcagttccttcttacatttgtctaacaaaggaaatgggcaaccctctctaatggaagataacatcatatggaacctctgtggttctttcatgacaatttccaacatataataaccattactagatatgtacaaaggtaggaaaatatgactgacaataaagagaaagaaaaatgatccaagcacacccatggatgatctagatattggaggtaacaaacaagaacttgaaattaattaagaatgtataattattttaattatacttaaaatgctttccaggcatggaagcttatgcctgtaatcttttggaggctgtattagtccattttcatgctgccgataaagacatatccaagactgagcaaattacaaaagaaggagatttaattggattcacagttccacatggctggagaggcctcacaatcatggcagaagatgaaaggcacatctcacatggcagcaggcaagagaagagagcttgtgcagggaaactccccattttttttttttttttgactggagtcttgctctgtcgcccaggctggagtgcagtggcatgatcttggctcactgcaagctccgcctcccggtttcatgccattctcctgcctcagcctcccaagtagctgggactacaggtgcccaccgccacgtgtggctaattttttatatttttagaagtggggtttcactgtgttagccaggatggtctcgatctcctgacctcatgatccacccacctcggcctcccaaagaaactctcctttctaaaaccatcagatctcatgagacttattcactatcatgagaaaagcatgggaaaaacctgcccccatgattcaattacctcccaccaagtccctcacacaatgtgagaattcaagatgagatttgagtgaggacacagccaaaccatatcagaggccaaggcaggaggatggcttcagcccaggaatttgagaccagcctgggcaacacatggagacccaatttctacaaaaatgtttttaaaaaattagccaggcatggtggcgcatgcctgtagtcccagctactcaggaggctgaggagggagggtcacttaagccttggagttccagacaagcctgggcaacagagcaataccccatctcaaaataaataaatacatacataaaatgttaataaaaattgaggaaaagttggaaaataaatgaaggatgtagacttttaatatagaaatgctatatatgatggtgaaacctcatctctactaaaaacacaaaaaattagccaggcatggtggtgcacacctgtaatcccaggtacgtgggaggctgaggcatgagaattgcttgaacccggaaggcagaggttgcagtgagccaagattgtgccactgcactccagcctgggtgacagggtgagactccacctcaaaaaaagaaaagaaaagaaaaaaattctatctacgaaaagattcagacgaacattcaagagctgaaaaaatgcaatactaaaattaaaaatcaataaatagtcttaatagcaaacggagaaaatcataaaatagaagatatttcaatagaaaacatcaaaacaaaagcatctagagagaaaaagctaaaaatgaaataaaaatgacaaaagagatgtgtgtaacacactcaaaagatcaacttaatgaaagctacactctgaaaccatctgaaacagagaacagtctttttaactgatctttcctcatgagaacaaattgcaatgtgactgagagaggcttgggagtcccatctcatcttttgctgtttgagatacaggagctggctagttttctaaactaagtgaggccccaagtgaagttgtcttcagccaatataaattgaaggtaatgggatgaaagacatacattttagcaaagttgtattctcttttgtctctcctttcaaatgaagtaagtcttgcgaaatttatttctttgcgacctcttttaaagtggcaacaagcagccaagaagcaccaccattttgactttttccaatgtccttgactagagctgtgctgtctaatacggtaagcagtaactatttgtggttacttagatgtaaattatgaaaattaaatgaagtttgatattcagtacctcagttgcagtagtcacagttcaactgctcaatagtatcaaacagcacagatgtaaaaaaatttccaccatttcctatattgatataaggttctattagatagcagtaacctaaagttatacactcaataatcatacaattttccttttaacttttactggatgcttaccatggcatagttaccagttttttccagcttttcagctggaaatactaagttaagagctttactttagaataactggccaggggtgcattggttttgctggaatttaactatcagaaactacatatcattccttgaaggtccatgttggaagagatgattctttcattttttttcctggtataataaggatggctgccacttttctcagagcctagtaacaagtgagtttggtggtgtggaggtccaccaatcagcataaggtggtatttaatttctctattttcagatgccacccaagccttcccttctgtacactgtttctgagtttagtgtccttttagttcagccctgccatagagcagtcctccatttttgaaaaagaagagactagtgagagctgatcaccaaaaaatctagttgcttttcgcgcagattttcaactagtttccctattttctatttcacttattctctgttttcagggttcaccctgtctcatttttgagcctttttttggcatgtagtgtatgatgatttcctttggctttctttatgcttttggatatttagatttgaggtttcttctatatgttgcctttcaccacttggccaccttcttttcagcttcattattttattaaaatttcctattcgttgccttcttctctggtattttcttgtcctcaaggggaccctcagtctttttttttttaaccctttcacagacattttagaatttttaaagggaaaggaggtaaaaaaaaaatgtttactactccaggttgaaccaggaatactgcattgttttataactgagctgtgaataataggcatgtgaaaaatttgtgttggtaggaactgatatgtactatatagtcaatatattctgggaactcacattctttgaaatataaataattctatgccatacttggtatttttcacatgaaaaaaactgaaattccaatagattaaatcatatcctggaggtgcaagagcttaataagtaacaatctgtttatacttgattttgtcatgcttccttatatcataatacagtgtttaaaggctcaagaatttgtgcctgggtttgaattccagttgtacaacgcaatagctgcacttaatttcacattctacttaatttgtctgtgtctaacttttgtttgtctctgtgtgtagaatattgataatataacagcagtatctacctcataggattattggaaggattaaatacattaatatatgtaaaagattttgaatagtgcttgacatacagtaagttctatagatgtgttagtaatttctaattgtattactttgtgctccatctatcccaaggaagaaaagatattgcttctgcttatagatggtcttttaaagctaggaaatacgacattaaaggtgtgacgtctacttgcactttaaaaactctcgcctttctagaactttctgttactaaagcttgaaaatgaaagaactgttactgagtgagctaatgaaagaaaaacatgctgatttcttctacttttaaaggggaaatggatgatgtaagttctgaagatagatctctacgattttttttacatcctctagattacttttagtggtttttccatactattttcattctactcattctaatttcaaaagtccttctaatttgtatatttgaattagtatccctagaaaacattttctccataaccaaattgatgtagaaccatagttttcaaaatgttattgcatgggtcataaaaagtagttgtggggactttaaaactatcttgaaacaatcttcttgtttcatataaaagccaatcttcttggcttttatatttcagattaaatccaaaccactcatagcttgagtaccatcagctgttggcaaaacttagcttcttggttctatgtaaaagtgaatcattttgtaaacactctgacaaccaagatataaatcctttggtttacacaggtgacctcatgaatattcttttccaccctttgtgtgtgttagagggagaaaataccgcaggcattgaatattgaaattttttctaatcattgtaactggaaggagacgctgacagatccattctctggacatgtgttttaaagttaaggaggaaaagacatgaaaaaataccgtataggctttgctgaaaccaaagcatttggagcacagtttaatacgtttgccaaattttaaatacagctgggttctcccacagtttctttaattggaagcagatttctgtgctaattctgtaacgtgaagagagctctaacagtatttctttcctaaaagtagggcatatatttgcagtgaccacttctaacatcaacaactccttaaaaatatccgacttagcaattttcaatgcgacttagaaattttcaagagttttcagtagatttattacctcatgtggttttatatacttaatagttaagtgtataaataattaaaattatttaataactgataattaagttcactgggtattttgtttttagaaaaaagtggatcgtatctaaagaattaaaaatatggaaatgttcatattgtaaagtaaaagtccacattctgcttgaatgtgaaagacaaaatgtttgtttctttcataagtttaaaaaatttaccaagttcttaacattttaatatgataaaatttagtggaaaaggctaaattgaaacaaaaatgtatttatattatatactacatatattccattcaaaactacaatactagtttctgagtcaccaaatgtggaaattaatgtcaatatgatgaaaatacaattttggaaaatttatctgtttttaatacctatatattcactttaacactcaatatattacatttttaataagcactaatgatattaatagtaatttgaaagaaacatattacaaagttttataaagaaagcattaaaataggtttttggaagattaaccttgaggcattatttcagtctgctttccaattacatattggaaagaggggtacagcatctactttttaatgctgctcttactttggtaagaatctaggtagtgggtaaaaaataaaatcatttgaaatagttttttatttattgaacattttttaggctgtacctataaaatatctttatagcaataaatacttttatagcaataatctacaccagatgtgttcatcatgactttttaaactttctaccctttcaaaattacatatctggtttttgttgacagtactattataacttagagaatttacctgattttaatagcacagcaaaagagctgttttaggagaatgagcataattgaaatataggcatttgctaaggagagtctataaagaccattttcattaagacacaaaaagattccccaaatattagtgtaagctctaaaaattgtgccagcagtgtaccctgagaaggcagttatttccttattattatgcaggcacctaaataaaaggtcgatgtatgtatcagttttttccacaagatctttattgctttctcttggtctttgtactgttccctttgctaatactgcggtatcttaatattaatctattttattgtaagctttgatatcagttgagctagccctcccatttttatttgcatgcaagcgtacttagctattcatggctctttcaatttcatttccattttagaatcagctgtatagtcaaaaattctgttgtgatgttggttggtattgcactgagtctgtagatcaatttgtgaaggactgacatatctatattgccattcatgaacatgatatatatctccacttgcatcattaatttctctccataaacttttagaattggtgcatatcttttctttgattttttccttgttgcctaatttttgtacactatgataagttgtaccttatattttgttactgatgtttaaaaataaaattgattatggtatactggttttataaaaaatggccttgctaaactcttattaattccatcaatttgtagattatttctattttctatttcaaaaagctacatcatctgcaaatattgacagctatcaatactgacatgttgaataaaaatggtggcatgaatatctttgtcttgtgcttaatgtcttaccattgcagatttagcattaagtaattgcagaaaattccttttgtagctaccctttgttatatggaagaatgtgcccatttgtttctagtttgttgagtttttaaaaaatcataaatggatgtcgaatttcagtaatagctcttccctttaaaatgtttacgtggcaaattttattgattgatttttcaacataagccaaatgtattggtgaatgtagtaactcattgctttttttaactagaattttccccattatgagtgaggttgagtatctttcttttagtgtgcttattggctatttggatatccagtttgtaaaatgcctgttcaagtcccctctccctttttacaaaatcaggttgcctgaccttctcgtattgatttatagatgctcattatatattcctgatataagcccttgttagttattcgagttacaaatatcttctccctcacagcaggcttgacttttcactttgttaaggatgccttctggaaaatgttacttaattttaatgtgatgaagttgctcaatttttaaattaatggtttttctggtaatgtttaagaagttttttctttctttctttcttttttttttttagacgagtctcactctgtcgcccccaggctggagtgcagtggcctgatcctggctcactgcaaccctctgcctcccaggttcaggtgattctcctgcctcagcctccaaagtagctgggattacaggcgcccgctaccactcctggctaatttttgtattttttgtagaggcgagttttcaccatctggccaggctgatcttgaactcctgacctcaagtgatccacctgcctcggcctcccaaaatgctgggattacaggcgtgagccacctcgcccggctgaggtcttttcttactctgaggtcctattgattctcttctatatcttttagaacatttactgttcttccttttaaatttacatatataatcagtctggaattcatctatatggtatgaaatggaaatatttaatttcatacatatgtatattatatatgtatataaattataaatatacatatatatgtaaattatatataaagcataatttccattttatttttttccagaggattgtttttctttaatccttaaggattcagctccttacaagggttttgttggaggtcatggggcagcaccaggaggtctaaatcatggtgggtgcattcagtacttcatgagatccattctcaactaacatgctgtgaatggcacaactcaggcattaacgtagcttcacatataccttgggaagcacgcaggagtcgaagacactccctttggaaatgtctgatagctgcagcctcttctgttttgaatgacgaacttcttagtagccttgtccttgggcatacattgggcacagtgtctgcagcaaataggctgcatgtggctgtgcctctttttggcatgacatggttccttcttttctttgtcatcttgaaagcaagaacctgagactaatttcatatttttttttgtaaattacataaaacacctttattattgttttacaaggtcagtgtttaattacatttatccacatttccatccccctttcttttcttttctttttttccttttgaacttttattttagattcagggagtgcctgtgcagattagtcacatgggtagattctgtgtctctggggtttggtggacagattacttcctcacccaggtaaggaacatagtcctgatgggcagtttttttttttttaattctcaccttcatcccttttcttgtgctccctttccctttgcctctcttgagcttccgtttgggcttcaggattacattcatccttgctactggtggggcactggttccaggaacaccactcccctctctcccacgtggatacccaaatcccagcataatcaaatcgtgtagttgaggaaccctggaatatcgataagaggaacaactgtgtttattgcaaaaaaatctgcctataagtggaccgcacagttcaaacttctgctgttgaagagtcggctgtatttttcttatgcttgaagtctatcattcagaatttcctttaatagaggcttgatggttgtaaagtctcttgctttttgtttctttgaaaatgtctcttgcaccttcattcttgaaagcctttttcattagatataaaattgtcaattgaaatttattttattttagtacattgaaaaaacatatcatataaatagatatatctttaagatttcctctttgtagttttctgaatttcactatgatttgtcagctttttatctgcttgggtttcattaggtttttgaatttgtggattgatatatgttttaattctggagaattctcagccattatctacttaaatattgcttatacattgttctttttctctctttctgaaaactccaataaaatatatgttagattttattattgtatccttaatgtatcatcaaatcctttccccaacagttttatatttttgtctttctgagctttattcttgatgttcttgatattttttttcttaactattttgcatttcacaaagtttcttcaattggatccaatttgttctcaaatccatccagtttcttattttggttaccatgcttttcagttctatacattctatttggttccttttcaaatacgctgtgtcatttgaaaatactctgttacatttttccagcttggcttttattttcttttaaattctaagtacgattattttataattattatatgataattccaatatgtgaagtgtcttgagtatgtttctgttgggttttataaacggtgcctttctcttgagtacctagttatctttgactgtgggctagacattgtattagagaaaacattttagaaaagtattgaggcccagtataacattatgtttctacacagaggattttggtttgcttttgctacatgtctagaggtgctagaaaacctagatgcctgtgattccatttcaaggcttcacattttctaggcctttataatgcaaacttgagctgtaaagtacgcacattgggtagtttatttctggttcatttgtcctcttaggaagcaatcctttggagttgtaaccctggtatgctttagaaggagtgcttctaagcccaatatagccaatctttgaggatcatggacaccacagtttgtattttgacccctgcaaggcattttcactactcgtttctcagctttttctttatattggtaagtagcctcaatgcaaaagtagccttaagtactgggtgtggttttatgagttctcatcctttcctgaatctcatcccatatttcatcttgaatttataagttatttgataaattaaaaaagaattctttttaatagtttatcaagctatttttagttgttcttagcaggaggactgatctgaatagcctaccatcagcagaagctcctgatactctcttttcagtgtaatttcacttcaacagaagttgttggagtaacgaggatatggcacatcatcattttccttagtccccatacacaccgggagataggcctaatctcaccaatgacagtgaattcagaaaacacattaactttgaaatctattcatttaagatcaaatgaaggctgttaataagtaagtattctgcttacacccaaaaaagcacattttatgagttttatgcgtagtctttctagtgaactatttggagatttttttcttctgttttttcttgttcaatgcataccacaaggccagataacttattatggacaaatgcagttgagtttgagcacataattagagtgactgtttagcaattttaaattgatataagacattagcaattggaaagtaactagtgaaaatctgtctgaccataaggtgcatacaatggcatttagcctaaaggccatattctaagttacccaaaattaattacgaacttaatagtataactattagtgcattatactagtataaagaaagtgataaaatgtgttattaaattatttagattgtcatcagtttaaaattataaataaaagtaacagtggcatagtatgtcctcagttaaccagaaagcttgggtaagcatatcaaattactggtaataaactttactatatgtctcaatcatatttctttgttccttccttgtcaaaaatgtagattatctgtctaactgcttgaaaggaaaattttcttaatattttcccttaggacattcctgttttattttgtgtctatttttttttttaacactccataatttttaaagtaacctggcaggagcccaagtgcatggaatgaaaagtcattcttggacctattccatattgcaacaccagtctcttaaatcacttttatatgtaacatttgtattctattcagcaaatggtcatattacttactattctgttgaaacattgcataggtatttgcttaagacatgcattactcagaggataataaatttcttcttgcttaacatgtagcacaatgcatctaaatacttgtatttttatttctcaaagctaaagtcactgtttctctatcagttctttgccttcaaatacaaaagaggaaaatgtaattaatgaaccagtaatttcggagtgatcatcttttctcttccttagctcacagatatttgctgctatctgttttacgctttcacaataacttccatttgcatcactctttacatgactacatctgagagaagtgtacggtaagagttagaaatattactcttgtttagtagtagcaaaactcaagtgcaagaagctgagagtcacatggccctgttcagcttctggtccggtactccctccaataaccctagtttgtctttttctcttcatttttactgatttctatcccacccgtgcatttgttttgagatttcagctcttgtgacatcatctctgcaaattatgcattgagatttttgagagatttcttgaaatttctgtttaatgagtggtgttaatgtaacatatagattttaatatctggaaaacttcattttttatcatccactactttctcttaattaatttaacatcatttgcctttcttactggtcatagtataattctgaggtaataaggtggcatttttaatttaactattcatagaacttctgggagaaattttatgtctagttcagaaggcatggcagcattttaaatttgattgtggagtattctaaccaaatcttcaagagccgtaactcgaggtgaaacctgccaacagtaagttcttctcgtagcccaaggcttgtttggttttgattagttttactagacttcatttggtttcaattaaaccttgagacaggctagtgactttcatgaaacgtgggtttctcaagttagaaaataattcttttgtgtggacgagtgtaacgttttcttcactgaaagaaaatatctactcaaagataattttggaagattttataatcacattgcaaagagatttttatacattgaactgtctcatattatgtttcttaaaaattattatattgtattcttaaatggcaaaatgaaaatcactccatatgcttccaaagcaataataagaaatatttaactatataagtataacaacattttatatttaactgcatattgttaatttgattttaaaataagcagctattctggggagttccagaaatttttaaattcatttatttttctaaaaggctttcttttagtattacattatcttaggtcgtgttcaaatgaaatgattttcctgagtcgcaagtcctttattacttaaaaactgtaacaacataacatcactggatatgagttgaaaatcgtgcatagtatttttatgcaaaggtagaaggagaagcataaagttataaacatattgtataccctaaacaaagaaaactgtggtctgtagtcctcagagaaaaatctcaggtgtaagttccttttgtattccaaattttttttgatcctaaacaaaatcctttattaatccttattaaaaaaattccatgttgggtaataaagataaatagaaaacaaactcaaaagtagtgtttgaagtgatagaagatgtacatttctctttctgtgaattcataaaccctggcttcagatactattgatttttacccagaggcatcattaaataccccaccatctgtttaagattatgccaaaaatattgcagttataaatatagggcacgtgtataaaaattagatgtatcaagttaaggatattatcataatgctcttctatattctcagcatgaaacaaaaatattaataaatatgtgaatattctgcttgtaaatatgtctgtagaatttaaaactgataaataaatttgttcagaaatgtagaatttaacatttaccactcggaaaacaagagcagatcacctcttgaataagtgtcttccaattttgtttctaacacagcaaatattttatatttacaatttaaaaaattgaattctccaagtattatgttccaagatttaaataagattaacgaccccttcaaatatttttgttgagagctgtttattaataccttatgtggtcacatcaattaaaattaatgacatctggtatacaagtgaataatttctttacatattttatcatatttgaataaatagaatgaagaacaaagcactgactttttattcatactaccaggtttggatttggattctgctatgaattcatcatgtgcctttgggatcttttcctttctgggcttacctttcatcaaatggaaagaactagaagctctcaatggttctttctacctttaacattttattggttatttacaaattataaacatttagtttggttagcataggctgtatgtttatatataggctatataattatgtgctttatatctctagtaattaaaaattattttttttaccttgtaaatttaaatttatcatgaaggaagcagaactagttacattggtaaatatgttcattcactattacactattacttctgaatgaacacacattattttctctatagaccaagaactgtctattaatctattaaaatatattttctcaaaactgatcccagggtgctagggacacaaaattcaaagataaataagaaattaaatttggctgtgtgatgttgaaatgtaagtaagcaaataaaataaaatgtgatcaaactttatcagttcgagtttttattaccagcaaattccaattttattgacacagaattatctcagattagcaaaaataagtggtggtactttttttctttttattttttttattatactttaagttctggggtacaggtgcagaatctgcaggtttgttgcatagatatacatggaccatggtggtttgctgcactcatcaacccgtcatctacattaggtatttctcctaatgttatccctccccttgcaccccatgccccgacagaccctggtgtgtgatcttcccctttctgtgcccatatgttctcagtgttcagctcccaattatgagtgagagcatgtggtgtttggttttctgttcctgtgttagtttgctgagaatgatggtttccagcttcatccatgtcccagcgaaggacatgaattcattctttttatggctgcatagtattccatggtatatatgtgccacatttgctttatacagtctatcgtggatgggcatttgggttggttccaagcgttgctttgtgaatagtgctgcaataaatgtacgtgtgcatgtgtctttatagtagaatgacttataatcctttgggtatatacccagtaatgggattgatgggtcaaatggtatttctagttctagatccttgaggaatcaccacactgtcttccacaaaagttgaactaatttacacttccaccaacagtgtaaacaagttcctatttctctacatcctctccagcatctattgttccctgcctttttaatgatcaccattctaactggcatgagatggtatctcattgtggttttggtttgtgttactctaatgaccagtgatgatgagatttttttcttatgtttgttggccgcataaatgtcttcttttgaaaagtgtctgttcatacccttaacccactttttaatggggttgtttatttttttcttgtaaatttgttgaagttccttgtagattctggatattagccctttgtcagatggatagattgcaaaaattttctcccattctgtacgttgtctgttcactctgatgatagtttattttgctgtgcagcagctctttagtttaattagatcccatttgtcaattttggcttttgttgcagctgcttttggtgttttagtcacaaagcctttgcccatgcctatgtcctgaatggtattgcctaggttttcttctagggtttttatggttttaggtcttacatttacatctttagcctccaactttgttctttttgcttaggattgtcttggctatatgggctctttattggctccatatgaaatttaaagtagttttttctaattctgtgaagaaagccaatggtagcttgatgggaatagcattgaatctatgaattactttgggcagtatggccatttttgagatattggttcttcctatccatgagcatggaatgtttttccatttgtttgtgtcctctcttatttccttgagcagtggtttgcagttctccatgaagaggtccttcacatcccttgtaagttggattcctaggtattttattatctttgtagcaattgtgaatgggaattcactcatgatttggctctctctttgtctatcattggtgtataggaatgcttgtgatttttgcacattgattttgtattctgagactttgctgaagttgcttatcagtttaaggagttttggggctgagacgatggagttttctaaatatacaatcatgtcatctgcaaacagagatactttgacttcccctcctcctatctgaatatccttcatttccttatcctgcctgatttctctggccagaacttccaatactatgttgaatagtagtggtgagagagggcatccttgtcttgtgctggttttcaaagggaattcttccagcttttgcccattcagtatgatttttggctatgagtttgtcataaatagctcttattattttgaaatatgttccataaatacctagtttattgagagtttttagcatgaaggagtgttgaattttattgaagaccctttctgcatctattgagataattatgtgttttttgtcattagttcagtttatgtgatggattatgtttattgatttgcatatgtttaaccagccttgcatcccaggaatgaagccaacttgattgtggtggataagctttttgatgtgctgctggattcaggttgccagtattttattgaggatttttgcattgatgctcctcagggatattggcctgaaattttctttctttattgtgtctctgctagattttggtatcaggatgatgctggcctcataaaatgagttagggaggattccctctttttctatggtttggaataatttcagaaggaatggtacaagctcctctttgtacctctggtagaattcggctgtgaatccatctggtcctgggcttttttggttggtaggctgttaattactgcctcaatttcagaacttgtaattggtctattcaggtatttgactacttccttgtttagtctggggagggtatatgtgtccaagaatttattcatttcttctagattttttagtttatttgcatagaggcatttatcgtattgtttgatggcagattgtatttctgtgggatcagtgatgatctcccctttatcaccttttattgtgtctgtttgatttttcactcttttcttctttattagtctagttagcggtctattttgttaatcttgtaaaaaagtcagcttctggattcattgatttttttgaagggtttttcatgtctctatctccttcagttctgctccgatcttagttatttcttgtcttctgccagcttttgaatttgtttgctcttgcttctctagttcttataattgtgatgttagggtgttgattttagatctttcctgctttctcctgtgggcatttagtgctatgaatttccctctaaacactgctttagttgtgtcccagagattttgatacagtgtgtcttttttctcattggtttcaaagaacttatttatttctgccttaatttcgttatttatccagtagtcattcaggagcaggttgtccagttttcatgtagttgtgcagttttgagtgagtttcttaatcctgagttctaattaaattgcactgtggtctgagggactgtttgttacgatttccattcttttgcaattgctgaggagtgtttcacttccaattatgtggttgattttagaataagtgctatgtggtgctgagaagattgtatattccgttgatttggggtggagagttctgtagatgtctattagatctgcttggcccagagctgagttcaagtcctgaatatctttgttaattttctcccttgatctgtctaatattgacagtggggtgttaaagtctcccactattattgtgtgggagtctaagtctctttgccggtccctaagaacttgctttatgaatctggatgttcccgtattgggtgcatatatatttaggatagttagctcttctcattgcattaattcctttaccattatgtaatgcccttctttgtctttttgatctcggttagtttaaagtctgttttattagagactgagatcgcaacccctgctttttttgttttgttttgtttttcatttgcttggtaaatcttcttccatccctttattttgaacctatgtgtgcctttgcacatgagatgggtctcctgaatacaggacactgattactctatttaatttgtcagtctgtgccttttaataggggcatttagcccatttacatttaaggttaatattgttatgtgtgaattttattctgtcattatgatgctagctgtttattttgccccattagttgatgcagtttcctcatagtgtcgatggtatttacattttggtttgtttttgcagtggctggcaccggtttttcctttccatatttagtgcttccttcaggagctcttctaaggcaggcctggtggtgacaaaatctctcagcatttgcttgtctgtaaagaattttatttctgcttcgcttatgaagcttagtttggctgcatatgaaattctgggttgaaaattcttttctttaagaaggtcagatattggcacccactctcttctggcttgtgggatttctgcagagaaacccactgttagtctgatgggcttccctttgtgggtaacctgacctttttctctgactgccctgaacattcttccttcatttcaaccttggtggatctgatgattatgtgtcttggggtttctcttttcgaggagtatctttgtggtgttttctgtatttcctcaatttgaatgttggcctgtcttgctaggttgggaaagttctcctggataatatcccgaagtgtgttttccaacttggttccattctgcctgtcactttcaaggacaccaataaaatgtaggtttggtctttccacatagtcccatatttcttggaggttttgttcattcctttttattcttttttctctaatcttgtcttcacgctttatttcattagtcaatcttcaatctctgatatcctttctttcacttgatcgattcggctagtgatacttgtgtatggttcatgatgttctcgtgctgtgtttttcagctccatcaggtcatcttggttcttctctaaactggttgttctagttatcaattcctctaactttttatcaggttcttagcttccttccattgggtaggaacatgcttctttagcttggaggagttcgttattacccaccttctaaagcctacttctgtcagttcatcaaactcattctccatcctattttgtcccctcactagcaaggagttgtgatcctttggaggagaagaggcattctggttttggatttttcagactttttgtgctggtttttcctcatcttcgtggatttatctacctttggtctttcctgttggtgacctttggttggagttttgagtggtcatcctttctgttgatgttgatgctattgctttctgtttgttagtttttcttttaataatcagggccctcttctgcaggtctgttggagtttgctggaggtccactccagaccctgtttgcctgcgtatcaccagcagaggctgccgaacagcaaagattgctgcctgctccttcctctggaagctttatcccaaaggggcacccaccagatgccagccggtgctctcctatatgaggtgtctgtcgacccctgctgggagatttctcccagtcaggaggcatgggggtcagggacccgcttgaggacacagtctgtcccttagccgagcttgagcaccgtgctgggagatcctgctgggagccagcaggcaggaacgtttaagtctgctgaagcttcacccacagctgccccttcccccaggtgctctgccccagggagatgggagttttatctataagcccctgattggggctgctgcctttctttcagagatgccctgcctagagaggaggaatctagaaaggcagtctggctacagcggctttcccaagctgccatgggctctgcccagttcgaacttccctgaggctttgtatccacggtgaggggaaaaccgcctactcaagcctcagtaatggcagacacccatccctccactaaactctagtgtcccaggttgacttcagactgctatgctggcagtgagaatttcaagccagtgaatcttagcttgctgggctccgtggggttgggatttgttgagctagacttggctccctggtgtcagccccctttctagggaagtgaatggttctgtcttgctggtgttccaggctcgactggggaatgaaaaaagcctcctgcagctagcttggtgtttgcccaaaggccgcccagttttgtgcttgaaacccagggccctcgtggtgtaggcacccgagggaatctcctgatctgtggattgcgaagtctgcgggaaaagcatagtatctgggctggatagcaccattcctcctggcacggtccctcaaggcttcttttggctaggggagggtgttccccaaccccttgtgcttctcgtgtgagaggacaccccaccctgcttctgctcacccaccatgggctacacctaccgtctaaccagtcccagtgaaatgaacctggtacctcagttggaaatgcagaaatcaccggccttctgtgtcggtctcactgggagctgcagaccggagctgttcctgtttggccatcttgcccaggagcccccagtggtacttttttcaatgcttaaaagaatggaaacaatctatttagaaagtgaacatgtattatagatttcagcatgtccattagaagatggtttactagaactatttctttttgcatatagaggaacaaacttgaacagaaaactctcagtctttgtactgaatttccttgtcttgaaagaaatgaggaggtagtgaccagcatttttattagaatgtcagaggtgcctctcataaactacttgaacgctgacttcaagagttgcaatgatcaaaaaaaaatgcagaaaatgaactagtagataactgtgggagatggaaggtgttgatggcattcaccacaggtatgcacttgtccacttattttcttggctggattaatgaaaggatgaggaacctgtttttattttttatttttttaaggcagaaagatcttcgcaactatcaatatggtgaaatgaaaaacaactacccattttcttgtcctcttttatccttgattgtagttatgtaaaaagctttactcgttaaaaaaaattaaatgtttggccaagtcatgggatcaactcaggattttattataacccagatcttggctaaccacattttcttaaaatgtccagtagactgaattgcacccgtggcttctaacatgaacggctggagccaagaatgcttgcgtgaaagcagccagccaccaaaacacaatgggatttattccttcattctgggtttaaagaaaggatcttaaagatccaaccttttagcctagaaagctttgtaaaccttttcaaatacctctgaggaatctgcatactttgtagctcaacttattagtctatttcattcacacgaggagattctccactctaaacactctgacttgcagaggatggaataccaagtaggtgtactctggattggggctttgataaaaacctttcaaagaagaaccatagtacaacagtttttgggatacagtttctggaataatgtaaaatggtgaaatgtaggcagatttttgtaaccctgctagtaagctaattaagagtatgtatttctgtattggttgaagaagttttattttttcctttaagaaatttctatgaaatgcaagctattataatgagaaagaattgttcctttgccaattttaaagcctttggagacattagtgtattaaccccacatggtatctgaagggagcattgaactggcagccagaattcctgagttctggccttgaaactggtatgtgctactgatattatcttgagcatattcattcatctgtcctggaagagatcatgaatgctaatcaaatattccatgtgttcatcaatatttgcaagcatcccctgtggctatgttggggtcatgtgacaagtgcaggacataagtccaagggatgtttgtcttccagtttgaaggagttaagtgaaccaggataaattttcaataatctttgtcatctgcaaagcagcaaacaaaggttttaaaatggccaagttgcaagatgggagcaaggagatctctgagttgtaaaaagaagaggaaagccatttgttcattgcgacatgaaaaggaaataaatatttgctgtatcaagctacgtgaatctgggggttgttttgtgccacagcatagcaaatcctatgttgactagcgtctctccaggagtcatcataagctgaggggtttggagacttcttaattctgttccagtttgtattcctgaaattgtctttgggcatatgaccttcattttacaaaagaaagaacagagaagtttggagataactgactaaagtcacaaagtaagtttgtggccatgctgcacgatgtatttctctgggaccctgtagattcatattccccaggtatatttctccacaacctatgagattaactgtgggatcattcaaattgaccattaacaaaatgctagattgattctcttcctgtctactaggttttgttcacttagacatgatgtaattctgtgatgcaatggataatacggcattcaacatcctgaccttaataccagagacttatctatcagattatggagtctgatagtatacatattatgtctattttcaactggggaaaaattctacctctgtgtttagttttgaggtggttattgaacaagaacctatgatagaccccaaagctattttcacaaaacttgaatttagaaatttaatgcaggggtccccaaccctcgggccatggactggtaccagtccttggtctgttaggaactggccacatagcaggaggtgagtggcaagcaagcaaaggaaggttcatctgtatttacagctgctccttatcactggcaataccacctgagctctgcctcctgtcagatcagaggcagcattagatcctcataggagcgtgaaccctattgtgaactgcacgtatgagggatctaggttgcacactccttatgagaatctaatgcctgatgattgtcactgtctcccatcacctctggatgggaccatctagttgtagaaaaataagctcagggctcccactgattctgcatgaaggtgagttgtattattctttctttatatattacaatgtaataataataaagttcacaataaatgtaatgctcttgaatcatcccgaaaccatcaccttagtcccagtccatggaaaagttgtcttccaggaaattgatcccaggtgccaataaggttggggactgctgaattaatgcatttgtaactacctggtagtttcttgtctttggcatccgggatggatataattgtcctcccaattgtcaagtgtcaaaatgtaaaatatagtacacataaacaaatattgatgaggataaaatgagttaatatctgtaaagtccctaggacagagcctggcatagaattaacaatatacaggtgtttattaagtaacacaaaggtgattatgatggatcatgagacactgtgagctaggatctagttgacatctcctttaattttcctcttatagaaccccagatacatgtcatccgatttctatttaaccatatttttgtgctaggaaatatgattttgtagtacatggtaaaatatttttacttaggacccatcattatctcaattaaaaataagaaaacaggctaagaggagttaagaggtttacccaagtttacaaagctgtcaatgtccttcactatctgcctaggaagttcataatctttcctaggcagtcttctatatcactgtctccattattagtaggagtagcagtgccatgtgatttgagcatggcagcccacaagttccactattaactttctgcagggtaggaatcacttcagccaagatctggagctcaagcaatttccctctgggtgagcagcatttattattcaaatacacttatttaataaacttaattattacatattcaactatttaataatctgtgctagcattttatcatggtttcacatttgttttttctctgacctttttgaagcttttttcctagcagctaaggtgtgtcacaccaaccatcttaaagacaaggccaggcacatggtgaatatttgttgattgtacagttgctaaaaggagacaagttcaaatgagtcacttatagaagcatttggacttcaacagatcgtcaagtgtttgaaaactcttatcactaccatgtcttgtttctgggacattttggttttctgcattaggaaaacatcagatacctcagtttgaacactgtggagcttgcaatttactcacactattatgtcacttatgttcttgtgatcatttactggaaattatgtcattctacttctctctgcttcataggggaatcttaattccaatccatccttctacattacttctaataaatctaatttttgctttgtttttgttaaggagtatcctgccaccattgtactctagacataatctcattcatagcatcagagatactctgcagattgtgtatttgccttattttaaaaattgaagttttttaaaagactctatttaaagactctaaagactattgtatgcattgctattgttaacaactgaaaccatatcattcttgccattattttaagataagacaaatcatttgttccctgggatggaaatgagctccttttcttgtaggtttgtgtatttttccaacccatatatgattataagtttcttccagtaaccttcaaaattctttatctccttagggttaatatagtgaaataattacttgggaaaatgggaggcatagctttgcttttgaagtctagctttactacttggtacccacgtaatactgaacaacatatttaatctccctgatcctcattttccttttgggtaaaaggagaataatgtgcatatagaatagggattaaaggcatggactctcaagctattttgcctagtttgaagcttcactgtgccctattttgcctatgatatcattggcaattacttaactcttcgtggtgcagttttcacggtaaaaaattagggaagcaattggatcttcttcgtatggtgatagaaatatttttatatgtgctttttctttcagattgtaatggaggttcgaaataaagcttgctcaagtccctcctatcaagtggcatagtatttgtatataacctatgcacatcctcccatataccataaatcatctctggattacttataataactgatacaatgtaaatactgtgtaaatacagtcaggtgctacataaaaacttttcactcaataatgctccacatatatgatggtggtcccataagataataatatagctaaaaaatttctattctctagtgaccttgtagccatatgcattattcacatgttggtggtgatgctggtataaacaaacctacacatacgattacacacggtacataatacttagtaatgatagtaaacgactacgttaccggtttatgtgtttagagtactaaacattttatggttattttgagtgtactctttttacttaaaaaaaaaaagttaattgtaaaacagcctcaggcaggtccatcaggaggtattccagaagaaggcattgttaccataggggatgacagtttcattggtgttattgtccctgaaaaccttccagtgagaaaagatgtggagctggaagagagtgacattgatggtcctgaccttgtgcagggctagtctaatgcatttgttgatgtcttagtttttaagaaaaacatttaaaacataaaaaattaaaatcataaaacaagtaaacgaagaaggaaaatattttttgtgtggctgtaaaatgtgtttgtgctttaagctaagtgttgattcaagagtaaaaaagcttaaaaattaaaaagtttgtaacataaaaaagttacagtaaactaagtttaatttattattgaagaaaaacatgaatttagtgtagcctaggttcacagtgtttacaaagtctacagtacatacagaaatgtcctaggccttcacattcactcaccgctcactcactgacgcacacagagtaacttctaggcttgcatgctccattcatggtaaatgcctgtattaggctgttcttgcattgctataaggaaatatctgagactgagtaacttataaagaaaagaggtttaaatggctccaattctgcaggcttcacaggaatcatggtgctcgcatctgctcacctttgggtgaaacctcagggagctttcaagcatggtgaaaggtgaagggagaataggcatgtcacttggcagaagcaggagcaagagacagcaagagggagagagagacgcagacagagagacaaagagacagagtgagtgagaggaggtgcacatacttttaaacaaccagatatcacaagaactcactcactatggcaaagacagcaccaagccatgagggacctgcccccatgacccaaactcttcccaccaggcctcacttccagcactggggattacaaggcaacatgagatttagatggggacaaatatccaaactgtatcagtgctctagagaggtgtaccgtttttatcttttatgccttatttttagtgttccttttctatgtttagatacacaaatccttaccatgtgttgtaattgcttatcgtattcagtacagtaacatactgcacaggtgtgtggcctatgagtaacaggctattccatatggcctagatatgtagtggctactatctaagcttgtgttaatacactctatgataatttcactgacagaatcacctgagcacacatttcttagaacgtatctttgtctttaagctgtgcatgattgtagttgttgtactgcattgtttttaaaatttgtatcatttttacagctatattgttattttttatggcttcatttttttccaagtgtttttgatccagagttggttgaatttgtggatacataaccttctgataaggagggctgacggtatgtcttagtgctttgattatacttcagaggtctgtaaactttctataacaggtcagatagtaaatttttaagacttttgggacacctatacaagtctgccattgtatagcaaaagtcattatagataatgtataaacaaattggcgtgattttggtcaataaaactgtattcacaaaaacagccttaggctggctttggcccatcagtcatactttgctgacccctgatctgactgttggttaacacaaatttgatcccatcaggcaattttgccttttcttccccagattacagatactccgtctctgtagctctgaatttgtactttatttctcttgctcatctaaaagcattcaattttcaattgtttaactaacaagctttttgagctgcgtgccagagcagagatcaattttagtgttaattcgtagtcgttaaatagaattaggaataaatttttagaatcaaatatactcagaatagaggaaattttctactttcatctatctctcttgatggactaaggtgagaatatacatcctcaacttctccccataggtccctaatagatacccaaacttgcagtatacaaaatcaaactccttattttcaccctctaatccattccccctgcaatcttcttcttccttgcagttcttcagttcaaaatttttaggtcatccttgaccgtttgctctttgacattccacatggaattcaacagaaactttctctgggactgtcttcagcatatacccagctctggctactttgcacaaccattgacaccaccactgagtgatggggaagaaacaaaatatttccacaagtaacctttttactcagtaactcaggatgtttttcaatttgagagacgatgaagtataaggctaaaatttaaaccatatcaagatcatttattattaagattattctatatatagtatgtttattgtccttttgagtaagttttgttttgtattttccaattgggttgtgttgtctcatgaaatggctatttactttgctgtgtcatgtatttaggccattttactcaacattgaaaataattttcttagtgtctttggcatttttggagcataagtctttcttcaagatgaaattttcttttcccctccaatataggcatttcttgttttattacactttgctctattgcttagcagatattgtggattatttttttcaaattgaaagtttgtggtgaccttctgtcaagcaagtgtagtgtcattacttgtcttcttttttaaatgtatcttttaagttcaggagtacatgtgcaagtttgctaagtcaacttgcgtcatgggggtttgttgtgcagattatttcatcacccaggaattaagcctagtatccatttattatttttgccgatccactccctccttccagcctacaccctccaaaggacccaatgtgtgttgttcccctctatgtgtccatgtgttctcaccatttagctcccacttataagtgagaacatgtggtatttggtattctgttcctgtgttatttgctaaggagaatggcctccagctctatccatgttcctgtggaggacatggtctcattctgttttatggtgtaaatgaactacattttctttatccagtctaccattgatgggcatttaggtcgattccacgtctttgctattgtgaatagtgctgcagtgaacatacatgttcacgtgtctttataagagaatgacttatattcctttgggtatatacccagtaacgggattgcggggttgaataatatttctgtttttaagtcttaaaggaatcatcacactgtcttccatctggctgaactaatttacactttaatcaatagtagttttgatttgcatttcttttttttttttttctttgagatggagtcttgctctgtcgccaggctggagtgcagtggcacgatatccgctcactgcaatctctgcctcccaggttcaaatgattctcctacctcagcttcccgagtagctgggattacaggtgcacaccaccacacccagctaatttttgtatttttagtagagacggggcttcactatgttggacaggatggtctcgatctcctgagctcatgatccacccacctctgcctcccaaagttgagtttttttcatgattgctgactgcatgttatattgtcctttgagaattgtctgttcatgtgctttgcccactttttactgagatttcttgttttgttttcttgtaaatttgtttaagttccttatagatgctgggtgttaaaaactatgttttgtcagatgcatagtttgtgaaattttctcccattctgtaggttttctgttcaccctgttgatagtttcctttgctgtgcagaagctctttagattaattaggcatcatctatcaatttttgcttttgttgcaattattttggcatgttcatcatgaaatctttgcacattcctatgtccagtaaggtattgcctaggttggcttccaggatttttatagttttgggtttaacatttaagtctttaatccatcttcaattaatttttgcatatgatttaaggacaggatcctgtttcagtcttctgcatattgctagccagttactccaacatcatttattgaataggaaattttttcccaatggcttttttttgtcagggttgttgaagatgagatagttgtaggtttgtggccttatttctgtgccctctattctgtcacattggtctaaatgtgtgtttttatactgtaccatgatgctttggttaccatagccctgtagtatagtttgaagtcagataacgttatgcttctagctttattctttttgcttaggattgctctggctatttgagctcttttttggttccatataaatgttaaaagagtttttttctggttcttttaagaacatcaatggtagtttaatagaaataggattgtatctataaattgctttgggcagtatggccatttaaacaatactgattcttcctgtccgtgagcatggaaggttatttcatttgtttgtgtcatctctgatttctttcaacagtgttttgtagttctcatagagatccttcacttccctgtttagctgtattcctagatattttattctttttgtggcagatgtgaatgggattatgtttctgatttggctctctgcttgactgttgttggtgtatagaaatgttaatgctttttgcacattgattttgtatcctgagactttgctaaagttgtttatcagcttaaggagtatttgtgctgagactagggggctttttagatgtaggagtatgtcatctgaaaacagggatagtttgatttcctctcttcctatttagatgcacttatttctttgttctgcgtgattaccctggctggacttctaatattatgttggataggaatgatgagagaggacatccttgccttgtgccagttttcaaggggaatgcttccagcttttgcctattcagtatgatgtttactatgggtttgtcatagatgtttcttattattttgaagtatattactttaatacgtagtttattgagagtttttaacacgaaggggtgttaaattttatcgaaagccttttctgcatctattgggataatcatgtggtttctgtctttagttctatttatgtgatgaatcatatatattgatctatttatgttgaaaaaccttgcatcctaaggataaagcttactggatcatggaggatgagctttttgatgtgctgctatatttggtttgccggtattttatagaggatttttgcattgatgttcatcaaggttattggcctgaagttcatcaaggttattagcctgaagttttcttttttgtttccgtctgtcaggttttggtatcaggatggtgctggcctcatagaatgagttagggaggagttcctcctcctcatttttttggaatagtttcagcaggaatggtaccagctcttctttgtacatctagtagaattcagctgtgaatctgtctggttctgagcttcttttggttggtaggttatttattactgattcaatttcagagctcattatcggtctgttcagagattcagtttcttgctggttcagtgttgggaggatgtatgcatccaggagtttatctgtttcttctaggttttctagtttatttccatagaggtgttcataatgttctctgatggttgtttgtatttctgtgaggtcagtgataatatccccttgttgtttctgattgtgtttatttgaatcttctctcttttctttattagtctagttagcagtctattttattgatttttttaagcccctggattaattgatctttcaaatggtttttcaggtgtctatgtccttcagttcagctctgattttggttatttcttgtcttctgccagctttggggtttgtttgctcttgttcctctagttgttttatttgtgatattaggttgttaaagtctttcttactttttgatgtgggcatttagtgctataaaattccctcttaacactgccttagctgtgtcccagagattctgatatgttctatctttgttctcaatggtttcaaaaatttcttgatttatgccttaatttcattatttaccccaaagtcattcagaagcaggctattcaatttccatgtaattgtatggttttgagtgaatttcttagtcttgttttctaatttgattgcactgtggttcaagagattgttataatttcagttcttttgtattatttaaggagtattttctttccaattatgtgatcattagaggatgtgccatgtggcaaggagaagaatgtatattttgttgttttagatggagagttctgtagatgtttatcaggtccatctcatccagtgctgaagtcaggtctgaatatctttgtgaattttcagtcttggtgatctgtctaatatcgtcagtggggtgttaaagtctcccactattattgtgtgggagtctaattctctttgaaggtgtctaagaacttgctttatcaatctgggtgctgctgtgttgggtgcatgatgttccctcagtctttgaaattgctgacctttggattattttctttttcttttattatattttatgaccttgagggtttgattgtggtgtagggtggattctgccaacttgcttcatttccggaagatcctagggggccagtggtcagctcccaaccactggactgtatgctatctttgggggacttgtattgggccctgactttgttctccggctccttgaggttaggaatccactgcgcgggaggggctgaggggtcccaagatcagtggtcactacacttcaatgagtggtgtcagccaaagcatttcaaagtgtggggacagcgggattcatcctcctttgcgaatgcccacagcagcagtagcaacagctgtggcagagtactagcgggtattgtggtgcctgcctccctgtggatgtttaccacggtggcaaaggcagtgcagctggggagggggtggggcccctgctggtgactgtgtgcagggtcctgctggaggtggtattggctcggggacagggtgcctgcaggcacaggtctaggtgccttttctgtgccccgcaagcaggagcgatccctcagggcaggggagaattctgctgttctttgttcagtgttagtgcaaggtcagggagctggcaggggcagggatggctggctctgtgcctgcaaatgttccatctgcaatggtggtccgtcgggggaggtggggtggtctgtactcccatgtgctggcagggcaaggaaagcaaaatctgctctcacagatgtgagccagcaaagtaatgtgaggagttgccttgggcctgggagaatctacagtatgtgggtgggagagtttgtgggctggtgtgtgtctgtaggggccaccccattggaactctccaccagtcagacatggcccaccagcacagaagctatgctgtgagtccccagggcaatcgagactgctctgccaggaggcatggccaggctggggccctgaaagagggcagcaagccaaggggtgctcaagtcgtacttgttatgtctgatgttcaaggctgccttgcagagttcaggtctgacagttcctctagggctaaagtctcctaaaggagcaagtcaagtctagggggtgactgtccttggctgtgctatgttatagatgctctcgcatcaaactctctgggttccacatcagctgtcttgttgcccctaccacttctctaagcagctctccctgccaactcaaatgcccttgatggtcgagggatttcctcctgctggagtcccagagccctgcggtgagggtgggttgctccttgccagttcaactcatccatttccctggagccattgtgagccaagaatgagtcctgctgcatgggagctccgtgccaaggttcccagttttcttccccttcagcttagcttctgtgtcttccctccactcttggtgccttcgctctgcagatctgttaggaacagatctgtctccgtccctaggtgggagctgtttcacctggctgcgtctagtcagccatcctaccctccctcctttcttggcattatttttctaacaacatgtgcttactttgtgtctctgtgccacattgtggtgatttcctcaatatttcaaacctttttattgttattatatctgctatggtggtctttgataagtgatctttgatattactattggaattgttttggggcaccatgaacctcctgcatgtaagagggcaaacttaattgataaatgttctgattgcttcatagcctagtcgttcccttatctctttccctttctttgctcttctctattccctgagacacaacaatattgaaattagggcaattgataaccctataatcacttccaggtgtttgagtgaaaggaagagtcacacatctctcacttaaagagctagattaagctagattaatcttaacaaggaaggcatgtcaaaagccatgacagactgaaagctaggtctcttgcaccaaacagtgtgccaagttgtgagtgcaaaggaaaagttcttaaaggaagttaaaagtgatactccagtgaccccagtaatgataaagtgaaacagatttattgctgatatggaagaactttagtagtctggatagatcaaagcaggcacaacattcccttaaaccaaagtctaatccagagcaaggccccaactcttcaactttttgaagaacgagagaaatgagaaatcttcagaaaaaaagttgaaagctggcagacagtgattcctgaggtttaaggaaagaaaccacctttataagataaaagtgcaaggtgaagcagcaagtgctaatagagaagctgcagtaacttatccaaaagatctagctaagagcattgacgaaggtggctacattaaacaacagattttgaatgtagatgaaacagtcttctattggaagaagatgacatctaggatgtttatatctagagaggagaagtcaatacccagcttcaaagtttcaaaggacaggctgaccctcttggtaaggactaatgcagttggtaactttaagttgaagccaatgctcattgaccattctgaaaagtcttagtgacattaagaattatgttaaatccactctgcctgtgctctataaatgaaacaacaaaacctggatgacagcgcatctgtttacagcatggtttactgaatgttaagcccactgttgagacccactgctcatgcacagagaaaagattccatttaaaatatttctactcattgacaatacacctggtcacccaagagctctgatggagatgtatgaggaaattaatggtattttcatggctgctaacacaacatccgttctgtagcccatggatcaaagagtaatttcaactttcaaattttgttacataagaaatatattttacaatgctatagttggcatatatcatgattcctctgatgaatctgggcaaagtaaattgaaaaccttctggaaaggattcactcttctagatgtcactaaaaacattcataattcatggtaggaagtcaaaatatcaacatagcaggagtttgggagaagttgattccaatcctcatggatgacttgaaggggttcaaaactttggtggaggaaataactgcagatatggtagaaatagcaagaaaactggaattagaagtggaacatgaagctgtggcagaattgcacaatttcatgataaatttgaatgaataaggtgttgcttcttgtggatgcaaagaaagtcatttttgagatgaaatctactcctggtaaagatgctgttaacattactgaaatgacatcaaaagatttaaaatatgacataaacttagttgataaagcagcagcagagtttaagaggattgattctcattttggaagaagttttactgtgggtataatgttatcaaacaacattgaatgttacagagaaatctgtcatgaagagaagagtcaatctaagtggcaaacttcacggtcttattttaggaatttgccacagacacctcaacctttggcaaccaccagcctgttcagtgagcagccatcgacgttgaggccccctgaggaggtcccaggctgtggcaggggttcaggctggtggaaaagtgggagagaagagtcaggggacaattgggaagtgtgatgatatggggaaagagggatggagtggaagccagaacccattgcttccagtatcaatctttttcactagcaaaaaggttataacttgttaaagcctcatgtgattgttagaatatgttagcaataaaatatttttaattaaggcatgagcatttttttaagatataatgctattgcacacttaatagactacagcatactgtaaacataacttttttgtgcactgggaaaccaaaacattcatggaacttgctttattgtgatatttgctttattgcaatcgtctgataccaaattgacaatatctctgaggtatgcctgtattttatctttatttgtgataagttcttacacatttgataaaacaagttatttatattgaaatgcatttgatcgtatctcttatttaagaagaaaatttggaattttccgtgaaaaagcctgctgaagtaatcaccctctgcaatttataaatattagaaacattggtcaagttttagaatattttattgcctattaaatgttatgtgactgtgttaaattattatatattatttgcatagtgtgaaagcttacttttgcttcacgaattattttaaatggaaaaaattctcagttatacttggaagagaaaaatcacatgtccattttggagtgcattttaaattgtgctacaaagaatgacaaaacactgcagtaaatgtgacgtttgaaattttataaggagtatgatataaataccactttttaatagtatttataaaagtggagccatgatacattctggctataacaaccataacaatattccatatttttaataatatgaatgtttttaaaaatatttttccatagttcttagaacaactttagaattcctcaagtacttgtttacatttaggtgttctggtatttcctgtttacatttaccctttgcgaaaggacaaaatcaagactatgatacccttttctcagcacacctgtctcgtgttggatctgtcttcccctggaaatgcttcttttttttttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgaaatgcttcttatttgttagtgtggcagcgatgataacagcacccccagacaccctggtaaatcgcttctctcgagcgctttgttgtggtcttcgttgagttctgagtgaggtgtgaaatctgagaagacagaatttgttttcattcttcagtaagtaagttagcatgtggttgtgcctagcagagtatctggcacttagcgggccagttaaataaacctggatttaaaaccagacttcacaaaatttgctgggaatctttttttttttttatactttaagttttagggtacatgtgcacaatgtgcaggttagttacatatgtatacatgtgccatgctggtgtgctgcacccattaactagtcatttagcattaggtatatctcccaatgctatccctcccccgtcccctcaccccacaacagtccccagagtgtgatgttccccttcctgtgtccatgtgttctcattgttcaattcccatctatgagtgagaacatgcagtgtttggttttttgtccttgtgatagtttactgagaatgatgatttccaatttcatccatgtccctacaaaggacatgaacttctcattttttatggctgcatagtattccatggtgtatatgtgccacattttcttaatccagtctatcattgttggacatttgggttggttccaagtctttgctattgtgaataatgccgcaataaacatatgtgtgcatgtgtctttatagcagcatgatttatagtcctttgggtatatacccagtaatgggatggctgggtcaaatggtatttctagttctagatccctgaggaatcgccacactgacttccacaagggttgaactagtttacagacccaccaacagtgtaaaagtgttcctatttctccacatcctgtccagcacctgttgtttcctgactttttaatgattgccattctaactggtgtgagatggtatctcattgtggttttgattttcatttctctgatggccagtgatgatgagcattttttcatgtgtgttttggctgcataaatgtcttcttttgagaagtctctgttcatatcctttgcccactttttgatggggttgtttgttttcttcttgtaaattttgtttgagttcattgtagattctggatattagccctttgtcagatgagtgggttgcgaaaatattctcccattttgtaggttgcctgttcactctgatggtagtttcttttgctgtgcagaagctcttgagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtcaggaagggatccagtttcagctttctacatatggctagccagttttcccagcaccatttattaaatagggaatcctttctccattgcttgtttttctcaggtttgtcaaagatcagatagttgtatatatgcggcattatttctgagggctctgttctgttccattgatctatatctctgttttggtaccagtaccatgctgttttggttactgtagccttgtagtatagtttgaagtcaggtagtgtgatgcctccagctttgttcttttggctcaggattgacttggcaatgcgggctcttttttggttccatatgaacttgaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcatgtcccttgtaagttggatttctaggtattttattctctttgaagcaattgtgaatgggagttcactcatgatttggctctctgtttgtctgttgttggtatataagaatgcttgtgatttttgtacattgattttgtatcctgagactttgctgaagttgcttatcagcttaaggagattttgggctgagacagtggggttttctagatatacaatcatgtcatctgcaaacagggacaatttgacttcctcttttcctaattgaataccctttatttccttctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcgatacctaatttattgagagtttttagcatgaagggttgttgaactttgtcaaaggccttttctgcatctattgagataatcatgtggtttttgtctttggctctgtttatacgctggattacatttattgatttgcatatattgaaccagccttgcatcccagggatgaagcccacttgatcatggtgaataagctttttgatgtgctgctgcattcggtttgccagtattttattgaggatttttgcatcaatgttcatcaaggatattggtctaaaattctcttttttggttgtgtctctgcctggctttggtatcaggatgatgctggcctcataaaatgagttagggaggatttcctctttttctattgattggaatagtttcagaaggaatggtaccagttcctccttgtacctctggtagaattcggctgtgaatctatctggtcctggactctttttagttggtaagctattgattattgccacaatttcagatcccgttattggtctattcagagattcaacttcttcctggtttagtcttgggagagtgtatgtgtcgtggaatttatccatttcttctagattttctagtttatttgcatagaggtgtttgtagtattctctgatggtagtttgtatttctgtgggatcggtggtgatatcccctttatcattttttattacatctatttgattcttctctctttttttctttattagtcttgctagcagtctatgaattttgttgatcttatgctctcagttttcttgtgcataaaatgggaataataactgccttctggaattgtagcgggaaataaatacaattgtagctctcgggtgctaagcacagggctgggacctagtaaatgctcagtaactgctcattactcttttttcttattttgcttccttttttttttcttcactgttgtctttttattttctattttaaggatattggcttagtaaaagaaactaaaatacatctgcatataaattaaataaatgcctcatttttaaacattctgtgagtgtctatgtatagctggtaccttaattgtagttgttcaataaatgatttatcttactttgggaactttcttaaaaagcttaaatccctcaatgttaataatagtgaaaatcttatgtttgaaaaaatgcttttgaaaaacatatattgggttacccttttaaagaaatatacttaatattgatatgagtaattttttaaaagtaatcaaagctttagagagtaagagaagaaataaaaaaaaacaaaaacattatgacagtgtttatatccctacttattaaattcaacatggaaaacaaggaagtagaaagtactttgtaaaatacctaaaatgcctgaatataagaagtatttggatattatagataacattttctatactacaatgtcacctcaaatagtgtacacacacagttatgaggatatgatagtcacttagaggattcatgctgggattgaatagtaggaccacacattttaggaaattttaagcagaaatgctttagaagaaatagtctttatttatttatttttttaaaagagcttttaaattactgagttcaaatacagaagaaggcctaagtttgaattcatggcgtattgctataatgcactattagactaatccttcattttcttgtcaattaaagacttacctttattcactgattcacttatcagtaattcgctcggtattttaaagctggctgttaaaaatccctttgtttatggcaataaggcaccattcattttgtgaactttataaaaccaacctctgccaattttgctctttgagaatagctctaaagatgtgttcccacagtaattactgattccagagatgttcattaaagaatgaagtcagaggcaagtgtttgaaacaattgtatcccaccaaagccagctttactgcgcaccttcccagaatctacagtttctccacgtttaagaaaatcactgaacaacttcatacaaaatttgtacttttgagtgcttttacctgcagtagcattaaagatgagtattattttttacatatttgtattgaaatcagatgcagggaaagatggagggaaagctaggatgctttgaatgtgggcccagttgtccgtcatatagcttctgtgaatagtatgggtcaatcttgtgttcctgctctatgttgcccacttacccagagtgaccagggtgagaaaagaaaaggaggggagaaacttcagtgaagccagccaaatcttagcagagaaaaataaataaataaataataaataaataaataaataaataaaatggttgtggagttgaatatttcttttaaaatggatttgttattgcagaagagtaggaagaaaagtttaattcttttattagcttattatcagaacctgaaatgctggagtgtgttttaggtactgcatagctatcctgcagttacagcccaacctcccactgagccataatgggcaaaggaagagagaaaattcacagtgagagagcagggagagagagattttgctatcagcctgtcagtgacagatctgaatgataaacgccttacagaaatgaagttacatttatttttattgcatgaaaatatataacagacaaaggaaggaagtcagaaaacgggattaggtatattttctaaatctttaggtgttaaacagactagagaccagtcacttgtaaatgaacacattccttgtttggatgcaaacaacccagccaaattagtttcctaagtgcttggaaacagctttctgtttttggcttccagacctgagttctttcattcatactattttttttttctttttgttcaatccttattaatcaccaatatttcaaatactttgtaaatatagattggtttcattagagttaatgtatttgggggccaacaggttgaatgaatgattttattttaaaattccaagatcctgcctgatacctggagtataatactgagcatcctgaggagaaatgttgcaatagcaggcttttgtgaaccatatcccaagaactgcagatccttgcactgtggtgactgggaacatttactcaggattcagcctgctagcatttgaacactgagagattgtggaatctctgtaggcctcagcttcttcatctgtaaaatggaaaagctaataatacctacttcaacatttttgtttattttttgacagagtctggctgtgttgcccaggctggagtgcagtggcataatctcgactcactgcaacctccacccctcaggttcaagcaattctcctgcctcagcctccctgagtagctgcgactgcaggggtgagccaccacaactagctaatttttgtctttttagtagagatggggttttatcatgttggccaggctggtctcgaacttctgacctcaagtgatctgcctgcctcggcctcccaaagtgttgggattacaggagtgagccactgcaccgggccaacatttttgttttcataaaggtagattaaatgagatttcctataaacaactgtgagatcattgcctggtgcatagtaagtgctcaataaatgttagcaattaatattacatactgatgactggagcacctttttaaaaaagttatgcttattcctaaataaaaaataattcacatacctattaccaaaaattcagaaaaatagaactatagatataaaccgtatttagaaaataagaatccagtgttatcttactacctgactgtatctatccactatcagtacagctatcagatgcctttattaacatgatcccattcaggctgggtgtggtggctcacacctgtaatgcctctctttggggtgctgaggcagagcagattgcttgagctcaggagttcaacaacagcctggccaacatagagaaacctcatctctacaaaaaaatacaaaaatgagccaggcgtggtggcatgtgcctgtagtcccagctacttgcgggcaagaggatcgcttgaacccgggaggtggaggttgcagtgagccgagatcacaccactgcaccactgcactccagcatggatgacagagcaagaccctgtctcaaaaaaataaataaatacataaataaaatgaaataaagaaaaaagaaagaaaattcctgttaaaaaacacttactgtgtttattacaagttaattatttactgccagttcatagccatctttccatcaataaatatagatgtaccaactgattgatgttagtgtcttcatcatgctccatgctccatagtggtccataatttaagtagtcacccctggcatcttaaatattttttgtaaatatagataataaaaatgccttcagtcagcacattcttgtttgctgtccctggagtgtttggatgaccattaaaaatggcagaaggctgacttggtttttaggcctgaattacagccctgccatctacaagctgtgtgactgtgagcaagttacataaccttactgtatcacaagtattttttttctcatttataaaatgatgataataagagtatctagctgacatgattgctgagcagagaaagatgttaagacacataaagctttggagactggtttctggtctatgatttttactcaggaagtattagcttgaggctatgtaaaatcttggcatttctcccaaatcatcaaaggtaaattatgttattcctttgaattagctaaattgtattgctataaaaatttacttgcaatcttaacatttcactgcaatatgtatgcatactttgggatgtttacatgtgaaaatgcacattatcctacacacttcaattctcaaaccatgttggttagagaagagattaatagttatttctagacacactatacacagaacaatttggagaaaaatcaccattggacagtagcaactagtttaatatttggcgtcttttattttctcttttaacatttccaaggaataggggacgctcttgtcaatgactttttttttttttttttgagactgtgtatcattctgtcacccaggctagagtgcaatggtgctatcttagcttactgcaacctccgcctcctgggttccagcgattctcctgcctcagcctcctgagtagctgggattacaggcatgcaccaccataccctggtaatttttgtgtttttagtagagaaggggtttcaccatgttggtctggctggtctcgaactcatgacctcataatccacctgtcttgccctcccaaagtgctgcgattacaggcatgagccacggcacctggccagtgactaaggtttattacaccacctggatagatgcagggctaggggcatgaagacaggaaggtactcccacttttcaaggacagaatgtggggcgggtggtaaaatctgaagagatcctgaaaaattgtcctcctttaggtgttgtgatgtattgcttctgcaatggccatccaatcttaaatacctaagtctagatatggcatccttattatgtaattctggaacaaaagttaccctaataaagagcttcaaacccgctaggacccactcaaaatagggtaataatactccaagacattcagaaatttcctctgttcccagtgggctagtcaggacagggcagtgagagccctcaggctagctcccctggcctcagcaactccattcacttcccccaaaagggtcctaaataaatttaaatttctctatgtacctcgacatgaaatagttggaaagcacactcttaaatgccactttactgactgtactggctaaaacaatgagctgtgtacgtatgaaaaagaatgttcatgtgttttctttgtcaattacattaatttatacccttgctagtgtttctgaaagagactaatagttccctcaaatacatttaatgacccagtttgagaaatactgttctagaaattaacactagtaataattttgtgctcatatgattacacatacaaatataaattcttgcaacttaaactccatagaaaaacttggatgtaacctggctatgtggatgaaaaactgctaatgttaatatgtcttttagcagatgatcaaaataaaaacaatacaatctaataattcccataaacatctgaaatcctctaaaaacatgtctatgtagaccataaggtaatattattctaaagcaatgattcccagaatgtgctcccagggcagtagatctgtatcatctagaaacttatggaaagctaattcttgtgacccactccagatttactgaaacagaagatgtggaggatgggacccagtcaactgtagtttaagaagctcttcaggtgattctgatgtgctccagtttgcaaaccacataatgaggctgagtccttttcagtcattccacaccaaatgagcactgtcgtatgtttaccttaggaaacataccctcaattgagtggggctgctgatatttcaattccttttaaagagtttgtctcagagccaatctgtaacaaaagagaaattcagtttcattattttatagtcaaatctcattaagtagttgctgagatgtttgtatgaaactcagatttgactttgccctgcactgtgaacaaagacgatgaaacattttcacatttggaatgattagtcatcaggagatgcagtcacaaaattttattgaaagcctaatatttattcaaaagcctttgatagactgcttttggaacttctgcgacattctccaccataatattgtttagcctctaactctccctaaattgcctttggtcagaaaagttaacgtggttactgctttgtttatttgactttcctacctcctgattcagagtagagttagctttggaaggagactaagagtcaagcgcttgcctgagtaaaacctatttttggccaagagaactcaaaaccaaaaccttatatatatccaccttattgcccagctaacttggctactaatttctctgctactatgaaattctctttcaaattcctaattcatagtcaagtctcatcttgttccagagcaattatggtggttgggaagcccaagatgagaagggtaacacaggaacaaggaagctgaatcctaacagtcaatcctgcttgttcctactatctcataccttaccagcattccatcctgaggacttaactaccaacttcaagctagcccatgtctcatcttgtggttcatcatgtctcgtcattttgtggcaaactgtccaggatgacccccattttttgcaaaaaaagaagacacagagggggaataatcttggtttttctccaaaccctagatgtagctcatatctgtgtttcctgaagttttctctctagtactcttgcagcctgaggctttttccagaatccaagggagtgggaagaaaaaatgagggaaagtcatggtccctgaagaaagagggacgctcagtaaagtccagcagacagagcaccagccagggatgtggtgggcggagccaaggacattaagctaaaagaatatgaaacttaaatctattgccatgtcccagggaaaagtggtgatgaaatttcaatgaacaaagcttactgttatttatcactttgtatgtacctttacttttttacacaaatgagatcatatcacatatttcttttgaaactgcttttttttatttaaaaatttatgacaggctgggcccggtgggtcatgcctgtaatcccagcactgtgggagccttaggtgggcgggtcatctgacgttgagagttcaagaccagcccggccagtatggtataactgcgtctctattaaaaatacagaaattagccagacatggtggtgcatgcctgtagtcccagctacttgggaggctgatgcaggagaatcccttgaacccgagaggtggaggtatcagtgagccaagatcacgggactgcactacagcctgggagacagagggagactctgtcaaacaaacaaacaaaaaaaggagacaaatattttttaggtcataaacttcttcttcttcctcctcttcttcttcttcttcttcttcttcttcttcttcttcttcttcttttcttctttcttcttcttcctcctcctctcctcctcctcctcttcctcttcctcttcttcttcttttccttattcttccttctttcctcctcctcctcctccttcttctccttcttctcctttcttagtatatctttttctaagccttcacagtataggttgagcattcgttatccaagatactagggaccagcagtgttttggattttcgattttggaatatttgcctatgcacaatgagctatcttccagatggaacccaagtataagcacaaatttcatttatgtttcatatgcaccttatatacatagcctaaggttaattttatccaatattttaagtaattttgttcattaaacaaagtttgtgtcaagtacttacatgcggaattttcttttttttttcagatctttcttttttttaattttattattattttacttcaagttttagggtacatgtgcacaatatgcaggtttgttacatatgtatacatgtgccatgtcagtgtgttgcacccattaactcgtcatttagcattaggtatatctcctaatgctgtccctcccccctccctccaccccacgacaggccccggtgtgtgatgttccccttcctgtgtccatgtgttctcattgttcaattcccacccgtgagtgagaacggaattttctacctgtggcattgtgtcagtgctcaaaatttcaaattttggagcatttcagatttggaatttttagattaggaatgttcaatctgtattctcttgttgtataagatacctataaaaaccatcttctatacttattgctttcattttttttgaccagactctttttaatgttttcccatgagtacttagaataaaaccctaaaataccagcatgagcatttgcactgttttatttgttaattttaatatttatttataacaatgatactttaaaatttttcaaaaccaagactatatacaaatatatactgagatgttccctttccaccatttttatttatttatttattgagacagagtctcactctgtctcccaggcttgagtgcaatggcgcgatctctctgcctctcgggttcaagtgattctcctgcctcagcctctggagtagctgggattacaggtatgcaccaccgtgcccagctaatttttgtatttttagtagagatggggtttcacatgttggccaggctagtctcgaacttctgacctcagatgatccacccaccttggcctcccagaatgcttggattacaggtgcccagccaattcattttttttctgtaaaattaatgctactctgatggcccctaattctgactaaactcctttcagaatctaggattattaatcatcttaatttttttctgaattataataaagtagataataatctgggcatctcaaatgccatttctcatcctataattctgaaaaatattgtttagttgatgccacacaattcctggtaattctttggaaaaagttaatatgtgggacaatataattgtcaaaaataaacctgggatttttcttccatgatcttccataggtagcaaaggagaattagtacaatttaaatgtaggcatgtttctgaaatttaggttgttcacccatggatacatagtcttactaaatatcttatttcatattataacattaaagggatttataaagattgaatattatattcttacttgaaccgatattttactgcttttttcttattttaattagcatgtcagtaactgtagaatggtatcagataacctttagtcttgtttatttccaacaaaacttttctaattcttgaaagattaacataatcttgcactaatttgcattctagtacgatgcttttcaaccttgactgcacattagagtcacctggggagagttaaaaaattccaatgccaagggcaccacagaccaattaaatataaatatttgatggtaggacctaggccacagtatgttttaaagctccccaggtaactccaatgtgccgccaagcttgagaaacactgctcctgggaaagaaataattatctagtttttgttcatttttttccaattagaatttatttcagcatgctttcctggaagtatccgttttgttaaatttggcattgaaaaccaaaaactaaaataacaattctttgtttttagatttgatgtgaaaagaataaattctcagtaagagaaatcatattgtgtgtagagtttcagtctacattttggagtgttggggagagaagttcatagctttcttcagattctcagtgtgatgtttctgtggtaggtagggaattgactgcaggaagaaacatgttttgttactggtttgtacctgacccttgtccatgtaaacacagaatgcccctctctgaagtggttataatgtaatctgagtcgagcattgaattctgtgagtgatgattctccgctcacactatagcaaactataaaacttccatgcacacttttaatgaaacaaactagccacatgcaaaagagggcaaatgagttgtgattcaaaagacaatctcagaatgtgggtagagctggcattatttcttccttatgattgaatagctcattattattcatgggtgaactaaaaagtaaaatctagtagtttggagaagtttttatccagctgtggaaagtagctcagtgggcaaaaactctcctctgtcctgttaaagaagaaatgggggctttctagcatagggaaaagatggttgtcatcagaagttggggctactttgtctttaaatataatttttcatgtgtatacttctgagagaagttatgtagtagaaaattcatagaattttaatttgaaaagacatgatccagtggctagtgagaagaaggagatcattatataaaaattttggggtggggcttgaggggagaacagagttggatttctgattctcaattttatttcctgctattgaataagatactagataatattcattggattactttaatatttatgggttttttatataatagaaagtgtttttttcccctcagacttttcttgtaaatcctataggccattgatttttccattctttgtgaattggatattttactaggaatatcctggtaaaagtctaaagatttatgtggtagtctaccactatcgtatggcttcactcactgaggtttcagctactcaccgccgaccagagtttgaaaataaattattacagtaaaataaggtattttgaaatagagactacatttgcataccttatattacagtatattgttttaattcttctattttatgattagttatagtgtatatagggattgatactattttattagtagtcatcgcatatatagggtttgatactattagcggtttaggtattcgctgaggatctggaacatttcctccacagataagggggggctattgtagcattcttccttaagctactgctttctcatacactctcccagagtacatgtatattttctcttcttttcttttcttttctttttttttttttttctgggagggagtcttgctctgtcgcccaggttggagtgcagtggcgtgatctcggctcaccacaacctctgcctcccgggttcaagcgattcccctgcctcggcctcccgagtagctgggactacagacgcccaccaccatgcccggctaattttttgtatttttagtagatacggggtttcaccatgttggctaggatgatcttgatctcttgacctcgtgatccacccacctcagcctcccaaagtgctgggagtagatgtatattttcattacaaaagcaattatattggcaaggtgatgtattgaatcccatgatagttattctttaatttagaggacataatgttactgatttttgtctggagcctcaaacatacccaattacaggacaacctgcattgttacttttaatgaattacatttgataccaggattttcttccttcagacttcttaaagcatgctttcaaatatactggcctgccagtaatttcacccaatttgttcccttagatagggtaatttcatcaaagttttcccgcatggccagaatctgtattagctatttggtgtgctataaatttaaaagctagtagtattcttcccactgcttatatacaaacaaaaaaacagatgttgtgattacactgtaatgttcctgcctaaagtaaatttagatgtaagaatatcgtctttataggtattgtagcaaagtatgtcattctttctcatttagcttaaatggaggtttaataaaattgctacttatcaaaagagaaactccaggggaagactaaataaatgaggtgatattttaaaagttaatgaatgaggtgccttgatctgtggttccattatactcttttcattgcttcacagagctcttaaaacataagatgtgatgaaaagagtaggtaagctaatttgaacattgccttaaaacgtaggcagtgaaacactcttattatgcctaccaaggggctgagagtagaaagtccattattctagaaaacattaggaggcaaaatgtaaaatgcaaattaatcttctttataatataatgaaaattaaaagtgaactgtgtttaaagtgagtaaagctgtaaaaatttggtgaaacaaactataataaaacatatttttaaaatttactttaaccattactttgatgatattactgataattctactttacaagactcatttgtgttatatattatgagcatagttttataatcagtatagatcacactactaatgccaacttatttcacattggtgattctgaaacttctttattttggatgtctatatggctggttttaacaaaactactaaaacatcctgtacttaattaggactcttttttcacaagcaaccaattccaatttgagcaaatttaaaccaaaaatatatgtattaaacagctgctggattatctcatgtcatctaatagtaaaaaaaaaaaaaaaaaaaaaaaaaaaaaaaaaaaaaaaaaaggcttgttctttaggagagacagaaactggatccttaatgtctgctgaaatattttctctgtgctcggtctctgcttctttctgtgtgtctatctcatctctgtttctatgccagctgttgattccaatcctcagagaagctggactagggttcctccacatttatgaatttacgtctatttccaaagacttggattaagctgaaaaagagtttctcaattttaattctacattccttggagaaagagtgtgattgatccagctacatcaagtcagctgggattagaggaaagagtttcacttgctcgtgggcacccatccctgtggatggagaaagtagttatgacagaagaggaactgacatgaaatcccaggaaatgttcattaccaccccgttagataactaagaagtgtcagtttaatgttttcattattttaagtgaattagccaccagagaaaatcttagtttttaagatataagataaattaatatagtgtttttttcattgaataaccttttcttgtactaaataaactagttcatactatcagaaaatccttaaattcttatatcagtattctgtaacttgaatagttgctctttaatttttttatattcttgagtatgcttatggaccattggagaagtggaaaagtaaattttggatttggattaccaggtaaaacttatcctcgttctgatatgaattaggtaattttaaagtggcattaagtaaactacaaagtgtatagtacataaatgccatttagaggtaaaatattattcagaatatgaatacttagaaggagaattagaaattatcacatcccaaacaatttaataggtatgaataagtaagtaatgctcagaagggtacagagtcttttattcaaagttacaaaaactgtttagagaaaacttttaacgaagagccctatcttcagattctcaactttacgttagttgcttagccatatatgaaaaccaaatgaaccaatctgaactgctcctgtcaaggagatgcactctctttccataaaagagaaactctaggaccttaggagatagtaatgcaatgtttatcctcatatgaaatttaaataatcgtctgttttactgattcggaagtttctggtcagtattgcaactgagaaagatacacaaaggcatattagggatatacctattagagtatcaggtagtcttctcatagagtccatgttttcaactcattcacatctctatattacttaagaagatgacttaagaagattgtgcgaagtgagttcacagaataaatagctgtcaataaggctcacccagacgactgggtgtgtgtgtgtgtgtgtgtgtgtgtgtgtgtgtgtgtgtgtgtaaaactgttatggtaaggaatatgcaaaactttattttttctgataaaatcttaagataaatccatttcttttcaggactggtaattatatttctagtaggatttacttattcataattgcctttaatttagattttgaagtcttccattacagtgagttaataaagagaatgagagttgcaatatcttcatgttagtaaagagtttttctgtttatgctctttattttaggcataaatgatttgtaatagtggccatggtttcagtaattcattggcacttaaggggcagtattaagatgttatggtgattagtaaacttttctctgtaacttcagtgctgcttagaaaagtgatcgtgttaatgaaggacttgtataggattagttcatctgtatatttatttttaacaactcaaattatctgcgtaagaacatttaagtacccttatatacaggtgagagcctgcttgttgggaaaaaataacgtgagattaggtatatttagctctttctctactactattttgctgtgtaccattgaaataaatgactttatcttcctaggcattacctgttaaatgtagagtttaacattaaatatccagggtattttctagctctgtttatgtttctataataaatgttaattgtacatataaacataaatccaaatttcatagatgatgatataaacttaggtctcattgttttgaaaatttaaaataaataactatgtagcaatcaattgcctcctattattaactatctttattctctccttagtatcatcccacttttggtaattccaagaactcatgaaaagatttcacaaaccaataatcagcattgatttttaacacactagaagctatagttacccaatgttattttcaattcctttccatatttcatactcatattagtattctgaacttcaagtaataagtatggaagagtcaaaattaaaaagaagagaaaaggggaacataaaacattatttttaactgtggggaaggccattgtttccaaggagaaaataaaatgctgactcccaacattctggggcatagatgatctcctcccttcctccacatccatttagatttgttttttatgaatgggtgcatgaaaaaggaactaataccatatggcattttcaggttcagcaatgaaaagtaaggaaggcaaaaatgaaatattggaataaacactcagagcttaggaaatgggagttccagatctggtgccttgtaccaaatttctggtgatgtttattaaatctctttatttccctaccctttctttcaatatctgtaaattgaggagtttcagctacacttactctaagctcactttaaactgtaaacatatttattttaggatgtattttctttatgtgtttataaacaaatacttttcttcatgtagttgttagctttttaatccataaacatttttcaatacctttacccatatcatttggaatatgttcaggggatacaaataatttaaatatttttaagcaaatatttcaaatgtaaatatttcaaatatttgtttaagcaaactatagagagaaatgtaaagttttgatggcactttctttttcctgtgttatcttctatccttactaatgcattataagcaaggtttgttttttagatagtccctcaagtcagtttctaccaatggattaaggcctaacagaagaccattgctccttaagacaaaacaaatacaaatcataaaactaacaaacacaacgcaagaaaattctgcattaaaaattagttggagtaataaatcacaataaatgaaaaggcaaacatgggaattattttcacaagatgataaataagccaagattttgctcttttacaatctcatttaagctgtaacatacactcttgcaaaaaaaatcgtcacgaatagcctacaggcaataaagagggtgggcctacttagttaattttaaattgtcagctctttttttcctattctttcagtaaaataaactgttttgctgaataagagggttaagaaaaggcctgagtgagtcactccaatttgtttccacattctgaacagtcaataaagaaatttattgcctcattaggcattttgagtagatttctggaaacctgggtgacgtaagacagaaaagtaacctcgtaagatgttttaaaagtgattgcagctgaatttgtttttgaaattgcaagttgcctgttagactggaatggcatcatgatttgtttcaagaaatggtgccaggcagtgggctggtttcaaggagaggaggaggaaacttgtgttttcagcaagaactgaaaaatactgtaaatactggttctgaaaaatactgtaagatgagagaagtgagatgattagaagagggcaaggtctcagtaatcagatcaagagtaagcttcttatgaggaaaaaaaatgaaagcaatgaaaattggaacattaaactgaatgggaagcaaaagccagcaatgtacccactgcatgttgcatcctaacttctgcttagctgatagttagctctctgttcaaatgtggacacttaaaatcctatgtgtccctcagatcaagtcatctctaatcactttgtatctagttttgggcttcaaagacttattagtagccgaatgaaggtagctactttccccacactctatgcttgtaataatcttgaggcaacctgtcttaacttcttttaaaatgactgaaggttatactgggggttggttgataaagtattattattttttgaatgaaggaatgttgactttgctccaaaatgtaaacaacccaggaggcaaaattcatagaacaaatgacttattaacaagtagaacacaatgggttgcttgcctaaactaactttctttttattcttttggcaggtaaacacattaatcataatcagtctgatctgtattaaaaaataacttaataaattaatcacaatcagccatagaacaagtaactttcagggaatttttcagatacaaggaggtaaaatattggtttcccaaaatgaatatatatattcatgtgtgtgtgtgtgtgtatgcatgtgtatacacatgaatgtgacattctatttaagagatttgttttcataaaggaaaaggaaaaaaaaaggaataaaaagggaaaataaagttttaatcagaattctcttcctgttagtcaaagacagatttatcagcactgtttcattctcttattataaaatattctaactttaggagagatcttgaaatgtaaaaagaaggaaatattttctccatcatccattctttcaaacctctcaactgataccttgctactgttgttccattgaatatccggagaataaaatttaagagagaaaaaaatgtggtgacaggatacaaagggagaggcattgggagaagaaacctagtactcatctcatctttgcaaatctctctagaaagtgtcttcatctgcaaaatgtggggtttgaactggatgactttagattgcccttgaattttaagggcaatgatgagtctaacttggtagcctggaggagattaaaatctacttaaaacgttagagaaaaagttaagagcggcaaaatggtgctgtgtttcattactccctttttaattaacattataaaagttccagatctgagatcctgccaaatttaaagttctactttttgacctatccagacatagctcagagatattgtgggtttggttccagaccactgcaattaaacaagtcacataaatgctatgtttacactatactgtagtctattgggtgtgcaacagcattatgtctaaacaaaatatatattttaattttaaaatactttattgttaaaaaatgctaatgatcaactcagcctgcaatgagttgtaattttttgttagtgtaaggtcttgcctccctgttgatggctgctgactgatcagggtggtggttgctggaggatggggtggctgtggcaatttcctaatataagacagcaacaaactttgcagcatcaaccaactcttcctttcacagatttctctatggcacgcagtgctgttcggtagtgttttactcactgcagaatttctttcaaaaatggagtgagttctctgaaacactgccactgctttacccactacgtctatggaatgttctaaatcctctgttgtcatttcaaccatgttcacagtatcttcaccacggatagattccatctcaagaaacattttcctttgctcattcataagatgcaactccgtaggtgttcttatactatcatgagattgcagcaattctgtcaccgcttcaggcttcacttccaattccaattttcttgctctttctaccacttctgcagttatttcctccctgaagcctttttttttttttttttttttttgagatggagtctcactctgttgcccaggctggagtgcagtggtgtgatcttggctcactgccagctccacctcccaggttcacgccattctcctgcctcagcctcccgagtagctgggaccacaggtacccgccaccgcgcctggctaattttttgtatttttagtagaggcggggtttcaccatgttagccaggatggtctcgatctcctgaccttgtgatccaccagcctcggcctcccaaaatgctgggattacaggcgtgagccactgcgcccggcctcctccctgaagtcttgaacgcctccaagtcatccatgagggttggaatcaacttcttccaaactcttgttaatgttgatattttgatcttctcccatgagtcgtatatgctttaatagcatctagaatggtgaatctttcccagaagatttttaatttactttgcccagatacatcagaggaatcactatatatggcaactacagcattataaaatatatttcttaaatactgggctgcagaatggatgttgtgttagcagacatgaaaataacattaatttcctcatacatctccatcagagctcttgggtgaccagtacattatcaatgagcagtaatattttgaaaggaatattttgtgtgtgtgtgagcagtaggtctcaacagtgggcttaacatattcagtaaaccgtgctctaaacagatgtgctgtcattcagattttgttgttccatgtatagagcatagggaggatagatttagcatggttcttaatgaccccaagacttttcggaacggtcaatgagcattagcttcaacttaaaatcaccagctgcaatagcccctaccaagtaagtcagcctgtcctctgaggctttgaagccaggcattgacttctctctagctatgaaattcctagatgacatcttctcccagtagaaggctatttcatttatactgaaaatctattgtttaagaaaaccgcattcaccaatgatcttttgaataacttacttcagcttctccatcagcacttgctgcttcatattgcatttctatcttacaacgatggcttctttccttaaaccttatgaaccagcctcagctagctttaaactttttttcctgcagcttcctcgcctctctcagccttaatgaaattgaagagttagggccttgctctagattagactttgggttaagggaatgttgtgttgttcctggtttgaacgtctatccagactactaaaattttctctatatcagcaataaggctgtttctttttttcgccctgccccgccccgcccccacccttttttttttttttttttttttttttttttttttttttttggcggagtctcgctctgtcgcccaggctggagtgcagtggctcgatctcggctcactgcaagctccacctcccgggttcacgccattctcctgcctcagcctcccgagtagctgggactacaggcgcccgccaccacgcccggctaattttttgtatttttagtagagaaggggtttcaccatgttagccaggatggtctcaatctcctgacctcatgatcctcccgcctaggcctcccaaagtgctgggattacaggcgtgaaccaccgcgctgggcccaaggctgtttcttagcatttgtatattcactggaatagcacttttaatttccttgaagaacttttctttgcattcaaaactttcctctttggcacaagaggcctagcttttagcctgttttggcttttgacatgctttccttgctaagcttagtcacgtctagctcttgatttaaagtgagagacgtgttaactctttctttcacttaaacactcagaggccattgtagggtattcatttatttttgagatggagtttcactctttcgcccagcctggagtgaagtgttgccatctcggctcactgcaacctctgccccccgggttcaagcaattctcctgcctcagcctcttgagtagctgggattacaggcacgtgccactatacccagctattttattttattttatttttttgtatttttagtagagacagggtttcaccatgctggccaagctggtgtcgaacttccgatctcaggcaacccaccctccttggcctcccaaagtgctaggattacaggcgtgagccaccacacctggaccattgtagggtttttaattggcatcattgtaatattattatgtctcagggaatagaacagcctgaggagtgggcaaaatttggagaaaccatcggtcagcataaaagtcagaacacacacaacatttattaagttatctgttttatatgagtggtttgcggtgcccccaaacaattacaatagtaacgtcaaagaccactgatcacagatcagcacaaccgatataatgaagaaagtttgaaatattgagaaaaataccaaaatgtgtcgcggagacacaaagtgagcacatgctgttggaaaaacagtgctgatgataggcttgcttgacacagggttgctacggactttcaatctgtaaacaatttaatacctgtgaaggtcagtaagtgaagttcactaaaatgagttatgcctgtgtatttttccacacgttaattattgctttttgagaaagcataaggtgttatcttttaatgattatttattgattatgatgtttactgaggctcttgtggatggttcggttcaacaagtatttgattcatggctactatgtgttgagaagtgagcatgggaatagaaagtaactctcccgccccaaatcaaaatgacaaatagtcctaggtttagggagtttagaatatgcctggtatataataggtactcagcatacattgttcaatgattgaataaatgcactaagggaaacaattagagtataatatctgtgcttaagtatatatatatattatctatatatctctctatataaacatttatatccagatattaaaatgccaatactttctaaatatttccatgacccccccaagcaaatctttgcctactcctctatctatctgtatagagatctctatctatatagagagatatgtagataatatatatacttatttgttacatctatctatatataatatagataataaatctatatataatataatctatatatgatatataatatatcatatatagatatataataaatatattatctacatatctctctatataaatacatagttatgaagagaagtaggcaaagatttgcttggggagtcatggaaatatttagaaaatattggccttttaatatccagaagttagaatacatatatttacagtaaagatggcaaggaagcatattagttgatgtattttaagaatgggacagatctgccagaaaaaattagaaagaacaaaagttaattgaggaatataatcaataaactggattttttgggtatgtatatatgtaacacatgtgtaataattttacacatatgtagagaaaacttcatactctccaaatactgcatattcatcttttctctgtgttcataaaatatacatatttattgaagaacaaaaaaataaaaaaacaaagaaagtattaacatttgagttggcattccaacaacaaatcagattttaaacattcattttaatcagagaaagcattctagtttacagcatgtttgggaacaattaacatgtatataatgaggagtggtcacagatcacaggaagtgaggctggaaaggtggctggggcaaaattgccaagactttttaattccaggtgaagtggtttaaacttcatgctatgaatagttaaaactccatactataaataatggcattttgtgtgtcaagaacagagtgaaatgacccaggtttgtttttgtgactcctgatccttttagtgtgcccagcctgtccggattaaacttttaaagaactcattgacctatgctctagcaatctaatggagccagtctttaacttctaaagtaatgtactttctgttagtaatttatgatatttaaactatggaactgaacatattgagtagggcttttcaaatggtacatcatccttcaaatttctgaaaattctgttgtcttccttctctccctagtccctcccatcccctcatgcctttctacctctgcattttttaggcttggaacatattaaatggacgcaggtgttgttcccactttaacacaaaccttagaggcacaaaataataaccaattttataaacaaaaataaagaaaataataataccaagagccaggaaacaataacaatgcaatgtaagctctcgatccagatggctgaggttcaaatcttggttttgccactgattggctatgaccttgaccaatttacttaaactccctgcagctagattttgaggaataatgttaccttctctcctagcaatgttggaggaataaaagagttaatagagattatggcctgatgtatagtaggtggtgcataaatattgtagacgtcattgttgttatcgtatagcaggggaagttggtataatttttgtttgtcccttatgttgttttctgacctggaaaggagtaacgctgctccttttaggaacaaccttagtcctcacttcatacataaatcacatgttcttctctttgccaacacctatattttgataagactcaatatctgaagctaaaaacacattcaaatctccttatgttactacttcttgttctaaccaaacaccaacattagtacttattctattttcttgtcctgtctattcatacaatagtggcttttctctgtatctgctttctgcttgtatattgagtcaaggactttttcctcgaaggcctgttttgtgtgtagcagttcaaggactatcaagtcagtcctttatctcaacatactccacaatttgaaaaaataaatctcatttttattagtgtgattttataatttttttataagactttgttaaactttatgaatcttctctagatttctttatggtttacatttccttgtaacttgtgaagaccagatggaggttcagttaagttagggggattggagcattgcttagaacatcaagtcccagactgggccaagagttctgaaaacaagctggctttctgcttatccaaatgagtcatttgggaagccattgcctcctttgctaaagacactttcttcatcatcaactttgattgtggtttcttttcagacctattttgactataaaataaatctgaaaaatgctttagacagaatatcactgcaaaatgtaagctattcttcacattaggctaaatttaacaatgatcctgaatttaaaaaccagagttaaaaatgacaaaaaaaactgtgatggatttattattgacattactgaattgacatggtcagttaggattaaaatattatgagtaatatgaatgttacgttatttaaaataaagagatattaagagactatttgtttttatcattttatgagaatagctagtagcttcccctctaccccttcttcaataaaactaagcagttcaggacatcttgtattaatgcaagaaagttagattaatattaatgataatatagtgttttcatgttgtagttgttcatctgaactgagccttcagtattctttaattttactcagtgaaaataaactttgtttatctcagctctttaaaaataaatggcattgcaggattgggtagaaccctgggcactttgtttggtcttatattactctgaataccaaaattattttttttcaagctagttaaatcatcatttgaaacagagctgcaagactaacatatggactacaggagagtaatagatgtgtcatataccaaaaacagaaagatccattaccctaaatgtgaaattgtgagagggaaggagaatacacaaagtaggatgtctggaagccttttttagactgtattaccatccatctagaaaaatgttataggtaaataaaatatgttcttactgaataataagtataatatgcgcaatttatcctcattacaaagagattttattgtgtgtgaagaattccacagagagccattacagatccattatagtgtttttagtgatctgctctacttcccaaaccgtggttgttttatgcagtatcagatgtataatgtgcatttctatttttttcctgctccaaactcgctatgcttacaaataattaggcaggaggggttttgttgccttgttggccacttcttaaaagcatagtataatttattggaacaaaatatagtaatgcactttaaggaaagttctcttatgtaaaagctcaatctcaaattgaatgaagggtaaatttttattcgcaagaattgacacatttccaataggaaaggcttcatagttgcagtattttattatgataattgaattttataagaatagcaccatttacttctatgaaaatttattctccttgttctgctccagagctttattagcttcccagtatttccccactcttccacctggaattcatgggccaggccccaacttacattgttacttcttttatatataattacttttgcacataagcattttcttccactcagcctccatcttttcaagaatatgtgtgttccttcacttcttggattcacgcttttactttctctacttttcctactgctccaattttttttcttgttctaaaggtctttaaaatttttcccatctctataacgctatttgtggatgtgtgggtctttttctttcaaataaggtacacatctgctgtgctgaactgctcatctatctgtagagcagaaagggagggtacacctgttgaatgtccagagttctccatggatttttctaggtcttctacgttatgtacctcatttaattctcttaacaaccaggcaatgaagaactagcatgcctgtttcatgggcgaaaaaactgaggcttaatgagtccaagcagcttctctcaagtttctttggtagaaagcaaaagaggatagattcaaatccgtctttttcaccaaacctgtgtttgtttgttttttagctttccctatgtgtgtgtctatttcattttcccatctcctgatggcaaggactctatcatgggcaattttatcttttaggtagccgtcacatatctcaattctgcatttacctccttgtgtagctcaggtgccacattttccttcacagtgtttttccgatttttacttattaaaatgatttgcatattcataagtagaaatggtatatttttccttgttagcaaaaaaaaaaagaaaagaaaagaaaatagtcatgtgactaatgaaaactctttcaagttggtctatagtttcaagttggtcaagaacataaaagaacataaaagagttttttatgttttccaagtttgatttctatcaactttatattctgtgtgtggttgataatatttctcagtttatacagctttgtgttctcttaaagaataatacccacttttcatagactatttaaatcttcattgggaaaaaatatcaaaatttataaattatatgaatatatttaattagcacatgtgccccaaaactatgtacatctattatacagcaattttaaaattttaaataaaaggtaaatgtaaaaaaagtacatgaactttgaaccaaatttagacatgcttaataaagcctatgtttatcactttgaatttggtattatttatttattattattatttattactttgaatttggtattatttaaaaaggaatccagtttttaaaactttaaatgaaataacatgtctgaagagagtttctagatgcagcttactcatctatatagggagcaaattacaaataaagtctttaaagaacccataaatgttgagataacgtggaattactgataagcaactcaaaagctgctccttaatattgttcacctatttatcaccttattctaagccaaactcctaaacaactgaaaaagaaagcttagataattggataatatttcttcacaaagtcagcttaaatttctgtctaaatgcattataatacatgaagaaggcttttaatattacttatgctaaaggaaaaaatatgctggttcttttgtcaaccttcttttgtactaattgtgtaagtttgaagcgagggctgtaggaaattaaaacagaaaatagaagtcctgattgtggggcctgttgaatttgcagtgtaacacaggagataaggcatcagtttaaacaaacatagacacacacatataacatctcaagatcgcataatacagccgccaagatggggtcacagatgagttcagtaaataaagaatgtcatggactagtatggtcagagaaattgttaccaaggaggtgcaatttgaaaggacacttcaaagaggggcaggattttgttagttggaaagcaggtgacacagcaatttgggcaggaaggaaatcaagttgcagaagttgcttagggaaagtaggtttgaaggaaacatcagaacaactaaaatagaagctttgctcaaataacaaagtctcgttttatttttatctgttttttttactttacctctatcagtttgtcactcttttcaggctagtacaaactgtcatgttttaaaatctctgtacttttattagttgtaggatgtaagctttgaaataagctttgcaactgtggagattagtgtcccattcctttaagggtctggccaacctaggggatccacagatattagctgctaggtggtcgatcaccttgaaacaccatcctgttatgctgtgtcctaatagcttgagaagctgaaccagaagtatgcagttcacttctacacattctgcagctcttcctgaacaacttcatttttcatctatttcacgatgaacagaaatattctcagaaattctttttttcttttagctaccaagatttgggcctgcttttttattggttatttcgtgagggtaatggggcatttgaccattctaatccgcttttctgagaaccagcacattctgaaaattgtctgagccctctctcctttgactatcaataaggatcacttttagataagtcgaagaagaggccagactgaaacaggaacctgtgaggctccctgttgcatgtttttaattcacacacccacatggctacatccaacagaggtgacctgaattttactcctttgatgttgcataccataaattcccatagcaggtttgcaacaaagggggtattttaaagcttttttctaacatcgccttagcagatactgactgatcctttcccaggaactgagagggtcccacccatgctcctgattttagaatcataaacatcagtaggaccaagatgcttttagagggataaagtgactttaatttatcttgggtggtcaaaacacagcatgtgcaatatttttacaaactatgattcagaaagcacatagttctagagcgttttgttttttgttatgttggtgtcactggaaacagttgtgcttcctgatgtcttactgagatggcctttttggtcattttgggccactttcccaaggatactgcatgttgcctgacctgtattcctgaggaaataaggaggacttagattgatctgttttggacagcgtactttctctaagaatggcgaaaggaaaaacatcagactaggatgctctccagaaataataactgagaatctcatcctgttgtgtaaactctccttgtactttgctctgtgtgtgtttggtggaaatattatttttaaacagccatttactctgaaaaaatatgattttgcattaaattagttttaaagttaagggatatatataagacctttttattaacaagttgatgagatgagcattagtatacctataggaagtttttgaatgagtgccaattctgaatttacaaatcaacatttcttctctccagctttctttagcttgcccatggtgatgtgaagatgagaagaaatagcaaggcccaaccagttcttcatctggagacagttcaacgttctgcaaaccaggtaaaaataatacagacgattttaggaatgcatagtcactttataaaataaactattttctttctcaagtttgatctacagatttttgcagaagctatatttatcatctaatgtataacttgttaataaacatgacattgtatcaatttcgattatctgtgaagagcagagtgactaaagcatgcatttgtgcattgactcattaataaagttatagttgtagtataacttacttttataaaaatattttaaagaaaaaagaggacatgtggctatttgatttgcttgttacaattctaaacaaagtaaagagaggtatgggctaaataaatttaatatttctttaaaaagtaacttttaccaaatgaatacatgtgcatatatttaaaattcaggtaaatttaaaggctagtaactaaagaaataaaccttttggcacaactgcaggaaaggaaccactttcaaactctttaatttttattttacttttgtggttttaaataacatctataaatctatctcaggatttttagagttagtgctctaacaattgatttcttgttgctatagatgtggatttaaacttccttaagacctcaaaattcttgattctcccaatatagctatatcactatttttattgttttaatttaaatctgtatctgaatttatagttagtaagactatacaaataatgtttactgctgagactggtgatgtgatatgattgcattctctttactgtagtagaattttcattttctcttgaagtcagtgcccttccttccttccttccttccttcctccctccctccgtccctccgtccctccctcccctccctccctccctccctgcctccctccatccctccttcctccttctctctctctctctctttctttcttttttttgatggagtctctctctgtcacccaggctggagtgcagtggtgggatctcggctcactgcagcctctgcttcctgggttcaagcgattctcctgcctcagcctcccgagtagctgggattacaggcatgtgccacaaagtctggctaatgtttttggtatttttattagaaacagggtttcaccatgttggccaggctggtctcgaactcctgatctcaagtgatctgcccgccttggcctcccaatgtgctgggattacaggcgtgagccacctttattcttcttttgctcagtttctccctcaccatctccctatctcccttctcccctccttcctttttccctcccttcctcctattcttcttctttttattttttttctaggtcttcccgaaccctccattatctttataaaatgcctttctattcaattttctacaatgacaagctggtcaaataatctagaaaggtccccttcccactacccttggagaaatctctcctgctaccctggctccttccagataaaagtagaaagagacaggagacttttatctccttccacttttaccttccacttttatctctagttgcgctcgaaggcttcttataaagagatgtcatttagggttttgtttttgtttttattttggctgtcgccctagtttattcttccattttatgatgtggtaggtgttttttttgttgttagtttttgtttttgttgttgttttttgttttttttctagaaatcatgtcctctttttacttggctctgccaaaaagcttgattttaccccagtaaaactgatgttaagtttctggcctccagaactgtaacggaagaaatctcagttgtttttaagtcagcaagtttgtgggaatttgttatacaagaaagaaacacaatttgcattagagtttctttttcttcctcattctttgcaatgatttttggaagtagaaagttatggaaagattatttattttaccttcttgaaattggaatcctttagttatctgatttaagatagttttctttttctttgctataaaggttatatccaccttcagaacaatgatgcattctcagttgtggaattttaatagagtcttcattcctctcctcgtcttagtacgttatctcctgtcatatcattctctcctcttctcccctcccctcccctcctgtactctccctgccctcccttcctctccctttccctcccctccaccccctgccctcctctcccctctcctcccctcgtctcccttcctctcccttcctcttttctccttttcctttcccagtaatccagcagttgcctactgagtgctagatgttgtgacaggctttggaaatactgaaaccaataaagcagtttgatgcctccatgaggtcaccatctattggtatagaggagggacaaaagtaacatttgtttcgtgcaagacataaagccaaaagcagaaataaaatcaacaactaaaatactgtactaaatacaaaatcaggccaggagcagtggctcatgcctgtaaccccagcactttgggaggccgaggcaggcggatcacgacgacaggagtttaagaccagccttgccaagatggcgaaatgctgtctctactaaaaatagaaaaattagccgggcatggtggtgggtgcctgtaatcccagctactcgggaggctgaggctggagaatcgcttgaacccaggcggtagaggtttcagtgagccgagatcgcaccactgcactccagcctgggtgacagaatgagactctgtctcaaaaaaaaaaaaaaaaaaaaaaaaaaaaaaaaaaaaaaaaaaaaaaaaaagaaaggaagaaaagaaaagaaaagaaagagaaaaagaaaaacaataaaaaacccaaaaaactaaattagatacatgaacaaaatattgtgacctcacataacatttagcaaatcgctctgcttggcagagactgggataatttattgaagagtgcttgtgcagcatcttaggagatgaattagcattttagaaagaactaaatgggagaaaggcattttatggcaaggaactggctctgtggaaggcacacacatattaaggagcacacgtttcttgagcatggccagatatttaatgtgcccagaacatagattaagagtggtaggagtgtgggctaatgagactataaaggtcaaattatgatgaatattattattattattattattatttttgctgtgttaaaagtttaggtttttattattttggaaatgagggaaactaaaggtgttgagcagaaaaatggcatgtattttaggaagaaaattctggcaatattttgattattgagctgctggagagaggctggaaaaccagggaaggggctttgtaagaaaccaggtgagcagtagatgacaattacctgagtcaaaacagtagaggcactgggacaagatcagagaatggaatcaagagatatttctgaaaccaaattggcagagggatgaaatttctaccttttagtgaaagacagtaagtgcaatgctagcagtcacagagagcaactggatgccaggggagagggactcaactgggtctgggcagaagcagaggaggtgacatctaagataagtcttaaaagagagaagaaacaagctacatgaaaaagaagagaagccagaaaaaggagagaaagcagattgtggctgcagggctctccaaacaccaaagactctctagtaaaaggcatggccatgacaaacagagtggctgctggctttgctttaattagcatataattattggtggagaaagtctggtgggaggtaaggtgggaaggaaccagtcactggaggcttctggttaatgtccccatcctttctttccctaaacatcactcttaccctgtgtagctgggactacaggtgtgcactatcacacctttgtaactttatttttttgtagagataggatgtcactattgcccaggctagtcttgaactcctgggctcaggcaatcctctctcctcagtgtcccaaattgctggtatttcaggtgtgagccacgtgcccagccccttcttaaatgtataccagtctttaggcctaaaacaatcttttatcaactgctaagacttccttcttttaaagatatgatcagagcttttgtctttcacagcaggcatcctagtttcatgttttcttgggaaatttgtatagattcacactcactacaaatgttattttcagctgttttatagatgtataatgcaccatttattcattcagtacatatttagcaagtaaaagggaacaaccaagattcattctatgccttcttttgttggaattcaagcacactaacaatgtgctctcttgttggacaagcatgaaagaaaaagataccctccttgtcaggtcttcatagttctctgtgcttacaagaatcctgcaacatttgacgatttcttctcaagctttccttcctgaaaggaaaaagggcaagaaaagaataaactttgtaacatgtaatctgtataatatattccaaaatgctttagctcagatattttggatacctttctgatcacatgctatagttagaatcaattttctttcttaaaagcttgaaagttaattaattgagctatgacttggggacaaaatgaaaacaattcccccatccaattcaacagaaagtgggatctgtaaaaatagctcttcttgaaaattttagaactagaatcatagaactttatttgcttttatattcattatcccataatatcctcttataaatggaagtttagttctgatcatttggatattagctcagggagctcaggaaagtagtatgctgccgttgattaactcttcaggatgctctaactcaacaggcaaagtttcagtaacagcataggcacccacagttttaggtactagtgatttagggccagttgtttaagagtattaactcaaattcggcagccctgctcctgagaggcttgccttctttgccaacatcctctgattcagaatatcctaatctaaagcctgaagacagtcataaggaggtgaatacgatctttacatgtactatattttatttttgtagaagttccagagatagtattttacccatatacaaattagtgtcttggtatggtaaggatttttggcaccaaaatctctaaggggatttttagaactaaggagggctaaagggaaagataatttgaataggttggcctttccacactccttgagttgtggcatgtgacatgcttttcactatctgctgaaggaagccctggtttatctcagaaacattcttgtataagtgccaaatacagtcttgtttcttgttcttgactctgccactccatgtggctgtaatatgctggagcacatttgcctaatgcctccggtatcttttccttggttaaaattgttattaattccacactatcttcctaggtctgtctctggggcccaagcagatttggtcacccaacagctagagcaaccacttgactgggtgaactctattggcaatgaggcatatgggggccaggcagtatcatccacgatagatgaaagacaatctgggtatcaggaccccagttaagcccaggcctcacacacaaacgatcctcccttgaggagctcaatagttgcccctcaaatagtttcccataggattagacttcagctttgacctgtcactattgtagacatgctacctgtgcttacttacttacattaatgtagcaacaccagtgaacacaagaatcaattatacatgtgcatttcataacacccctccaggagccattcttcctcttccttcccagctcccattctaatcatttattcattttttaaaattatgggagatcatctaatattctctctctctctcaccttcatatttactttctttatttgttttagtgggtttttttgttgttgttgttgttttaacaagagctttgaaaggcaacacccaggcagtatgctttatagatttatcaaaacaaaacttgttgaactgggtgctcttgaccaccctgctctctgattctcaacatgagatttcacctgcacattctgataccttgctgagctttcacttttcattaatgacctaattgtatagttttctctgtgttggcatgcttgttctcttccctttccctttctccttccttcctcctttccttctttcctttctttctttcttgcttccttccttccctccttccttctctttctgcctttctctctccctttctttctttcttctttttctttctttcttttctctctcttttttttttaaagcaacctcactcaactcccagttgctcacccatttggctacatgtatcctcggctgcagtaagatactttcttgcttcccaatcctttgggatctgtacagatagggagagtctcagacatgagttattttagattgtctgagaagatctaattaagggtcaaagtagtagatgttgtgggagggcatttgtcactggatgagatgactgtcaccatatgctctcgaaggagaaaacaaaggctatagacagagatgaacatgattttatagatttatttttaaaatcttcctgtgaatctaagcaacagagcagaagcagtgaaattgaagggaagggggaaatttccattccttaaaaaagaagaatcatttcaaattctaactagatttgggaaagtaaaatatttgaaaaaattaagggctttaagatgtgtgataaagagaatgctgaaattaatgatacagcaaagttggaatgtctgcctctcctttgtttaatgtttttcttttattaaaaaagatacttatatgtttttttaatttagaaaatatcagaaagtaaatccaatattctactatacagagatgatagttactgtcaacattttgatacctgatcttttaactatattgaaaaatactcgtcttacaaaattggaatcatacattatctgcagtttgtttctttccccctgcttttgcttacctaaagtttacatctcatgactcttgaaaataccatttttaaccaatatctaatatatcataagaattgatatactctattttcagttttcctggcagttataaacaattttgtacaaaaatggtgcacacattacacatacccctatctcactaatgaatttcttacaaaagggccctcaaagtatcactgagaatcgtgccccatcttagagcctttcactggtacgtccctctccacaagtgcttttctcccatatattacgttagactcccatattacactcagattattgctgaaatgttaccacaccagaaagacatttccctgaacccgtatgtaaaatgtcgtatctgctgcctccgaagttatttgtcttatcctgcgttatttttgtcttaacgttcagtagtacttaatatgtaatgtttatttgtctacttgttatctctacctcatagaatcgaagataaacgaggcagaaattttgttttgttaaatgctttattcctagcatctgaaacagtgcctgagacatagtacgtgatcaataaatacttatttgttcaacaaataaatacataaaaacaaaaagtacaaaacttttggtacatataaataagttgccttccagaaagcctgttttaatttgtatactcatatgtaatgtatgacgatactcattttacaacagaataacccactttgaatattagtttttaaatgataaaaaaataaaaatgtacactatatatcaatgttgcttcaggtttttttgttttgttttgttttttgttttttttttgagatgcagtcttgcactgtcgcctgggctggagtgcagtggggcgatctcggctcactgctacctctgcctctcgggtttaagcagttctcctgcccacagcctctcgagtagctgggattacaggtgcctgccaccacgcccagctaatttttttgtatttttagtagagacgggtttcactatgttggccaggctggtctcgatctcctgaccttgtgatctgcccgcctcggcctcccaaagtgctgggattacaggcatgagccaccgctcatctcttcctcttctttatccattctttttaaattaaagtgtttgctcctttttttcctttaaaataatgtgcaagagctgttatgcattaataatgttgaagttattcacatttttatagacatgtttctctctttcataatatcatttttaagtgatatcgtaatatcatttttattttagattcggggagtacacgtgcaggtttattacatgggtatagtgtagcatgctgagttttgtgtatgaatgatcctgtcacccaggtagtgagtatagtacccaatacgtttagccctttcctccctccctctcttcccccgtctagtgaccccccgggtctattgtttccatctttatgtccatgggtacctggtctttagctcccacttataaatgaggatatacagaatttggttttctgttcctgcactaattcgctgaggatagtggcctccagctgcatctatgttgctgcaaaggacatgattttattatttttcatgactgtgtagtattccacggtatgtatgtaccatattttcttaatccagtccaccactgatgggtatctaggttgattccatgtctttgttattatgaatagtgctgtgatgaacacacaagtgcctgtgtctttttgggtagaacacagaatatacttttaagttttccttatgttttgtgacattttagatttaaaaacatgtgaaatcaaatattagaagatttcttccagcaagcttacctatattgttgctacagatttcaaacacatctcttattttttaaagtttgtcattgatttcactgttgtaattttccagtgtcatttatcatccttacttcatttttttttaaatccattatggtttctttcttttcttttttttatttttaagtgtatacctccgtttcattttcttccttttattttaagccatttcctccttcttgtcctgtatgatagggaacatggctttgtgaattttatttaaaatccctgttttcacctgttttaatagtagtatatttacttattgctctccttttaaaaatgttcttatcccattttctctgtagtatttgtgtataggctccacctttatatttgtttttttattggctcaacactctggattagcttagatctatccaatgtcatgtttacaaccagataactcctgttgttttcttactattcacttcttgctggttaaatcccattcatgctgattaaatccacttcatgttgctccagctgggtgacacgttggtgtgtggacctcccagcagctagagaccaggacacatctatgcaatctgactttgctctcaatagtaagtaggtctcttatgtcccaaaccttgttatatcacaaggatgaaaagctactattcctagtacagtaagttcatttcttcaccatcttcctctctctcctactgtataactcattttaactaattttggggggatgtaatgtgttacatgccagccctccctgccccgtcctcccccaactccacctcgctgcaactttctgtttttgggtactaatgccaaaataggaagagatagtgatataaggacaccgcactatgtaccctaagaaccagcaccttctattgatacctgatgtaattatggcagtccaagttttggtggaacaggccataaatatgactgcagttaatcaagaattgttaaaaataccttcttaattttcagatggataggactaatctttctacaatgcagaccacctgtttttcttagcccaacatcattagctttagaagaatggtaaagatattaccgctattaatcttagtttttagaattgttgagagatgtacttttcagtttaagtattttaacaaaaagttagctgagaccaccttgtgatggtggactgctatccagatgtcatggaaaactaaaatttttatggcaatatttttcaggtctttgattttagttcaactcttccttcatcccaaaatgactatcttccaagacattccaaatgattggacaaatgcatagatgcataataggattagagtagaaaatatcaacatgacataataagtagcaagtattttcttttattatgtgatgttttgaaattatgtctttgtaacttcatatattattattatgtcataccattttgaatggccttttatttaattaaaatataattttaattattttcatatttattctaacttagcatctctaaatacacatcatagggttttagtggtagaattatctaagctattgagatgtttttcaagttagatgaacttagtgaaaaatgttctgcaatgtttgataaaatcaccacggcatctagagcagtggacaatatccccgtgaaatgatggtggaaaccgaccaacttttttcaatagcatcctggtagtgatcttttcagtcacttttaaaatgggatttttttctgtaacccgtatgtaattcagaatgtctgtggttgttttagtcaactggccattaaaaaaaaatacattatggactgtgaactcaccaaggccctttcaagtgctgatgtatgttttatgttttatgtaggttattagtgaccttttttgcacttttatcagaaagtcctttgttttgtgcatgtagctctgtcagaatagaggccagatcttcaggtgtttaattgcagacttctaatgcataagacctgctggccttgttgacttttagaagttatttgttagtctcaaatgaaagaaacaagaaaaaaaaaagcttgctctttttataacagagtaagatgaaacatgcaatgatagggtggtgctgagttgtagaaatttctaaaaactaggtattcctcaaacagtaattagaatttttgattttctacatatctattggctaaagagccaaaaatggttttcaataatgcctgttttcaatatataaaacgtccataacagaatcactaaaagacatcaaattattattatttaaaatttattgagaggcaatgtcaatctgttttttcaaacctatcagtgactctctattgtatattggagaaagtagaaactcttaatttctgccctaacccccacccataactgattttaacactcctattaccacattatttgttactgcagtttttaaaattgactctatccatcagacagtattatttggccgctgtttttttacacctgtcttatttattcttgattttttttttttggtttgtctgttttatttatgtcactgtccactttgcagacaatttagttggccaggtatccatgaggaatattgccattcctgcactgtgctgagtcagacatgccttgtggcatcatcaagtaacaaggttgagaaaacgtgggtgtggcaaatccatttctgagtaacagcctttttggagggaagagattggctaatccaatcagtatcaaagcctgtgcttcttaattgggttgtattattcaaaagcatggatttaatttgaaataaaattgcctgatgtttctgtatcattgatttattgatggtggcggctactattttttagtgttttcaaggaatatgaaaacttacagtatgaaatttacacaaatctgtagttttaaaatattaccttttcctttagtgtttctcctattttccgttagtttgagttctcattttaaaaaaatgttaaagagaaaaaacatttgtctgacatagagctcaaaaggaaattctcattaaaacaactatgagaatgagagaaatcatgatactaagatagtatgtaatctttagagtttaaaatagttgttcctagcccctaaagtgatattattttgacttccttaagcatagagaactttgtttacagtagttctactctgcagttaggtgtaataaaccagcattctttacaaaactcaaatgagaccttggaacctgagctatatgagtaacacatatatgatcctgtgatctatatgatatattatttgtcatttctctattcccagcttgaaatttaatataaaaaaaagtttcactgcttcattctaaatcctgtttgatccaacatggaaaacattgttttagatttcttaatgtaaaaaaaaaaaaaatatatttgactggattagatagtagttactgcaaaaagttactgcaaaaaaaaaaaaaaaaactcggagtttacctttagtcacatcttcagtacattttctattaaagtatttctagattttagtgtctgcttggttttggttatctaagctgtaataagtagccttgggacccctgaaggcacgccccacacacttatgctgtgtgacctaaggtcacaagtaatggctgcaagctaattgattgagaaagggttgtctggcggggcctctttgcgtcctccctttacattcctaagttctgtgaaagaggcactagtagctcaggctagcaaggaaggaaaaaagaggaagtttctctctgcgttctgattacactctgaattcccttgtagtgagcttacttctctccacccacttcttaccaagaactccttaacttgagggtgaacaacttaaagcttgatcctacagttacctgaaaagtgatttgagtattcattgaactgaaagaacaaatcgcctacttcaggcggtggcaagcgtatggaaattatattagaacttcagcaaagtgcacagctgcataatagagaagccggcactcagattgacaggcaaataagccagcttgtggaaggggcctctgggtggcagctctgggcttttgggtgttggacaaccataggcaaaactgaaatggaacaggggcagaaaatagcacacttttactctacgcaactgttgctttttcatggtgagtgcagatttaagatattatatttaaaatatactttctatgttgtaaaacaagttaagaaatctgttgtgctttgagggaaattatagcaaaagcatttcttagaagttcttagacgatgtggttttgtttctgcttgatttcacactaaccttggtgatgcaaacagaaaaatacaatatttgtattgtctcgtgtgtcctttttctgaaaattgtcctttggtttaaatcatgcttctcttcaacttgaatcagcattgttttaggcaaatcatgtgtgggatagatgatgaaggaacaacggtgtgacagaatatatgtaaacatttcatttagttcgactttgtgtcacttctccacggcttcatgttttgccgccttatcttaggaatatatagcgcagtctgcatgaaaagagctttgtgtgagaattcctggccagttgaagggtcagggcctgtgcgttatctgactgccagcaagatcactggtgtgtcctcttatttttaacttaaaataggaaaaaaaaaagtgcatctttacatattaaaaagtaagtgtgtttgatttcaacagttcccttcttgtagtatgtggatgttattcctggcaaagaattgtttaaatttcttttaggaagcggcatgcaaacttcttttgtttctttttgtcttgtttgctcatatttcattgaaactttacacactttaaaaaaatttgaaatggtaccaagtagtttttattttggtgcaaatattttgaaagttgctaggcttatgttttctggagaacaatgtctcagagtgtaaattttgtttaactccccgtgtagtcatacttataactctactttaaatgtgcttcttattttaaaaatatcagagcctatagagactattcctagaaatgttaatagaaatgtttttctttggcaaaaattgcagattcagttttacaatttattaagtgccaagatatcattgctgttgttgactttgctaaaaaagcaattttattaacaaggtgactgcattagatgttaccaactgagacgaagtgaaacatgtgctttcaccctgttgatctgatgaaatatagaggtctgtgtggttacttcgtgcgtcacattcatttaaactttttaaagagcagctgcgtaatacaaattttgtatactcacttaaaaaataaaatttactagagtaggctcttgtttttggagacttatacattctgtttgctaaagtaaactaagaaactgaaaaaatatattggagttagaagctccaaaactcttcaaagggaagaaagcttttaagaaaaaaatgaatgtgctttcagttataaggcaattttgaagcattacttagctctcttttgcaaagatttaaggaaaaatcaactgttgtggaactaagtaataggcttgcctttatacaaaaattatgtataaaaagaataattattttccgaactgtttctatgatttgatacaagcttccttcaacaattgcaaaatgtgactgacaaatccttttctaagagaacaagttcattatgctctcgtcacctgttacattcattctcccttgcccacatacacagttcctagctgtttattagtgctgcaggaaagtgaaaatattttttttgaaagaaaatgtcaaagattttatttgcatgaatcttttgagctttaaaaaattgtggtcttatcataattgcccaaagtgttttgttaataaggtcttttgttattatcttaatatgaatagtcaggaaaggacatataaatcattttggattttctttcactatatctcaagtaaagttaaggtgtggctgagggtttttaaaaggccaagagattagacctttgaaagtttatcctttttgtataaagatgttttaaaaaatgtttaccacttacctattccctccaaatgaatgtaaagaccaaaaattaaagggaactttattattttacttggttataaagtctaaccacaaggcaggaagttactaggctttggagagacgctacaaaagaatgagcttccctctaatgaaagtacataaatcgtgaaaaactaaagacctacttcttagttctcctaacatttaatcttaaactagtaacgcctgtcttttctttgtatatttacttattgatttgctgctgagacagaggcatcttttaaaaactgaagtcaaccacataattttaataccatgattttaagaaggtgtatattttcttatgtaaagctagtcttccatagatgtttagattacgtatttgattactaggaaacagtggctatatggtcacagattaatatatgctgatctctcttatctatatataaaacatatattcacatacaaacataaacacatatcttgtgcttaggcctctaacatcttaaggcaatgtcttttcctcctagttatgcacttagttttgaagacatgtgtagatgaaataaaacgaaagagtcttctgacaagtgttctgaataaaacaagaaaaaaaaatgcttcaccaatggtgtgaagcgtaacaccaagcgcttgttacagaatatatcactagtgggtttgttgcttttcttatgtatttattaccatattgatgattacttctcctttgcctatagaccaggttggtggtgtgtgtgtgtgtgtgtgtgtgtgtgtgtgtgcacttatgagctcacatagggatgagagagtagcctggacatgtgccagggttatgacactctttgatttacttcttcagttctcttggtcactaaatttcaggctcttctgtacccttgtagcagttgacagctgatacagtgaaatcgtgccttctctttaagagtacatattatatcagctgcattctttcaaatggattgaacaatttatgttaaagatgatttattccatcaaaatatagaaaataatctataggactagatcctatcatcccagacaaattatgggtccttaaagactttcctagagagtagcagtatagttttattcttcttcttactgggtagagagcatagagtttgttcatctttctagacactttgatcttcctgaaattatttccacaattttgatcccacaaagcacaaatattgctttttttttttttttttttttttttgacagagtcttgctctgttgccaaggctggagtgcagtggcgggatctcggctcactgcaacctccccctcccgggttcaaatgattcttctgcttcagcctcctaagtagctgggactgcaggcacccaccaccatgcccggctaatttttttttattattatttttagtagagacggggtttcaccatgttagccaggatggtcttgatctcatgaccttgtgatccgcctaccttggcctctcaaagtgctgggattacaggcatgagccacagtgcctggcactgcttcttttaacattagctctaatctctttttctggaactccataatagatatatgttaaagtttcataatatacatatttcttaaattctctttcacactattttatatatctatctgtgctgcacttttggtgaattactgagacatcttcccatttactaattctttttttgactatgtccactccagaatttatttttttgacaatgtttttcttttctggaaattttaattgattctcatcgccacttcaaatgttttatttctacttactttgttacacattgtattgatgttatttcttgtctcttccaaaatcctagcatgcttattttgaagttattctgaaaccgctctattattttcatgtcttctggaataacttcactgaatgttgtttttaaaattttgctggtgcctttttatatcattctctcatggcttagaattttggttttcaggcttaactggaatgagaaggatttaaaaattctctctctctctctcattgctagcccttctgcaccattcctattgtcttagtgttggctctgtaccctctcgtttcccagtctataatctctgctaatggggatatcaaaaacctagtcactaaatcaaagagcagtctgtcccaggatgtgactgtgagattatggctgcttgctttggcctccccaagaaagcagctctatgcaagccgtggctccaggaaaagggaggtgttagtcagttgttcggcttcctcttgtcttaccttcaggttttaatcagtaagcttggcactgattattactccctgtgggacacatgtggcatccagttactttgcagatacaaggattggcttgcttctcattctagacaccatctggtgcagtgtacctcactttgtgtttatagtttatttctggtatgtttatcttgtttttgactattacttttcttttatatcacctcttttaaaacttatctattattgttacatgttggaagcaaaggcacggggctcaaaccatattattgcaatgccatcttgacaagagttttcaaagccgtgggctttggaatcagaaaacttggtttcaaattctgactcacttatgatctatgtgttaccataagcaaagtctttaatctattataaacctccttttcccttgcaaatattgatagtaatgcctacttcgtatgactgttgtaagcattgaatgtgaaaagatgtggaaagtagttaggcctgtgcttaaacattctgtgcgtgcaaattctggaggtggagaaaaagcaattaaaaccaaaacaaaactagatgttactgattatgtaattaacaaatggtaattggagtatcaaatagacttgcttcttgtattctgagtgaaagtaacactatcatttttgatatctaaagcacatttctaaagatgactgctgactgcatgagtttccacaggtggatcaaagctctgttacactatccacctacaccattcacctaattcagagaatcttaataaaatgaaaagcattcttcagaatgaccctttaggtatggttctctaaatccatgtcacttaagacagatggaaaagaagagagaagtggcatgagaacatgcttgtggcttgatgaatagtaatatatataccacccaggttgggtttctgtaatagtgaaaatggggaggagggtggtgatcttttgtaagtgtttcagacagtcttgttttgttgctttgtagctactttgtaatattgtctcttttaaaaacatatattttgatgacctagcattcaaatttatagcatcagcaaagggtcggtttagttgagtgggaaatgaaattctgaaaacaaaaagttttaaaaataagaaagatggggatgaagataaagaagcagtagtagcaacttggaatttgtcttagaatttgaaaatagaaacaggtttctaagaatcagtcttagtccattttctgttgctataacatgataccacaggctgggataaattataaaccatagatatttatatggctcatggttctggaggctgggaattccaagagaatggcattggtggaagcaagaatgtgagacagatgacagcagagagcccgaggggtagagtcccttttttaaaaaacttttttctattttaagttctgggatacatatgcaggaagtgtaggttttttaacataggtaaacatgtaacatggtggtttgctgcacctgtcgacccataacctaggtattaagcctaacattcattagctattttgcctaatgctctctctccccacaccccatcccccagcaggccctggtgtgtgttgttcccttccctgtgtccatgtattctcattgttcagctcccatttgtaagtgagaacatgtggtgtttggttctctgttcctgccttagtttgctgaggataatggcttccagtctctgcaaaggacatgatctcattcctttttatggctgcatagtattccatggtgtatatgtaccacattttctttatccagtctatcattgatgggcatttgggttgattccatgtctttgctattgtgaatagtgctgcagtgtacatatgcatgcatgtgtctttgcaatagaatgatttatattcctttgggtatatacccagtactgggattgctgggtcaggtggtatttctggttctagatctttgaggattcaccacactgtcttccacagagcttgaactaatttacattccaaccaacaaagaatatttaaagaataagcagaagatgctcctacaaatggaaatgaaaggaagaagctaacctggtggaaggaaagccagtggtttggccatactgcccgaagtatggccttactgcccaaggattcccttttacaacaacccgttcttacaataactaacccagcccagcaataacaatccatttatggaggactccaccctcatgacccaatcacttcttactaagccccacctcttaatactgtttcaatggcaatttagtttccaatgtataaactttgggggacatatttaaaccataacagaagctattgtcaatatgtcctcaggtaggacatttatgaaataagcattttatttttctttcttaccactgggtttccttccaccagattagcttatttctttcatttccatttgaaggcacatcttctgctcattctttaaatattcatgaacttcactgctttttcctgggttgccctctcttacttttctttctcctttgttcatctcatccatctccgtaacttcagataccattataagcccatctctagcctgtttcttgctctcaaactttaagccagtatattcagttagccacaggcacttcatcctcaagacgtctgaattcaaataatcatctttttgccagaatcttttaccatgtcaatccatcatccacctggttgcacaaaacagaaacaagatacgaactttgtcttctctctttctgtctctacaacatttaaggcttttgaaatattgatttctaaccatttctatttttaatcatttttttaaatcacagctacacatttcttactatatgattaatggtggaccacttcagagttgtatcacttgaggacaaggaagctggggtgtgtatctgaaactcctttctgtcattggttgaaggttactcctgtgaccatgaattctagaatcccagcccatctcaaggcaaccctagcatgttcttggctagagaacaccctcaggcagagagtggcaggtgcttgcagtaaaacatcctcaatgtgtaaggaaaatataagtgccaaggttatatgagaacaccgaaaacatctgcattgcacatttcagaggcatttaagttgtttctatgtgtttgctatttcaaacagcattgcaaagaacacaattatatatgcacccttgtgaacatgtatcaaatttttcttaggataatacccaaagtggaatttatatgttgtgagatatatgtggtctcaattttaccacttttccaatcactctctaaaatactgaaatttctctccaagggtagtggacaaatttctatttccatcagcagttgctagcattcccatttgcctcagtcctttccaattctttttttttttttttttttgagacggaattttgctcttgttgcccaggctggagtgcaatggcatgatctcagctcactgcaacctccacttcccaggttcaagcaattctcctgcctcagcctcccaagtagctgggattacaggcatgcgccaccatgccgggctaatttttttttgtagttttagtagagacggggtttctccatgttggtcaggctggtcttgaactcctgacctcagatgatccgcccacctcggcctcccaaagtgctgggattacaggcgtgagctaccacgcccggcctccaattcttaatattgtccaatgttttaacttttatttgttgggtaaatgatattttaaggcttttaaaattttcatatttttgattctaaatgaaaacagaaagatatctagtaaatctctgaaatgaagtgagcgatggagaccttatatacaaaatgcaatacattcatcatttttattataaatgtatctttatttattcaagtgttctcttcagtgaagtgcttccttataactttgacaatctttattaaattgtttatctttttttattgactttttggcatttgctatatacattctgagtgctgatactttgtcttatatgtttcaaataatgtctccaaggctatcccttgattttaaacttttgttatgtttttcttataaagaaggtgttagaaattttaattatttttaagataaacatattcatgttgaaatcacaaaagtagacaatatatagagtgaaaagtctccccaccatccttgtttctcatccactccgctcccactggccccttgtggggttcttgactataaaccaaataaaagcatacaatttacacctccttcaattacatacagtgttttaaaccctgcttttgtcatgcaatgtactgtggagatatttcaagatatgtaaggaactgtgcttcattctatgagggatgaaaatatgaacacaatacacagcctatccactgaaagattagtctgtcataccatgttgagagagtcataaaacactgggaattccaaggggagatatttctttccaactgaaagaatattcttcagaacagttgagaatcatgcatcaaggagatacagtttacttcaacaccagaattttttttaatccaacatctttcctttatttttttctcttgagacagtgtctctctctgtcacccaaactggagtgcaatggcacaatctcagctcactgcaacctccgcctcccaggttcaagcaattctcctgcctcaacctcctgagtagctgggattacaggcacgcaccaccatgcctggctaattttttttgtatttttagtagagacagggtttcaccatgttagtcaggctggtcttgaactcctgacctcaggtgatctgcccgtctctgcctcctacaatgctgggattacaggcatgagccaccgtgtctggtctccagcatcttaaacattaagctttctatagctgagaaaagtgtagcaaatttataactgaagaaaatatatattaagaacctagtacatatcaaacactgtgagaggtatgagggatgtaaaagtgaacaaggcagatagtccttgattttgtgggaggtaaaggctgagagttgaactgcaatgaagatatggtggataaagtgtgttaataaaaaggtattgggggtgtagcatgtggacagggtgcatgggtttcagatggagtcttgttgaaagagtagagagatatgtaagtgagagtaagcaatgttccaggcagaggaaagagatatgaaatattataaaattgagagtctggtgagcttgagaaactgcaaaaagtttaaattgtatggagcaccgagtgctgggagtggcaaagggctgagaaggaggtttggagataaatactggctccctcctgaaaggtctagtttggattatcctaagggcactagagacaaatctaaagggtttaataaggttggcaaatggttgtatattttctttatttagataggaaaatatcctggaacatgagtggtagttaaaccaagataatatgtgccatttctcaagaattttttttaatgctgttactgtagttacttagaggattcgaagataggcttcagagttattaaaaactaccagcgtttatatgctgtataagcactagtataaagaagaatatatgtacatatcctttattaaattctcaaacatttcattgattgaaacattgaaaaatcactagattaaattaagaacagtggttgaccagaaaagtacccttaagaacctttaagaaaagaacctttaagaaaatctttaagttcagagaaataacagagagaatcatggaagccaagtgcatgaaagaagaaaaagattccaaaattaagtcctttacataaaacagttaaattccctcatggtacaagccagcctttctgtgctaatggggccgttctgctcctcaaggtaattcaggagcccaggtttctttcaccttgttgctctctcatcccacaatatgttgccttttaggttgcagacatcactgagttcacatatgaagagaaaaagagccaagtttcggagaccacagcctgtctttaacttgaagacagcctagaaattaaacacagtatttctattctactcatctaattgtagttacacagtcacaactgcatatgagaaaagttgggaaatgtggtttctagctggaaagtcatgtctttaagaagagggacaatgaattttaggtgaataacaagcagttgtcacaccaaccttttaagtttcaaaaactattgagtgattaaataagtttacatactcattaaacaagtatttatcaagtgattgctgtatttggttgattattctatgtgatagcaatatagactttttttttttaagaaaatcattaccaagtggtacatattttagaaaggagagataggtgttaaccaaattaccaaataaatatgtggataaattaagaagtaataagtattaagaaaaaaataaatttaaagaatagaggggctgttttcagatagaatagttagagaagggctttaggttaaaaattgcaaaacgttctttaaaggatacaaaattgagatctccctccttggtcgagattttgcagttgagttgcaagcttagaacagtagttgaaatagggcagggagcgtagctcattggaaggagattcagagttaaagtccaaggagtgttatctttttaatgagtttgggggccgtgattacagcttaatgaacaaatgcatgcagaaatgagattgttgagatacttgtgctgacaggaaggagggaatgatgggtaaataagaagttagcaaagctactgagagtgagggttgtgtggactgattccagttcttgatgtagtcacataaaggcacggagttgttatggaaaccctccaggaagttgagaagtccgagtctagtaggggaggtgtgtcatgagactgaacctgtgctagggcttctctagctgtgtgcactggaagggtacctatactaggtaaagaggaggtggcaatgagagaggtttaagtgaggaatgtaatgtctattctacatagcaaaagaaatagtctttcagaagagaactgactgggaggcgggcatgtggctcatgactgtaatcccagcattttgagaagccgaggtgggtggatcacttgagctcaagagtttgagaccagcctggcaaacatggtgaaaccccatctctactaaaaatacaaaaattagctgggcctggtggcgcatgcctgtaatcccagctactggggaggttgaggcaggaaaatcacttgaaccccgaagccggaggttgcagtgagtggaggtggtgctgttgcagtgagctgagaatgtgccactgtactccagcctgggcaacagagaaagactctgtctcagaaaaaaaaaaaaaaaatgtggcagaagagaactgactggaaccacatgctccagttctagatgatgcctgaatttgtaaagagactaaaaatgtgttccagattatatttttcgtgacaggtttttttctttttaatttaatatttaaaattctaaacttttaatttagttgactctcttgattttgttgtgtggggattgttgtgtagagctgtaaattcatggtcacagttataaagttaggtagataagtcataaaaaatattaagaaattaaaaccctcagtgaatctctattatattctgcatttttttttgttaacatcagccggttcctagtggatttattgattttatttcatgtaataactagggaaacatgtattcctgaaaaaaattaaataatgtttaaaagctatttattgatatagttcatttagcatcatatgcatgatcttttatagtccattcctccgtagatactacatcatagagcaaccagccttcttggctagtatatttttcttgataacttggtttcaatttttttttcgtcctttatgtgtggatatttgcatattcctatttctacttccatctttgtattagaaatgacttcagatataaagaaactatggccagagctataaggatttttgccttttgaaggtaataccttgatatcatgacattttctatgattttaagctttttagtttttatcattttatataaagtattaatcatttctgtttatttgctggttcttggattactccaaaaatatctaatatagaccttttgaggcattgctattgttgtttacttgtttctaagcaagcccattttctctagtatttattttttattagttatttgttaaataactaataaaactgttatttattatttattagtttgtctttcctccaaggacatgaacatgtctttaatattttctcctgttcttttttcagttgcattaacttgtcttatttgacttctcttacctttctttctgcaaagtgtagctgatttctgcattcacgtctcataatttgttactttggagtgaaagtcctgtttgccttcagctcttagcaaaatctgtctttcattaccctatttgtattgccacttcttggtgctttaaaattcttctacactgttccccattgctgacacagttcctctcctcagcagaaattttactccactctctgtaaaatatctgtctcaacaaagaagaggtaaacgttttaaatcttgaagctcaatatggtattctttgacatcagtctcttctatgttaagttttgatatcttatagcaacatttaaatgactttcttattgttctcatcttctcaatcaatattttcttgtcagtcagatttaaattagcaagattagatttcatatattcttgaaggcaggatatcacaaaacaatttagcaagctgtttgcaatcaatattatttatatattcacacactagagattacatagggacaaatataacaggaatatggcccaaatcatctagatttagagccctttaatcaacatttagaattatttacttctgtgggtagaagaaattatcgatatttactaaatgttattaactttttaatcactgttacgcctttagcaaataaatttatttatgtattgggtgattagaaatgactagctacaaacagatatgtagaaaagggacattaatactatacacatacacacacacacacacacacatgcaaagactaatagtgacagatacatgtacatagagagatatacacatatcatactttatggaatgctatattccatatttcatctgcataagtcactgatatactttaagttaaatcatgacaaaatgaattgtatggtttgaaagttccagaatgcaccattaaaaaggaggaatcagagtgtgtattcattggaattcttattttaaagattaattattaatgaatcaagtaatttcaaagtaatattaatcctttttaggaaaatttgagtgggctgactttctttaatatctttgaagccagggaattcagttttttaacatagggaaaattttgtattcatcatcaattttggagcttccaatctttccctggtacttgctagttataggggctcacagataactaagatggttgtatctttttagtccatttcattttgaagaatgtgtgactattgcttttcatgacactgtgtctcatttatttttaattttttcaaataatgacaatctagatgaactttttgggattagtgggtgtttaaatttgttttaagaggggcaatgctacatgttgcctatcagcaatccagaattttttacatgtctaatcactttacagccactatggaaggtgctttgggatctagagccaactatctgagctataattcctattcacacattgctgagttgcagtagggagggttaactaagagagcttccttaatgctttatagaaaaaagcagaatataaataggtttattcagaggataaaagattaccaaatgaatgttagagatgtaggaagcaaggcaagaacattctggattgactgataataaacaatgtatgtgagagcaaataatgtaagagcaaaacatttgtttgactttgagtgatggcaaagattggaatatatggctaggagtttaaaagtttagtcaaatggatttagtggtcagtgagaaggtctgaagaaccaattccatacagaggtagcaaatcccagaagagtaacagtgtccaaatggagaaattgttaaatctaagcagcagcaaaaggctgggttcagcattggaggaaagacgagatggccatgccagccaaggtaaagtcgttccagccaagttatcccagactaaaaccaggagaaaacagaagtaagatttagttctaagggacaggattgtagggaacagttatgacccctgttatatataaagtatggactggggaccttctagttcacagacatttttgccaaattggtaaaagttctcttataaaatctttaactctaggaaaatataattctcaaacacatgagggtaaattcttctgttctataagatgatggacatagaaattatgggaagccaaggccaggtatggtggctcatgcctgtaatcccagcactttgggaggccgagataggcagatcacttgaggtcagagctcgagatcagcctgggcaacatggtgaaaccccgtctctactaaaaatacaaaaatcagccacgcaagttggcgaatgcctgtaatcccagctcttgggaggctgaggcaggagaataacttgaacccaggaggcggaggttgcagtgagccgagatcgcgccactgcactccagcctgggcgacagactaagactctgtctcaaaaaatgaaataaaataaaataaaataaattctgggaacccaaaagagatgggtagaataggaagattcaccttttaaaagtgcattctgagggaaaggaacgtgataacttgacagagatgtttgactgctcctccttctgaatcccctgctaaaaacttcagctgacagtttcagtctcacccagttcaagggcaaaggctactgggccagtggctcatcgacttattgtttccaggggagacgtaagacagtctggaggatgaggagttagtctggaaaagtgaagagggcctgctatagatacagaaactgatgggtagcatccatagttggagcacaggtgcagagggtgtgttcctctgacacagggcaacttgtggtggagtttgacttagaagtgagattgtttgggggatgaaaagggaaagatagatatgaaaagaaaatttccaaatagcaaatatattggtcttctgctgaaaatggctagaacggacatataaactctgagaaacaggaaattcaggaaaggagctaatggtagagagactagaggagcttagtttgggaaataataagtttgtgaggggtgataagaaagccgagaggcaagtccttttggcagttgcaagcaatgaaggagagaagtcaaacctggagatgcgtattttaagagcctatctcaaatgtgcagatcatactggttttcatatatgattttaaaaaaagttaagaaaacatacgttctttaaaatgcaataaggttgtataatattctctctggaccagtaattcacacagccatcacaacacaagtaaaacatgctaatatcttctggtaaactacctttcacaattcaattagataggtattgtaccagctccatttcttaatgtgttcgtttatctcaaatgcaacagtgtggtaggattgtatgtgcctggagaccctgagcatagaaacaggggagaagagaaatgcattaataagtacaaggcttaaactaaatataaagaatttcaatatcacgaacatataatagctttaatcatgcttgttctcaaacattatttatggcagtggtttatgtgattttacttaattaaaaattaggtaaactgatttttaaaaatgtatatataaagaaagcaagctattatttctttgaaaactgagcttttgctttggcaagtcttgataaaagtaagtctctaagaagtatttccattgcataaagtatggacaatacaaatgtaaaagactacacaaattataaaaattcagatgtctgtactgaaatttttttctctagtgactaaattctccattcatttaaaaatatattaaattcaaaattattgatggggcagtttatacacaaaaagcaatagcaataaaattatgcttgatgggcacacaggtaaagaaaactttaactatataaatatacacatatatacatatgtctacattaataacattatttattatagtctccattgtaataattggctgaccaatcagcagacttgctgtgttataaggatatatcagctgatgtaatagataaaaccccagcttcttagaggttcagagcttgttcagattacaatccacgcagtatgccttggacagttttttactccctgattcaaagactgaagttctttccatcttgtagctccaccaatagcaacttccacagttgctattgaagtattagttcacacatggggaaattttatggtctggacctggagcagacccatatatactccactcttcagtgcccagccacatggccataccttgctcaggtgaatctgggcaatgtcatctctctgtgtccctcatgagagccagataacacacgtaggataactttggttgtatgtacaaactctgagccaggcactgtggagagcacttctacaaccagtatacattttctaccctctagattcttagtagttacggaacagaactttccgtaagtcagtgttaatgcaaggctggatttattagcttatacagtagagggataaagactttctcataaggagaaactttttgcaaggggcagtattggaacagagcttgaagcataggcagggactcgtcatcagcagagatagaggctacagcatgaaaagtgacatgacaacaggaaactataaaatggccagagatgagattctatgataggggcagagataaagatatctgaaagatatttgtggactatcacatgacaggccttaagcaccctatttatagttcaggagtcacttcaaaatcttcagcaaatgcttgagaaagaaagcagtgttcagaacaagtagaatggaaagaaattaggaatgggagtagtgcagagcagcttgaactaatgcactgggaatggaaatgagagaacaggcaaaacatttgagaaagtcgatttgaaaaggcagattgtttatgttggtgagtaatccagagattttgtatttcactgacagagtgttctcaatcgttaatccttgggaattatttgatgagttccaaagggcactaacagctaacagtcgatctcattaactaaggatctgttaaaacctgccaaggcaagaattttttctgggtttgacaatgacgtctctgaaagccttgaacttgaagagaagcacagtaaaaatatcttctgttatagccacaagttaccacattttgcaaaacaaaactgaataataaattatataggatagaccatgcccccacctttttaaaaactcattaaaaagtcttttttatctttgtttttccttaaccaaaattatatggctctaatcttctttctacattctcttctagagttatggtcagggtatagatattttttgaaatgatactgaaaggtaacatttcagagagtttgaaggcattatgagtcttgattctgctagacttcagtgaaggaaaaggtaatattggagttcttcttcaatggcacctgtaagtctcatctgcataatcaagaatactgtattcacaccataaagggcactcttgaaatagggttttgagggccattcttttctcatttttatgatgcaggggaagtatttaaacgtttgaggagtaaaatagcctcttctattcccattagacgtagctgcaatttaccacaatgtaaaacatcaaatagtgttgatgtagaatatgtgaagtctcattttcaggtatttgacttaagaatatttttcactggcaactgagactgttagtcctccaagaagatagcctaagtcttgccaagttcaaaatgaaagatcctcctcaactccgtcagagaaggggtaacaaagtttagatgacagccatagagtcataattaacatgtaacttttagattgataatttaaattattccaactttcagaaaaattgtcttactaccctcaaacatattatgtgctatgtataattgttaagcttagaatggcaattggaaatatagtgtggtagcagaattcaagtggaagtgcattaattgtaataaaaaattgtatctaatcatgtggtttcctgttataatgggtagtagtatttatgtgctctttaaacactttgatctaaggtgtaggtttcctttcaataatggatacattccaaaaatatttaaaagggaagaaaaagacatattaaacgtgtttgaaatttacttttattatttcctactcgttgatggtattgagagagtgaagaaaattttgattaagcaagaggaaaaaggactaagttaccagaaaatatgggttttagcttagtttccctccttattggccatgaaacttgtctgagtttttagtttttatccacataaccattctatccacttcacagagttattttgagggccaaattattacatgttttacatacacaaacagtgtataaaatcatttcccttctgaggtcactctagtatttttataacatcatggcttaactccactgacataaatcccatggcctattgttgcgactttctgatcactcatgagtctgtagaggagtcttggtcctcagcctaccgatgagtctgtagaggtgtcttggtcctcagcctaccagtctcggcttttaacacctgggagaatgatacaattccagcaattcagtaaggtaaaatattagggcaatgactgagataaaaaaaaaaagaaagaatataagttttaccctataattggttgctgccaaaggattatttttctacattgcaattcttattacatcacaccactctacttaaaattatctgttaatgttttttcaagtctcttggtttttgattttggcatttcttcaaatctatctcatgtactagaatctgtgatttgagaatttaggctgaaaatgtgtaagaatcaggtgctcttgttaaattttgttgagttggaataaaaccacaacagaatacttttgagtttttaaaaaataaactcccactgatttttaaatagtatgcacttggagggaaaatttttattttgttttgctatgcctcatcaccatttcttttgctctgcaggacagtactacagaaggactaagtatataggaaacttgacttatttaaataaggcagtgaaaaaaatagaatatggggagtaaaacaacctctgaagctaagtctgcatatataataactgggtaagtctttcagtgagtttattgattagtaacaggggtttgatacgtaaaacagagcaaattgcatataggtatgatttgaatgggctaacatacttacaattaatataaaatatttccagattaagaattataagcacacattaaaataagaataaagaaactttttcaggtgtcttgaagaccctgaaggatttagtgagtcatcagtgagacatattaataaggatgagtatatgtatgagtacctgttgggtttgttttcctatcgttttttcactctaagtagtagcatgtattttcttttttctttttgaaatggaggtttgctcttgttgcccaggctggagtgcaatggcatgatctcagctcaccgcaacctccgcctcccacgttcaagtgactctcttacctcagcttcccaagtagctgggattacggccatgcggcattacgccgagctgattttgtattttttttagtagagacaggttttctccatgttggccaggctggtctcaaacttccgacctcaggtgatccacctgcctcggtctcccaaagtgctggaattacaggctgagccaccgcacctggcaggtaggatgtattctctagttcttttacaaaaggaggattttcatttacctgcactttttgttccccaaagagggagtcctggagtctcttggtgtgtatagaaaggcttaaatattttagccagtcctttgtaactttttccttgcttgtcaaaagcaataatattgccatcattgagaaatggtttcaatgatggcgacacttcacagataagaacaagcttattaatcttgggaaactcacaaatgattattgagtctcctagattgctaaaaacaaagaagaattaattttttgtcctgaagatttaaggtaattgtccacagcttaataatcatcaggaagaggataaactcaatcacaggaaatacaacgtagtagtgaaatttgttcaattacagaggaaagttccatcggaaatggtggaaatcctggcacttggaataagcaaaaccaaacaggacaaagtactaaactacaattagtaaggttctaatacagctctaaaaaggaatgcttcctatattgatgataattagttgatgatagattactgagctgaaaacttgacatttgattgctacttttaagtgttaggcaaattaagaggtatggaaaattggacatatcatagtgtaaatgaatttattttctccatggcaggatttggttgcttgtgaacatatagcagattctctaatactcataaggctccctctttcctttaatacgaaggatgtaggagaagttcagcaagcacttatttgttaggttgaattctaaatatggacacagtgcagtcttaaattatgttagaaaaaggacatttggcttagtgagacacattaatcatagtgcagtcttaaatagatctgaggacttacaacagtgcatagatatgtctttaaatcagcagaaattcagaagaacatggcaggttagaaatgataggatgataacttggatttgattatggcaagattaactaagcagctgttgagattggataatgatatgtgaggttctcatcaccctgtaacttgtttccactaatacagattaagaatgtctggaggaactataattatctctgtggctcgtgcataacataattatgttttgccagtgcaaagcattttattaagtggaaaatgatttttaaaaagttatacaagtggctacaagaacaaatcaactaagaacagaaacattggcacttcataatagtaatgtgaaaaatacttatctctttttgttatatggagttttcagaatttaaagccttgtttatatgacagatacatgagggattatttcagtgatgttgaccctcttactgaagtttgtgccccaggtgtccagaccacaaaatagaaaatgcaatctttgtctgccttacataaatacagtactgagatcagcttgtcttttaaatgtctgattgctatttaattacaaaaaatttgtctttaaacagagcacccaaaacaacaaaaaaacagtaaagaactcatttcggagccttgtaatccaccctaccacataaaaagagggtgatatgtctgacaactctctgtataatcaggtttattaagtgatagtcattatgcattttataaacactaccctaaaatatgtaatgtgaatgtatctgttaatcagaaaaagctaactaaaactgaatgcaatgtactcatttccattctggtggcattcttacataatgattttaaagcaactgtgatgagatagaaagagtgttaaagctgtagtgaacaaatgggaattcaaattccagctctgaagtgttccggctggctgagtttcttatactttctgagcctccgtttatccagtagtaaaatgcagctatgaatttctaccccagtgggctgctgagagaattaaatgagataatttatgtgaacaatcttcttagaatatgtttatttaatctgaccttgaaaaataattcacaaaaaatgtgtcagagtaagttttctctcgtctcaaaggagagaatatgaagtagattaagtgacatttttgaaaaaagttccacatttgaaacttttatttataaaattgtgaatttatctttagttatagaataactttcctcttcctttgatctttttaagcgtaatatttagccctctctttattactctgagagaagatgaatattttaaaactatttatatcacatgtctaaaagtatttctcatttttttcttaagctcttttttgaatatttataatttctttcccttttattctcatatttcacacctagtatttctgctttcatttcattaatctttttttaataacttggcacctgggcctgttttgcagctatgtgcagcaatcttaagtactatgtatagtttagttttcaatcagttccttgctgttactttctgcaaataaaaactagcttagctatgcatgtgattaacatggcccaggtattcctattactaggtctttctattactaggtctttctttccttctgtgttatttaatataaggcaaaataggaccctgccgcttaccaagctttcaggatcctccatcttccatcttccactaatcccttcctatgtctctatgaaaaatatatctctaagatggtggttgacaagagtgtgagagtcaaatggtaaggaatattgcttggaaataaggctgaattaataattccagagaaacattgtgaaataacttataggtacataaattcactatatttagatctgcctcatacttttaaaccagcagcatgataattcatagcatggacttatcatcataccatatattgaaacattcctctattgttggatggttatttcatttcctctgcttcattgttttgaacatccctataataatcaccactgtatatgccattttttgcagaagtggaattcctagttaaaagttgaatttcaaaattgttcttgacagtttatacttctagcaacaaagtctctaagtcttactattaagagaaaatgcaagacttagaacaatacattttataaatgacatgtgtattaaaaaagatctattatgtgaatgtatcatataacttgaatgatatacactaaacacttaacctctggggaggaaaataaaattaagaaaaggtggggaaggaaaatttacttcaaatacatttgtattgttcagattttttacaggaaagatgagtttatatactgctatgtgtgtatatatatatataacatatatatatctatatatatatatagatatatatagataaattttttttttttttttttttttttttttttttttttttttttttttttttttggagacggagtctcactctgtcgcccagactggagtgcagtggcgcaatctcggctcactgcaagctcctcctctcaggttcatgccattctcctgcctcagcctcccgagtagccgggactacaggcgcccgccaccacgcctggctaatttttttttgtatttttagtagagatggggtttcactgtgttagccagggtggtctcgatctccagacctcatgatccacccgccttggcctcccaaagtgctgggattacagatgtgagccaccgtgcccagcctactgctatgtatttttaaaataaaattaaaatagagacacaaaggtattactatagtggtatcaaagtaaacagtgtgaaagcatccaacctgaatttcatagctgcagtgtgatggcatttttattcagctatttctaggcatattttaaggtctgagactcaccatatgcactatcatgtaaatttatttttataggtaaaaactgtaaagtaataaaacagtctcagtttccagagcaaatcatatccatctgtactgctgggtaaatgtagttctgattcaaccacatgaataagattacacgtgtttttgaaaatcactatttgctgaagatcataagcaattcacatgctttgtctatggttaattttggtaataagatgcaagacagctcacagatctttaagctatatctagaaatagtgctgattgaatttaagctgattatgcagcttattttggtcgtttgccctcttcctaaattctaaagttcaaagtttaacgtgaaatagttttctcaagtttagctctagccaaagtccatgaaatggcttatgtctgtcaatagttgacctaatagatttgtcctatgttgacactttgttcttttcatactagactgtgcgtatcatgtaggtatgttattttcagtgtgctgtgctttaaaatgggattagaaagtcatggagaattttttgaaaatgttttgatgtgttagtgttttttggtagggttttgggatacatcatttatttattaattaattcattattctgtatttattctagaatgtcatcagtaatgtattgaactaccaatcatgttagtggagataacaaggcaagaccagtatagtgacattagaggcataaaatcaatgggttctataaaatatttgagttgctttataagaactgtgtatcaacaggagtaaagtcatcaagaagaacctcttctaccagtgccatcaagaaagggttcatttatatggggaagctccaacagaatctggatagacagaaataggattctttttcacaggcagggatggagatatgttttagacatggaacatttgagaggataaaagaagcatgaaaccacatgtctggtacctgtgactactaaggcatgtaaataaggcatgctgagagatgagaatgaaggtaaggtggtaaagcaggggtaagattttggaaaccattaaaaaccatgccaaagttcatgaacattttcctttaggcagtgaagatcttttaaggggttttcagcaggagagcaacagagctgtacattttagaaagagccctctggcagaaatgcaggggatgaatggggaatgcacaataagaggcgttaaatgattccttctggtaatattgggacataaaataaagcctgaatggtggggatagagaggaaaggatttgatgcagtatatgttaaggaagtagtagggtgtgtgtgtgtgtgtgtgtgtgtgtgtgtgttttctttctttctttctttttttttttttttttgacagtttcactgtgttacccaagctggagtgcaatggcacaatctcagctcactacaagctccacctcccaggttcaagcaattctcctgcctcagcctccagagtagctgggattacaggtacatgccaccatgcctggctaatttttgtatttttagtagagacggggtttcaccatgttggtcaggctggtctcgaactcccggcctcaggtgatccacctgcctgagccttccaatgtgtcgggattacaggcgtgagccaccacccctggccagaagtagtattaacaagtcaaagtcaatgataaaatttggatgatgtggaagaggcagtagattcccaagcatctgtcttgggttaatgggtagatggtgatgctgttcaccaataggaataggaaaagaggtttgggaggcaagagtgagaagtggttagtgttcagtgtttagctatgttttgtttggagtgtttatgtggcagccaggtggagattccaagtatgcagttcaatatgtgggcccaaaggttagaacacagggacgaattagagatgtagatttgttggtcattgacgtttcataaatgtagtgttaatatcgcacaaagcaaaatgtttagaggaggaagaataacattaggaatagcaacctgccatatatatatatatatatatatatatatatatatatatgacttaccaacataatccatagggtgtcacaattaggagtttattagggacgtttgtgagaccagtctcagtaacatagtggaagtataagtggagcacccactcagtgcatagtagaataaaatacaaatgaaagagttaaaatgaacaggttcatgttcttttttgaggagcttagctatgtaggggaggggaggacattaactggaggaattcacagggtagagggatgcattaattaattagacaagagacacaaaggcattactaatagtctatgggaaaataactggtggagtgagagactgaaaatgtagaagagataggaattactcacaaggcacagatacagcaactctcaacacaatgcagcagaaaaagggcaaactggctattcttattattgagaaaattgtggatgataaaatagaaattatggtatatgaaaggacagcctattaaccacttatatagcaatgttttaaacctgcataggtaaaacggccgaaatggtagtctttcttccaaatctctttccctccaccatatgctagacacacccttttaataaacagcaccacagtctaccttgttgcttcagctgaagacctgagttgtccttgattctcttttccacagtttattctccagacatctcaacttcctatgttcctgtcaatttctactactgcattctaattgaaagtatagttacgttatccccagactacaagagtagcctaacttttctctctgcttatctagagccactccagccccactcttccatctgttctccacttaccagccacaataatatcataaaaaagtaaaccaagtcatgtcactctctggttcaaactcttcaataatgcatagtgggcatgtggtaaattatgactattataatcataattagaattttcctttctctttctctttctcttttggttttctctttaccttcatttaactctataatagcaaagacatttaaaaattggccaatctattctaaacatatgattactggtagatttatagaaaacatattcagcactaatgtgacttatttctgtcataaacatttgactccttgctgttgccttatttgaaaatgacaaatgacaaataagtaaaacggtgtttctgttacttgtgttttatttgacccctcaattcccagtaataagtaagataatactttaaacaatctttgacatttttttctaattagatgacaagcaatctcaatgcatgcaccacgtgtttcaaggatataaattagagtgaatactttaaaaaaatagaataaaagcgggacacactgatatttgacatttttgaaaatctcgaatctcacatccctgatttttataatgacagtgattaggaaaaaaaagcttaatgtaagacaataagctctgagatttttcttagaaatgtactaaatttgattctaggaggagaaggcacttgagaagagcctgttgaagtctcatctgctggagaaaatttactccaagaaaataggatgaaagtgtcaaagacaatagttacaagccttggtggtgcaattgattatgatcttgtaatggtataattctgaaacgatgacacagatagtgtctttatatgatggagctggtccctagaagcagaaggcacagttttcaagttcagaaatttctaattaatatcatgtatatggtgaattacatatatatgtaataatatgtaatataaggttctgtaatatatgtaaggagttttattttatgatatataccataaaatgttccttatgtcctaagtgtatgacaaagaataaaacacttcatatcatagctatgacgttgtggaaaagacacagaactagtagtaaaggagcatgaaccagattccattctatcaatcaccgactatgtgcctgggtttgtctcctctttaaaacatagagaatgcttctcctcaggcgttctctgatgggtccattctatgagctgattctttttggtgaaatcagtcactaattcagtatcctgaatgccatattaaggaggtttagagaaaatctgaaaggtaactatgctaaaacagaggcatttctaagtgaatcaagttggtagtcacattcagaggctttggactcggtcacaaggaagcctaaccaataatcacttcacactgagtaaccattctacatatctttctgttgttataattttaggaacaactgtaattttaggcaaaacttggcaacttggccttatgtttagtaaattattttgggctctttgttttccagatttcaactgatgtttttatagtgacaaaaccatcccaatttgcctcatgtgaaagtcattctaaaataattgatatccaaagtcattaagataatgcaactaaacaggaatgtagttacttatatcttattggtagggagcataaaaatgtaggcacgagaaaggtgttttagtgatctaaagatccaatctgttatttttaaacgatgccattctattttgcaaatgcctactataagcagaacagctgaactcactgccaaatatgaaagagtagttaagaaatgatttgcagaatggatctcaaggtctttattttgctcttgcgtgtggaatctatttgctcatttgcacgtgtggaaattttaatctctacagcatgtttttaagcgtcacactgagcctggaagttaacacagaatcagatcagtaagtaaataaagcatatctttgaaaacatgaaatggaaaaaaaatacttgttttttgaaagttttatctttgcacaaaatgtctatctacatgtcaaagatattcagatgttcagctaagcactttgtaggtcaaaaaatatattttttgcattctgaactcttggcatcttggttaaactttcattctatattaattatacggatggaagagtttattcaatactttaatgaaccaagattattagaattaagcttcatgaaatcaggttctttgtctatcatgttcattactgattccccagtgctcagttagatgcttggaatatattacagctttaataaatatatttcaaaataatgccatggaaagaggcataaaataaagctttgagacttagcctggccatagcactgcttctaagcttagatcttagccaagccatttctctttccttgagtttcattttcctcatcttctaaaaataaggatttttttaaattgatgagagttctctggtcttataaaagtacttgacaattattataccatgtctgaaataacgtgctaatcacaatcttaaaataaatatatttccagaggtgatataattgccaaacatacaaattagctcacctagtatatagactcaaaaagttcagaatgtagatttcctctgatcacacttgaagattatagtgcaattttctcctacagaaagtttgtgaagtaccattaaaaattatgagtgtaggttgtggggaagatagccaaataggaacacctctggtttgcagctcccagctagatcaacacagaaggcgggtgttttcttcatttccaactgacatacctggctcatctcattgggactgattagagagtgggtgcagcctatggagggcgaaacaaagcagagtggggcgttgtcttaccaaggaagcacaaaaggtcgggaactccctcccctagccaagggaagccgtgagggactgtgccgtgaggaatgatgcattctggcccacatacccacagaccaggagactccttcaggtgcctataccaccagggccttgtgcttcaaacatgaaactgggcggctggttgggcagacactgagctagctgcaggagttttttttcatgccccagtggtgtctgaaatgctagcaaagagaactgttcactcccctggaaagggggctgaagccagggaaccaagttgccttgctcagcagatcccactccacaaagcccagcaagctaagatctactggcttgaaattctcgctgccagcacagcagtctgaagtcgacctgggacactcaagcttggtggaaggaggggcatctgctcctactgaggcttgagtaggcagttttctcctcacagtgtaaacaaagccacagggaagcttgaactgggcggaacctactgcagctgggtaaagccactgtagccagactgcctctctacattcttcctctctgggcagggcatctttgaaagaaaggcagcagccacagtcaggggcttatagataaaattcccatctccctgggacagagcacctgggggaaggggcggctgtgggcgcagcttcaaaagacttaaacgttccttcctgccagctctgaagagaggagaggatctcttaacacagcactcaagctctgctaagggacagacttcctcctcaagtgggtccctgatctccatgcctcttgactgggagacacctcccaccaggggtcgacagatacctcatacaggagagctccagctggcatctggcaggtgaccctctgggacgaaacttccagaggaaggagcagacagtaatctttgctgttctgcagcctccactggtgataccaaggcaaatagggtctggggtggacctctagcaaactccagcagacctacagcagaggggcctgactgttggaaggaaaactaacatacagaaaggaatagcatcaaaatcaacaaaaaggacgtccacacccaaacaccatttaaagatcaccaacatcaaagaccaaaggtagataaatccacgaaggtgaggaaaatccagcacgaaaaggctgaaaatgctaaaaaccagaacgcctcttctcctccaaaggatcataacttctcatcagcaagggaacaaaactgcacaaaactggatgagtttgatgaattgacagaggtaggcttcagaaggtggctgataacaaactgctccgaaataaaggagcatgttctaacccaacgcaaggaagctaagaaccttgaaaaaaggttaaatgaattgctaactagaataaccagtttagagaagaacataagtgacctcatggagctgaaaaacagcacaagaacttcgtgaagcatacacaagtatcaatagctgaatcgactgagtggaaaaaagaatatcagagattgaagatcgacttaatgaaataaagcaggaagacaagattagagtaaaaagaatgaaaaggaatgaacaaagcctccaagaaatatggaactatgtgaaaagaccaaacctacgtttgattgacgtacctgaaagtgacagggagaatggaaccaagttggaaaaaactcttcagtatattatccaggagaactttccccacctagcaagacaggccaacattcaaactgaggaaatacagaaaacaccactaagatactcctcgaaaagagcaaccccaagacacataatcatccgattcacaaaggttgaaatgaaggagaaaatgttaagggcagccagagaaaaaggtcaagttacccacaaagggaagcacgtcagactaacagcgggtctctctgcagaaaccctacaagccagaagagagtgggtgccgatatctgaccttcttaaagaaaggaattttcaacccagagtttcatatccagccaaacgaagcttcataagcgaaggagaaataaaattctttaaagacaagcaaatgctgagagattttgtcatcaccaggcctgccttggaagagctcctgaaggaagcactaaatatggaaaggaaaaactggtaccagcaactgcaaaaacataccaaattgtaaagacaattgatactatgaagaaactgcatcaactaatgggcataaaaaccagccagcatcataatgacaggatcaaaatcacacataacaatattaaccttaaatgtaaatgggctaaatgccccaattaaaagacacagactggcaaattggataaaaagtaaagacccattggtgtgctgtattgaggagacacatctcacgtgcaaagacacacaggggctcaaaataaatggatggaggaatatttaccaaacaaatggaaagcaaaaaaaaaaaaaaaaaaaaagggttgcaatcctagtctctgataaaacagactttaaaccaacaaagacaaaaaaagacaaagaaggacattacataatggtaaagggatcaatgcaacaagacaagctaactatcctaaatatataagcacccaatacaggagcacccagattcataaaggaagtttttagagacccacaaggagacttttactccaacacaataatagtgggagactttaacacccactgtcaatattagacagatcaacgagacagaaaattaacaaggacattcaagccttgaactcagctctggaccaagcaaacctaatagacatttacagaagtctctactccaaatcagtagaatatacattttctcagcacattgcacttattctaaaattgaccacataattggaagtaaaacactcctcagcaaatgcaaaagaatgaaaatcaaaacaaacagtctctcagtccacaacacaatcaaattagaactcaggattaagaaactcactcaaaactgcacaactacatggaaactgagcaaccttctcaatgactactgtgtaaataatgaaattaaggcagaaatacataagctttttgaaaccaatgagaacaaagacacaatgtaccagaatctctgggacacagctaaagcagtgtttacagggaaatttatagcactaaatgcccacaggggaaagcaggaaagatctaaaatcaacaccctaacatcacaattaaaagaactagagaagcaagagcaaacaaattcaaaagctagaagaagacaagaaataactaagatcagagcagaactgaagaagatagagacacgaaaaagccttaaaaaatcaataaacacacgagctggtgttttgaaaagattaataaaatagtagacccctagccagagtaataaagaagaaaagagagaagaatcagatagacacaataaaaaatgataaaggagatatcatcattgaccccacaggaatacaaactaccatcagagaatactataaacacctttacgtaaataaactagaaaatctagaaaaaatggataaattcctggacacatacaccctctcaagactaaaccaggaagaagtcaaatcactgaatagaccaataacaagctctgaaagtgaggcagtaattaataccctaccaaccaaaagagcccaggaccagaaggattcacagccaaattctaccagaggtacaaagaggagctggttccatcccttctgaaactatttcaaacaatagaaaaagagggactcttccctaactcattttatgaggtcagcatcatcctgataacaaaacctggcagagacacaacaaaaagaaaagaaaatttcaggccaatatccctgatgaacatcgatgcaaaaatccttaataaaatactgccaaaccgaatccagcagcacatcaaaaagctcatccaccacaatcaagttggcttcatccttggcatacaaggctggttcaacatatgcaaatcaatgatgaaaaacacatgattatgtcaacagatgcagaaaaggcctttgataaaattcaacaccccttcatgctaaaaactctcaataaactaggtagtgatggaacatatctcaaaaaaataagagctatttgtgacaaacccacagctaatatactgaatgggtcaaagctggaagcattccctttgaaaactggcacaagacaaggatgccctcgtgctcaaaataatattggaagttctgggcagagcaatcaggccagagaaagaaatgaaggatattcaaataggaagagaggaagtcaaattgtccctgtttgcagatgacatgattgtatatttagaataactcatcgtctcagtacaaagtctccttaagcaaataaacaacttcagcaaagtgtcaggatacaaaatccatgtgcaaaaattacaagcattcctatacaccaataatagacaaacacagagccaaattatgcatgaactcccattcacaattgctacaaaaggaataaaatacctaggagtccaacttacaagggatgtgaaggacctcttcaaggagaactacaaaccactgttcaaggaagtaagagaggacacaaacaaatggaaaaacattccatgctcatggataggaagacccaatatcatggaaatggccatacagcccaaagtaatttatagattcgatgctattcctatcaagctaccattgactttcttcgcagaattagaaaaaaaactactttaaatttcatatggaacccaaaaggagcctgcatagcccagccaatcctaagcaaaaagaacaaagctggaggcatcaccctacctggcttcaaaatatactacaaggctacaataaccaaaacagcatggtactggtaccaaatagaccaatggaacaggacagaggcctcagaaataatgccacccatctacaaccatctgatctttgacaaacctgacaaaaacgagcagtggggaaaggattccctatttaataaatggtgttgggaaaaccagctagccctatgcagaaaactgaaactggaccccttccttacaccttgtacaaaaattaactcaagatggattaaggacttaaacataagacctaaaaccataaaaaccttagaagaaaacctaggcaataccattcaggacataggcatgggtaaagacttcatgactaaaacaccaaatgtaatagcaataaaagcctaaattgacaattgggatctcattaaactaaagagcttctgcacagcaaaagaaactatcttcagagtgaacaggcaacgtacaaaatgggagaaaatttttgcaatctatccatctgacagagggctaatatccagaatctacaaagaatttaaacaaatttgcaagaaaaaaaaacaaccccattaaaaagtgggtgaagaatatgaacagacacttctcaaaagaagacatttatgcagccaacaaacatatggaaaaaacctcatcatcactggtcattagagaaatgcaaattaaaaccacaatgagataccatctcatgccagttagaatggtgatcattgaaatgtcaggaaacagcagatgctggaaaggatgtggagaaataggaatgcttttacactgttggtgagagtgtaaattaggtcaaccattgtggaagacagtgtggcgattcctgaaggatctagaaccagaaataccatttcacccagcaatcccattactgggtatattcctgaaggattataaaacattctactataaagacacatccacaagtatgtttattgcagcactgttcacaatagcaaagtcatggaaccaacccaaatgcccatcaatgatagactggataaagtaaatgtggcgcatatacaccatggaatactatgcagccataaaaaaggatgagttcatgtcctttgcagggacatggatgaatctagaaaccatcattctcagcagactaacacaggaatagaaaaccaaacaccacatgttctcactcgtaagtgggagtggaacaatgagaacacatggacacagggaaggggacatcacacaccggggcctgttggggcgtgggggggctaggggagggatagcattaggagaaataaatgtacataggtttcacaaaccactatggcacatgtacacctgtgtaataaacctgcacgttctgcacatgtatcccagaacttaaaatataataaaaaaaattatgagcataatggtacagtctctctattttgtttaaggggagtatcaagtcagagtttagagtgaattatttcttttaactgcacagtgtgattcgtgaaggtcagagttgaggttcagtgcagtcaggctggaaaggtagctcctggcaataagaagagtgtgtgaataaataaaagacgtgagctgtttcctaagtttacttaatattcagattaaatgaaaattatgagcctgaatgtaggagtctggaatgaatatgagtcaaagatcacatggaattaatgtattataaaatgatatacaagataggtttaattaatcttcctcaatcattcttatttttcagatcttcaggaattttactgggataattatccaaataaattgcaagcattctatccaaatggtaagcagaacatcttattatgtaatcatatttgtttatccataattaatataactttctgagtattgaaatgagaaacttgatttactcttcttcactcatgttttaatttttttataagaaaaactagaatcactaaagaatttctttttattttatttaaaaattataatcctgagatgcaaatatatgccatgtaagcctgggaactatttaatcactttactctaaaatctggtaaaaggtaaaatttctgaaaataggtgactggcaaacattttgtaaacaatatataagaagaattgtatatcaaaatatacacataaaactatcttttcagataattatgtatcatttattttcttatagcgaaattataaaaatacaacctatagccttccatagatacataattaactatgttttgaaatgatatccaattcagtaccctcatacatttgaaactttgataagctggtctatcttcactttggggatcttcttcattaagagtttgttttctcaagttttgaggtaggatacatgaagtcattcttcttctttataattatgtggcaggaactatctccctgaaaactttatgcttaagtttttgacaatcacactgtcagtcagatggtgcaaagtcttttaatactttttaatataagagagttgtctaaaatacagatagttctccatctgagctcatgacccaagcaatgtgcttcaaaattgcatttattgtatttttcttattacaaatgatactatgttcataatggatagataaattagatacacataaatacaattaaaaagcatattctcaccacctaatgtaacctgttaaccttttgtataaattggtgaatggtttcagtatatgaacacacaacctactgtaaaaattcaagaaatgagtgtgatgatgatgtaaaatgcaggttcaccttctctgtccccacttcctctgcagcttgggtataaatgcctgctccaccacctgttctctgtgtgaactttggcaaatcctttacactctctgggctgtcctttctcatctgcaaaatggagctaataatacatacctagctgaaggggttgtcttgaggatgaaatatgttaatacaagttaggtgtatagaacagtgcctagctcataagtgttagatattacaaaattacctattgtatttgaattattttttagaattcttaagatgtgcctattttgtatacttatatctcatttagctctttattaatggcaattattcttcagttagttattttgtggttccagatagaatatcatattttctaaaaacaataacaattttagatacttttatttttttcctttttagcatcatacttttttctattttgagttcactacttattgccttggctatgtctttcggtgcaacatgaaataactgaataattctttgttctttctgattttattaggaattactttcatgattataatttgagtactgtgttgactatttgtataagttttattctttttcttaagaagtaattatattcttaattaactatatttgatgatcagaagttcctgttgatattctataaatctcaattaaatataaattaatgttttaaaatctgttgagaagatgacttggttctcctctctaggtcagcagatttgctaatattatgttactcttgcatagctggaagcttacttttattacataccttagctcaattcctttttgtttacttgagaattctaaagaatattccaaagtaagaatgatatatactattttttattgcttgatatctatgtggtactattaaggacgttatatccacattgaacttcacaatattttctgtggagttacatatatgtaaaaattacaaataaaataaaaaccttactggtagaatattcagaccacagaatctattttggaggtgaaatttagaaaaaatgttttattaattgttctttgaattttgtaggaattctaccttcattgagttaatttctagtctgacatttaaaaagtattgctcattttgttaagtttttcattttactgccacatatttataaactatagtcttttggtttgcaaagttattgttgaataggtttgatagactcctcatcatttctaatttttatgtgtttttcttcatttttcactgatatttgtgtcagaagtttccctgttttatagcttctctcaaaaagccaaaagtggaattatgtacttgtttgatatatttatcttcctgatttattaattctgcttaatacctagtgtgtgtgtatatatatatatatatatgtatgtatgtatatacacacacacacacacacatatatatatatttatttatttattattttttttgagacgaggtcttgctctgtcgcccagattggagtgcagtggcgcaatctcagctcactacaaccttcgcctcccaggttcaagcaattctcatggtgcctcagcttccttggtagctgagactgcagatgtgtaccaccatgcctggctaatttttgtatttttagtagagatggggtcttgccatgttggccaggctagtctcaaactcctgacctcatgtgatctgctcaggttggtggatcaaagtgctgagattacagacatgagccatcatggctgtccaaaacctagtctatttctaatgccattttttaaattctgagatttatttctatgaaaatatttctaagtgtatcaggttgtatacaccagggtttgaatatgattgattttttaaatgttttggaaatatttgaaaacagtatgtaatccttgtcatagacttatttggatatagttctatcagttcagcacaattcatcataatattcaaatttcatgttcttatattctatttgctggacagagatgaggctagtttgtgcaaattcttaaaatgcccaagtgatccatttggatttatacagtaggcataaaactattgaatataagctggtgagttatatgagtagaccctatataggaagatgaatctttgggggtatgaaagatcaactacagtggcgtacaactaaggccaaatataagatttaaggatctgtttatttcagcatttctacttttaggaatctgaccttagaaatatcttccagtctttgaaggaagggtttagtgttcttaatctttcccaagccaattcccgccatcttctacttttccttcatccagtccatttcctccatcagctttccttctcagtccttttgtgaccttctgtgacatcaacttcttaaatgtaaaatataatgactttcttgtctcatgaattttatcccccacttttatttttagaaactttgatatagcttgtaaaagccaagacaaatttctaccagaattagagatatggcattcatccagccagccatcaaacatttttgaaaaccaactatctgctaggcaccatgctaagaggtagaaaaagctgcctccctacaagagatagaacctttaacctccatacgaaagagctcttaatcttttgcttgaattctccaaagttcagcatctccaactgacattaatatatttttgattcgatgacctgaagacaaccaaaactttaatgagctcagtctttatccctaacctacctctcctactatttcctctcctggttgatggctgatattaatctgtgctagaaacttaataggctgtcaatatataatctttatttaattaatattttatgctgtatctttactctgtcctatccttaaccaaacttcataaaagtcctattgatcacatctttacatgtatcccaaacttctctttacctctgtatttattacctcagttttaggaccacaacatatgctttttgattttttataaaccactaattatttttatatccctacctcttttgtccgtcagctacactcctaccagaatttgcatattatcatgacagtcacccattgaaaagtttttatgattttcgtttgcttagaggaaaaaaccaaaatcctcaggatgcattcagttttcttcacaacccagtaccaagtttatctcttctcaatttattccctttctccatctccatcatcctcattcccctgaatttcatcacatctaattaatgtgcatcatggcttcttcatacttagaccatgttctcacacatagtgggtattcaaccaatgtttgctggtcattattttgaaaaggcaaagggctagattaagcaggagcatatgatcaatcacctgagtgggtcagactgagaagacagtttagttgtttagttgataacttattggaactcttgaagttttatattagaataccatggaaatggaattcataaatacaacttagaaatgacctagtctaagctatgtttcctgaatgttgagacctgaagtatcagggacttgttcagaatgatagttgcagctgtttaatactatgagatttactgctcccgaatctgcggcaactgaggtaaacaatggtttgagtcctgagtaggaatttaagagacatgatgaactgtaactattattgatagaagtagattattctgacttgattccaaactgattgcatacatgtaatttacctccaagggtgtataattatgattttgcctgaggtatctatatggaagtatttatgaggatgcaattttcagggttttttttaaaagcatgtaattggatatttgatttgtaacctctaaaattaaggttagaaatagagtcatgagtgcttcatggaagacttcaaatggagagagagtgaattaatttagtagctgcttcatacaacttggctcaaatagagattgtagtctttctcctagtctttatcatatgaaaagcagccaggatagattttccttgttatatttttgtatagttgaaagttttgaatcaaattttaagtctttacaattgcctttttaaaattttaactgtttgttcttcgttacttctttctaaatgtcaaggtatatttatttactcttaataatgtgatatgtagtattccacaaacattgtcagtgacaaatcttttgaactaaagaatagattgtttgaccattccagtaattaaggaaactagattaaatatacaatggttgcactggtttttcaaacattgatgaagtaaacattattctcaattgacttagtagccagacattcttctcccaagtcttgaaaaataaaatattcaactttctgttcaattgagtggggagagctataaattttgtttcatagctttgtttatattgtctgcatttctctagattttatagttttagaacattataagccttagaaattcaaatgccgttttgcatttaaacttatgaaaaataatttaggcccacactgaagatctgtgaacacttttcttccaaagaggggtcgtactgtttaagtttgagaaacactgtatgaaactagtagcttaaaatatcccttttctaaatgttaagatggttcctattgtacaagggcaagtttctgaatatatagttataaagcctattgatatattgggtagtgtttttttttgtttttttgagtgcatctaacccaatgtccacattgtataaagtgccagagagattgaatgaattatcaagttcgtggactagtcagtgactgacaggacacaactatagtgataaatatatacaaataaacatgacaaagtcattcataataactttaattataacgagagagtcgggtctaatcaaattacatacaggaagagttaaaataactatctgaatattaaaagtaagataaaattttgcttgatgtaggctttctggaatatttaaataaacaaaattctgaaataccctctaataagtatttctctatagagaggtaattatatttaacagcaaaattaacattgatctatattcactgtgatatattttaaatattgttttgaaatactattgtatttatacaatgcaaaggaaagatcgctatttttattaaaagaatgttttcaaaaaatattttaaatttttatttcaaagtgacagttattcaaatgttgaatatgataagtgttttgtcatataacaatgttgtaaaatataaatgatttttatatataaatagaaatatgtcattcatcaagttatatgtaattggccacagctaactctaagtgggaagatttttttctcatcctattacttttttcctgagtatctcaagacataatgcttgtttctgtatttagacttttttagtttcccttgtattttagttagaattatctaattgctgctctcacacaaatgatgttatgtgactagagagaggaatcacgacttacctctttatctccctgtagccccctgtttctcaactttggctgcatgttagaaacactgcagaagattaacaaataatcatgtatgggtgataaatcttgattttactgatagctttacatgtatccacaacttctcaaattatacactttaaatatgtgcagtcttaaaaaaaaaaaaggaaaacatacacttatcatatgacccactaatccccctacttgggggtgggaaggggaaaagtgggagggttcaaatactcaggtcccatttgcagatattctaatgtaattggtcttaagtgaggctcaggctctgatatttattagaaacttcccatgagatcctaatgtgaattcagcattgagagcttctagtgagtactttgcatataagttctcaaaaataattgttctcatgtttttatatatataatgtgtatatatatgtgtgtgtctatatatatatatacacatatatatgagaatatatatctatatctatatatatatatgtgtgtgtgtgtgtgtgtgtgtgtgtgtgtgtgtatatatatatacatacatttttttttagacacaggttctcactctgtcacccaggctggagtgcagtagtcagaccatggctcactccagcctcaaccttctggtcccaagccatcctcctgcctcagcttcccaagtagctgggattataggtgtgatatgatatcacatctggctaatttttattttttgtatagacagggtcttgctatatttcccaggctggtcttgaactcctgtcctcaagcaatcctcctgccttagcctcccaaagtgctggggttacaggtgtgagccaccatacctggcctgtcctcatattttaattgaatatgttttttctttaattacaagtaatgtaacttgggcaacatggcaaaaccccatctctacaaaaaatacaatataattagccaaccgtggtggtgcgctcctgtagtcccagatacttgagaggctgaggtgggaggatcacttgagcctgggatgtctaggctacagtgagccataatcatgccactgcactccagcctgggcaacagagtgagattctgtctcaagaaaaaaaaaattacaataaagccttgaatacatacattgaaaagccttgagatgtataaattatgccagaggaagtccagtaaaagaagtactcccaaatagctttttgcaaatatagacatgccacagccttataggcatacatctttactaagacacatcataaaaacacatctgtgtggtacttttggtgcattttgaataaggactgaaaaaagttcacaaagattggtcagtttgaagtatggaatttaaatcacagttgtcatcttattaatggctactatttttcttgaaatttccattttatatgatatagtagtttgcaaatcactttcatttacatagtatacggtcatttgagtcatatttatttgttttgaacatggactttgatggagacattcccagttttttttaatataaaattcatttctttaaacatcagtttataattgaaaatttcagttttattgaagtttggttccagacagttaaggtttagtagtgtttgcatttttgtctttgtaaaaatatttgcacatttaatttatgattcaatttaatttttctgttatgaacatgagtgggtagcagaaaaaaattagagtgtagacattggtagttagaattgtgggtctcaaaaatggggtataattgagttgacaatctcatactttgtatctagaagagaaactgtggcaagaaacattttatatttattttttgttctttgggtataacctttataatgttaaccttttggaatgtatatattttgtgagtcagaatactatagactatgctgtagtaataaaccatccccatatttcactgatttatctcaacaagggtttacttttcctttctttctttctttctttttctttcttttttttttttttttctgacagtcttgctctgttgcccaggctggagtgcagtggcatgatcttggcccactgcagcctgtgcctcccaggttcaagtgattctcgtgcctcagcctcctgagtagctggtattataggcgcctaccaccatgcccagccaatttttatatttttagtagaggcagggtttcaccatgttggccaggctggtttcgaattcctgacctcgagtgatctgtccacctcggcctcccaaggtgctagatttacaggcgtgagtcaccacccccagcaggtttacttttcatttatagagcaaggggtactcagcatgttatagttacttggagcccagactcagggaggcaccgtattgactcatgtgacagggaaagggacactgatgaacagcagttcactgttaacacatgtcacatgggtacttctcattcaaaaggggtgagaaagtacattcctactatgtgcctgggaggagaggagaattggagtgtttgtaaacgagtcctagagagacccacaaacgtcttctgatggatgagataccggatgacagcgtatctttttcttctcaacataagcctgtattgtaaggaaggtagaatcttatcattgcaccttctcagataggaagttgagaatcagaatgcctggacagcgtcactatacacccacagctagtgagtagagggatcaggtttattatgtctttacagcataattatgtctccatatatttcattgatatgaaacctgtactgtgttctgctactttacattctatgatccttttatataattgctactttattttataatcaaacaaagagccagtttatgataagcatagattcttaggtttaagtgtgtaaatttataactattaccatcggtttgtcttttatactttcctttaaataatattttttagtgttaaaaattattcctaccttcagtccacctttacattttcgctaaaaaatattctgttaagttgaaaaacgaagcaaatcattgccactggacaccatatttatatcactgggaatgatgttgtttctcaataggatttgattttatctgaaattccaatgtttccaccgacaatataaagaaaaaacaaaaacaagaacaatctgctaatgaacagtttctgaagggacagaagggaagttttccaaatgcaaagctcagccaaaagggagaatttattgttgttgttgtttatttgtttcctgagacagagtctcactatgttgcccaggctggacttgaactgctgggttcaaatgatcctcctgcctcagcctcccaagtagctaggattctaggcaggtgccaccagaccagctcaatggggaggtttactaatgcaattttgctacaccaaaatggtggcatctatttatttacttattttaaataggaagaagtcagaagacttaatgaatcaagcattacttataattatattttttaatacaacgctttgagcatggacttaaaaatgcagagatgaaatataagagcttcttggaagcaaacattgttggacagacttataatgtgtcaggattttcaaactcattttctataactttccaaagatgctgtcaaatgaaggatgagtcaggttttccataaaaacatcattctaattttgtaaaacggtgtggctcaaaactataaattgggctgccaaactatttctctcaaatgtttgatggtttgggaacatgtagaatccattatattttcttcattaaaggactccatataataaagtgatttattgtgacaatttaatttattgtgataatttaatgtttgtgattcaatggaaaaacatcattcttttcataaatgtgatgtaataacataatattcatcactgggtgcacaaaagaagtttatggatatatgactctgctgctaagctatcagaaggattcgtgcccctgtcactccacacacgctttagaaagataacagccatgatttttgatatgtaaagtcccaaccattgtgtgttcaggaatctgtctgcatcatgacacaacggtggaactaagccataatgaatgatttagctctgtttcctctttcttcacaatgtgcccatgattctcataccaatatgcctttcttggacttatctctgaagtctgtaggagataacttcctccccattactagccagcagggtggcctgagtttccttgtctggagctgcaggatatttgttctatcctgtttacagccaatggggggccctttttcttccctacagtgagccttttcatctgcacagagggagatacaaaatcggaaatgatcttaattaaatgttttccgtccagaaacaactagtccactaccttgatctggcggaccttcttggaggtgccccttcccacctccctctgtggtgagattgcaggtaatagaccttatgacaaaagacaaggataaatatttatcagggcaccgaagaatttttgagtatctacaattatttacattcattcctgtgaacacatttaaccatgtgaggtgttattagtactccccgctgacattttttcctttataatattttcaaataaaattgtatcccctgaacaaattacaaaagtgcctttaaatatccagaataaatattttgagaatattcattttaaggttcaagtttctaaagtaccctattcgatgctaagttattgcaatatctgtcgtttagaggaacttgtaggtttattagctctataatgtcaacattcgcagatatgaagcattttatatttcttagtgatgtataaatgtatgaggaatacatgaaaatgcaacaagattttggttggcttaataatgagtttctttcttaaagatcaagataaaaattctgaatttctattgttctgtttttaaaattataaacttaaatgtatctagctccaatgtaaactctacattgccaactttttggaatatgaatataatgaaagtttatatctggttagttgtgaaaaaaattattattctatcatgtaaagaacatagaatttattaaggagatattacttaattggtagattattcacaagttttagctgaattgatttttttaaggaaaaaattatgtgaggaatttaacatatttgttttggtagaaacatgttttgacagaggaattttatacttagataaaatatcagtttcatataaacaaatcataacttttaaattataagtacatcttataatttttatgttttcacgtccatagattatttattgatagataaatagatggatagaaaaatttgcaaagttcagatttttttagtgataatctaattttttaaataaaatgatttaatatttgcacagtaaatgtgatgaaaactttgtgtacagatataaggtcctgtggtttggggtttcctttttgtccaaaaggcattgttctatgtgaattagacataccgatttaatattctaattcaatgcctataaaaccaacctttatttaattctctgctttctgcaattcctcaaggagtgaaaaaatagactgtgacttctttaaaagaggcattttgttaaaagaataaaatgtcttttgaaatattagtgaagtactagtattttaatacccttttttaaaaaaaacaattaaagaatcctatgattatttcttttccctatctcaaaaccaagcatattttcaagtaaaattaaatatatttgaatctacactttataatattacaataaaggaaagaaatagttatcattactacatttggagatttttttaaatgtagtttctcgttgaaagaatttactttcaaccacaagaagttgattattctgtgtgtttttatcagataggctttatataatttcttgtatctcataaggaagtccatgcataatagacaaagcatccaagaacacaaacttaatgaaaaaccagcttttgttgagatggtttcactccagtaaccttggaagtgttggcgagtaatttgagttttagtgacaagattctgttgctgctagggatggttttggccatttgataggctgagtttttacaagaataatttactgtgtttacagacagcttaggtcttattagggaatattaacccttcccccaagtttaggttctatgtgtgcgtaaattaagagatctatttctgttttggaaagcacacagtatattttaaatataatttttaaatgtaatttttaaaagaaaggctctattttagccttctaaattatatcttctatatacacttggtattgctgaataaccaaaattagctttcgcttttcttgctggaaatttgtaattttcttaacatattctttctgttctgagtaaaagtaaataaaggtaattaaaatacagtatttttttaaaaacttttgaaaaggttcatcttttaaattcttcaatgatatgtaaaagtttctacctatgaatttattttttgttactgataaatttgtattaaataattgatgcctaaaatatatatttagtagaataaagaaattagctataaaacaaaattagaagagccacaaactagacagggcactgtggctcatgtgtgtaattccagcactttgagaagccgaggcaggtggatcacctgaggtcaggagttcgaggccagcctggccaacatggcgaaaccctttttctactgaaaatacaaaaattacccaggcatggtggcaggcatctgtaattccagctacttgggaggctgaggcaggagaatcactagaacccgagaggtggaggttgcagtgagctgagattgtgccactgcactccaacctggtgacagagggagactctgcctaaaataaaataaaaataattaaaaaaaaaaaaagagccacaaactaaagtctggttgggttgggttccattgcctttgctcagaatgtaagctgctactatctaggtacatcagctgtacatatgtcttgtagccctttagggtctcagaatttgtctctgaaaataagaggattggataaaaaaaaaaaaaagctcagtactattttataattccagatgacaagctgaaggatcaagtctttagcttcttaaaattgttatagaggatattgaaaatgttattactaaatttggagtgaacatacatgaaaacattgattctttttatttttgttttgaaaatagttaaaaataaaaacaaggggaatttattatgtcaatctcacaatttataaagcttgatattttgagttgcaagtaaaattaaatataaaaatctttattaattctgtcacattagtagaggtctcaatgctgtgaaagtccatgtctaaattatgacaaaattattttcaaccatatcagcattgtttcagaagaaaagatcacaactaaatttacttacagcaatcttacaggtttaagttttattgcgatttcaaaaacaaaataatttcactatcaaattaaaaacaattcattcttttatccagaaagatagacattaatttgaattaataacatatttctgttttttatgttgcaatttctttcctaaagatataaaatcttgtgccaactgtcagaaaaaggaaggatgagattattaatatgtgcaatgtgaatcaaaaatgattcaagagaaattatatgtatatcaggaaacttcttgttctttcttattgatgctaaagcagggtggtgatgacttgaggtataatttagttaacactatttagatatatattgtcaaatttagaaacacatttgtagtaatataatatatcatatatgacatgcttttctgagggatttgtgataatagtaggtttcatgaaaatctctcaagaagacattgatttttttaccaaaaggtaaggctttatatctatagtatggggatgtaaacataattatcaaatgaatatttgattcgaatgatttatttgatattcacataaatcaaatgatttatttgatatttatgaatgtgatattcatattcatcaaataaatttgatattgatgaatatcaaataaatggcaaagaaaatatttatgatgagatgaacttttttttattcacatcagatgttctatacctagtattattaccttttgtcactcatcaacaaaaggtagtattgagttgttttcttactggcactttaaaatattatgcactattaattttcttcagtaaaatttaatctacttaatctgctcttataattatattctgtgatgttttccaatacaaatagttattccaaccacttttagaacttgtttcctttccaatgtcctttcatagcatcttttagtataaaacaacctttgggataaatattaataacatcaagtcaacacacagagtgcctattcatctttgttcattatatcacttgctctatttagatgaaaatcatataatcaaaaatgccaatatattgtctgtgtgacaaagtgtctccaatgacacatttagtataaaagccatgttgtactaatctgagaatagaatagatctatatctcattctaataataattctcaatgaatagtgtggctctttcaactgatgcattaaacagataaagatatttcttggagagttcagtcagttggctatgccgccagttataacagaaaccaattttcaagccgtgagttcttgttttttgttttttaccaaaggtactgtttccgtacactggtattaaaaaaatggattattctttttgatataactaagatgaaacattttttcattttttcctgtgattttcagtttgtcatttattattatatttaccagttttcgtttctatgtgccttacacacaactctcacaaactttgtttctccatttgctttactctttttttaatcaatctgtctagtttgtcctgatgaaaccaagtaccatagacagggtggcttataaacaacataaagttatttctcacagttctggaatcagggaagtgcaagatcagggtaccagcatggttggattctggtgagggtcctcttccaggttgcagactgccatctgctcattgtattctcacatggcagaaagaggactggagggctctctggggtatctttcataagagcactaatcccactgacgagagctccactttcatgatctaattaccccccaaaggccccaactcctcatatcagcacattggaggttaggatttcaacatatacatttctgggcaatgtatacaattccattggacagtcttacaatcttttcagtgtttacatgcataatttactgcaagacttggaatgaaacttcttagctttgcttggtctatataatatgcttcatcttaagcaagctctacattactagtgatgttaaatttcagtaaatggaaaaattccttgagaatactatattctctttcattatccaaatacctctaattttacaatttgatcagtgttcctgcccgtgtacaacccaattgaattacattggatgtaattgccagtttttaaaatatatctttggattaaaagataaatattatgaaggaccctgtctcattgtgccatcagtatatcatggctgagactatctcagataagataatgtattagtcgtctgcttcctaggaaaatgaacactaaaatgaaatatggaagaaatggattctgagtgttaaatgtgagaaacaaggtttatactgaacattctaagccattgccaaatgtcaactttaaacttcagatcaagagattcagaattctacagtgtcaggtatggtagatgttctcacaccaaggtgaacacaagaatcaaccgagtgatttatttaaaagagagtcctgagtgccacccccagaaattcagatttttaaatttttaaataaatctgagtgtgtcttttaaacttacattttgtaccagcaactccaagttattctaatataggtaatccacagataaaaaatatttgttagaacgtattttttaaaaatattgtttagaccataaatattttagccttttcttttttttaacaaaatataaatttatactttttagacagcaaaaaaaaaaaaaaattgtttaaagaaactctggccgggcgcggtggcacacgcttgtacccagcactttggaaggccaaggcgggtggatcacctgaggtcaagagtttgagaccagcctggccaacatggtgaaaccccatctctactaaaaacacaaaaatcagccggccatggtggtgtccgcgtgtaatcccagctactcaggaagcggaggcagaagaattgcttgaacctgggagacggaggttgtggtgagtcgagatcgcaccactgcactccatcctgggcaacggagagaaactcagtctcaaacaaaacaaagcaaaaacataaactctaaattccattatgtatgtatgtatgtatgtatgtatgtatgtatgtatgtattttttgaggcacagtcttgctctgtgttgcccaggctggagtgcagtggtacaatctcagctcactgcagcctccacctcccagattcaagcgattctcatgagtagaatgcctcagcctcctgagtacctgcgattacaggtgtgcaccaccatgcccagctaatttttgtatttttagtagagacggggtttcaccatgttgaccaggctggtctcgaactcctgacctcagatgatccacccaccttggcctcccaaagtgctgggattacaggcgtgagccacctcacccagcctaaattcctttaaaactatatttatttcttaagaacctgatcactagtctttctgtcagctctttctctttttattttttatttttggtcatttctggtttatattttagaatgtgctactatagatttgctgggatgattctgattttaatcaattttttttccttcttgtaccataaaaaattgaaatgtcccagaaattttgaatacatctagaatctagactgtatctcccagattcctattcatataaaaattttcaggcaaattgtccctctttggggttcacaaatcatgattgcaagagctagaagtaaaccactgtagaatattttagaggctaatagtttagaggctaaagatgtctcagagaatattggtctacccctgtcctatggatgaattcactgtttagcaaagcactggacgtgtattatgtcctagagtatcccaaaagggtatactgaatcatttctaaaaacagtcagtgtattaggaatccatgtgcaagtaacagaagtccttagtacaggagcataaatagaagcatatttacttgtctcatactacaaggagcctgagattaggccacaggctaatatagacactcaagagtgccttcaagatttcgggctcttttttttttttctgctctgtattgcgctgactactattaccctcatgctaactccttcttaggtagatgattgctacacttctaggtcccatatcctcaggataactacctgggaaagaaggaaagaacaaattagcgaaaagcaatgctctgtttttcaatttggaaagagatggccctttcaacttcatgttattacccaaaactgtgtcactttatctgctctggctttatgagaagctaaaaaattgagtaattttacctgggtacattgatgtcccaaactaaatcagggttctgacaggaaaaaagtaggaatacatactgtatcagaaactggaattgtttgctacagatagtatatctataaagaaaaatgtgtaagaaagactcagaacaattaatgtagacataaagatgtagattattatttgcctgttacatgtattaaccgtttggtagactattttttgggagacatcgttgtgagtcttcataatgctcatctcactcacccatgacagcaaaatgggggttggtcgctaattattaggtaaaacattctaaactaacaggaaaaaggaatccttgagttaatcttgggaggataacagtgggtgaaagacgatgataaatgcgcaaaactgctaaagtttaaatgattggcactttcaggatggtagcagtcaataagaatatgactgctgtgtagttaacctctgcactttttttcttttttctttttttttttcttttcttttttttttttttgagatagagtttccctgttttcacccaggagtgatctcggctcgctgcaacctctgcctcccaggttcaagtgattctcctacctcagcctcctgagtagctaggattacaagcgcccaccaccacacccagctaatttttgtgtttttagtagagatgaggttttgccatgttggccaggctggtgttgaactcctgacctcaggtgatctgccccctcagcctctcaaagtactgagattacaggcatgagccaccatgcccagcctctgccctgtttttatcagtttacctttatgactgactgaggaagtcctgaagttgcagctgctccacttctgagtgatcctggtttttttatttcttgttgtcccacagcagacagttattaaaatattgaaataatgagaatcctcaacaactctagtcacctttggcacctgcaaaatagaagttttgctatagtggtctagggtgagaggtaccccaaagaggtatattgaatcagttttaaaagcagtcagcttgttaggatttcatgtacaaataacagaaatctctgctacagtggcttcagtagaagcatactcacttgtcttatactataagaagcctgatattaggccacagagctaatacagaggctcaaggatgtcctcaaaatgaaaggtttcagtgttcactggcagagtttcctctggcaagcctggaggggatgggcagaggctggagtggaattcagattactcagaattaatcaggtcagaattaatcctggttattactttataccatggttcagttacttttataggtgaagatgtattttgtgcctaatcctacaaaaacatccaccccataatatgtcaagagcctgcatttattctgggaagaataaccataaaacctctcaagagaaattttccactataaaatacaaaagtaattttatgcgatacacagatcaatattacttgataaatatattacacaatggtcttgaacattgaaatatatgttaataatactttggtgtacataatacctgtatttcccatatgtattaacatcattttatagaaaagatcataattttaaaaaaagggtttgcaggaaggtacagttgggacctgtgcacacattgcatacatacagggtcttaatggaaagataattcaatacctgctgaaaccataacagatcattaagaacttttaaaaagacccgtgtctgtattgaaatagagaacctagctcctacttcaaatttacaccagaaaatggaacaattgatattatttttccattctttaatttctttttgcttaattgatttttgttttgtcttagttatcagtttgtcagatagcatgtggtttgttatttttagagagctcagattttccaaaataagagtaagcttctttgtcattattttatattaccatatatatatatatgcatatgcacatagatatatatgtgtgtgtctttacacatatgtttactataaaataaagaaagcaatattttacataatagttttaaatattctgtaagtaccatttggactagaattggtaagatttttttgtttttgttttgttttgttttgtttttttgtttttaatttgagacagagtcttgctctgtcgcccaggctggagtgcagtagtgcgatctcggctcactgcagccttcacctcccgggttcaagtgattctcccgcctcagcctcctgagtagctgggttacaggagtccaccaccatgcctggctaatttttgtatttttagtagagatgggtgataagcattttaaacatatttttaaaaaattatataaatttaggggtacaaatggagttttgttacatggatataccgcatagtggtgaaatctgggcttttaatacaaccctgtaatatcagttttgtcaaactcttatcagtcccacagtttatgaagagttttgaagttttgttatggtgtggattacagaattgtaatattgtcgttaacacctatgggtcttttcaatgaccataaaaaagtttggaacctgtattcattaaggaagaatttcactaacctcagaaggaatgagatatggttctgagacagagagaccctgatgaactctaatacacaatggtagttccagcataagcataatcatatatggacaagctaatttcattccacccttatggaaatctgccaaactccactatactttcaattgcaataaaatagcttcaggcaaatctgactttttatctacttctttgtgtactgtaaaaataaaactaaaacaagtttttactctgaaaagcttgtcgtttcaaaatgtatagtattaataactatgaagccatacagttatcactaccattacttggtgtttattttcatttattttttcctgggtattgattttgcatagttggaatcatagcacaaaataattttgtccatttttatataaaagggctattaacctttgttaatttcattccagtttggtaattggcttccacttcattactgttatatggatgtttatataactgtgataattgcttgcgtgcaaggacagagtaaagaaatgagaagttttacaaatttgtaaaatttgtgtcagtgattgagcctaaaatggaatctttacttcagcatatttgacccttagactttttaatgtttatgaaaacaattactaaaattatccccattttctacttgatccagtgtacctcatggaaagttaaatatgtttgaaggtagtgaaagtctcagcaagacaaatgccataaaatgattctaatattgcattcaaatgtttctatcatgtatatagatatgtatgtgggtggtctgaatgtatgtgtatgtatatggaaagagagaaatgattcataatagattttacattgaaatgtactaagcaaaataatagaaaagcatgctgcagaatataaaagcaatagagacaagcaataaaaaaaaaagaaaatgtacatatcagaaataaaacccactacatgcttctgtatatttgtgaataaccagtactcactgtcatgtaccaattaaaaataataggaaattttataaaccctataaatattgtgtttaactttttataatataggacttcaatagaaaatagactgcataaattaccttttatagaagtttagttgttaatgatcatttttagggtctcatccagagaggttcaacacattgttatggctgatttaaattatgattacaattatgaaatattgtgtctgtgaagttcaaaaatttacataccacagtcagcagtgaaatctattagaagctctagtgcgtttgtaggtctaatgtgaattgatatactggttcaattttaaaacatgttaattcagtcccctgtgccatgccactgggattaatattattataatatgtcatatcacttaaaattaaattatggtatactcttttgtgataaaaattaactaaagtgcatgaaattgtttctgagtctctaacaaaattacacattccttcgttttacgtaatttaaaataatatgaaaaatgtcaatatttggagctaacctcacatcattcaaattatagctaaaaacatagaattgctacattatttcttagattaaacatacttttccttaatgtgaaattgatattgaaatgtcatctagacaatgctatggatatctacagctttttaagtttgcatccgttctaatagattatttgaaatgaataatcatcagcttctttgagacagtaggggaaatcagaaacttcacagatgtttagtgatcttccaaggacaaaataatagaagtaatttaaattgctaacgtattggtctgttttcgtgttaccataaagatactacctgagactgggtaatttataaaggaaagaggtttaattgactcacagtttctcatggccggagaggcctcaggaaacttacaatcatggtggaaggggaaggggaagcaggtcacaccttacatggtggcaggagagagagagaaaaagacggcagggaaacctgccatttttaaaaccatcagatctcatgagaactccctcattataaggagaacagtatgggggaaactgcccccatgatgcaattaccttctgccaggttgctcccttgacttatggggatgacaattcgaggtgagatttgcttggggacacagagccaaatcatatcaactagtttgtcatttggattatagcactcattgggaggcacagtatattatgtaactttgaagtataactttcagttaatttttttttttatcattgcatttgtacacatttttgccagggaggctaaaacataggttaggtaccaatatttaaatctatggactgctttccactgggggatacgtattttcaacggtaaataaaagaaaataattttcatttcatagtcccttaaattttacttggagaatagattgcctggtaatcactctatcactcctgtctcttttcttagaagcaggcaaagttgcccagctaccatagtgtggaccttatgggacagctctggatatgtatgtcactgatacccttgttcactgtcaggttgacagacctgatggaggtactctgtaccacctgtatcacaggattttcctgcaaattgatatcaatctatcaattgaatagaattgaatattgaatatccaattcccctccctaacataataaaatacactagtaacggaatttcagtccccctggaagagagaagacattttggggctggtattatacttaggaccttccaccaatgagtccctccacgttaaaaattgtcagtaagagtatcaaatagatcacttatattagcatttcttcttccttctactgtgtaaagtcatcaaagatcattttgaagactgattcatatattattaaatgtagtattattttactattttttactaaatttgggaaatgactcagaactctttaataattttgagaggtatgaaaaataaaagtttttttccccatatttttgtgttggtagccctctttaaaatagaaagtatgaatttatttaagccagatcaacccagcaaaaaacaacaaaaaaagacttttgactttatcttgtgttatttttgttactgctggtggagaatttgtttctcaattcttccacttatttttataaacatgaataaattcctcattgaaaaaagttcctgtatttctattttttagtgctaccacgtaacttattttgagtgtgacatttgccaaaataaatagttccaataaagttccaatgaatacttgttcacaagtatgtccagcatgtcatctatgctaaatagtttctttaaatgtcatttcttctccaatcatactaggtactaaatcatctctattttctactgccactggaataagttacatgtacttcagtttacatctatctggtatattattaatggcaattgatggcttaggaatgaaaagttttgtgattaaaacttaggtttagcccgatatgagaggcaccaacatgagtgttaatacaatagataggttatcataaattattgctcttaaaatgtcaaatttgttaattccatcgaaagaaatagcttgaaaaaaagaaagctagccaattgcctttcactgaaatgtaatggtttatctgtagaataaacagaattagtttcccttcgtttgaagattttgtgggaaatacatttcattcattgtgtcccatcctgaagtatgctagtctatgatttttattatgccaccttacagaaattatagaatacaaaacagatataatctcctttttgtgcagagaataaatagaaatgcatatagaaatataaatattaaataatccagaactacataaaaagcaagtccaattcattcaacatacttgtgtattactcactgataatatccatgaattggactatttttctccaactcacctgtctcatgctacacaggagcctattttgaatgtttcccgtgggaaagaaacctcatgcattcatttcaattaaggcagtgattctcaactgggggattggttgtatagtttataatagtaatggtacagagaatttctactatacagaaatgttagtgatagaatccttaatgatgttaaactgttgatggaagtatgtcatgtctgtcaggattctgagatggaaaaagattggcaaatactgaactataatattggtcactggtagtagcttggaaaattctcttctaggaattttgcatttgatagggaatcattgaatatccaattcccctctctaacataataaaatacactagtaagggaatttcagtccccctggaagagagaagacattttggggctggtattatacttaggatcttgccacccatgagttcctacatcaggtacatgtttacttgacattcagtcatgagattcctgggccaatctccacactaacatgcacagttgtgtgtatagacgagacacatacatagtaggcttaagagcaaatgtctaccttttcctctgttttcaactcaaagtgttggtcctgggtaaacaaaagttttgattatacagtttttatcagtagatacccccaattttttttccatctcatctcaaatgattcattgcctaccaataaaaatagactgtccactggcagtaacttcagatctaatatttatcaattgtttaacagtgttgtgggataattccgccgtattgtttactatttctcttttccccaagatcagatatgtttgtctctagttgcatatatttaaaactttctagtttatattttcaatacgaagacatatttaaatacattaatttccatagcctgaattagagtagcatttgtaatagcattttcatctcagttgatattgattttctaaaatacatttgcctcagaaacattctttttttcatttggcattttctttacattgaaaattgaagaaatgcagtcattaaattatcattttcatttaactggatcttgttcaaatttcaatcaggtgttctacaaaaagttaatagtttaccagacattttcacatttctactgtatgcaatgggctattagtttttttttaaaaaagagaaagcttacactttttctctctatgatttggcttcatttattgcaaaagattgcaaagtaattgaaggaaaatgaaaactaaatgaaataattaaataagcaatctaatttctaggtgttaattcaattctttttctaagcaattttctgtattttaaacttcatttgctttctatctactttttgcctgcaggcttagatgtctcaaattatgggatggatacatcccttagtacttagcatgatgacacaggggaaaatgccactcagaggactagactaacacatttaacagttatttcattatttggtggcctcaaactccagatggccatatctagttgattttattgtctttgtcgattaaatacctgtattgtaaaattgtatgactataaaaggataaattttgatttactaaaggtgatcttctgagatattttgagggaaagaggtagtataccaaaatggaaatactacgcaaggtaagtgaaaacctttttaatgtatcttggtcagtaaattaaaccaagtttatattgatgccgttgccaaatttccatgtcttttaccaacacaggttcaaatctggaaaaaacatttactgaagaattcactgatttggcttgtaaaagccttttctataaaccataggatcaattgtcagtcctgtcttgaatgattacttatctctaaagctaacagagttgctatttaagctgaataccttccttaaaagcaagaaagataagtaggagtacacaggacactgtttgttagcattataacaaatatcctccagcataagtgatcaggatgttaaatttatggtaattgaattcaagaatttttgtcagaaaagtattttcagatatgaataggtaaattcttagcaagctagtcttctttggaaggtgcttatatttgaataaaaaggatttctttaaaaaaattgcttttaggatgccatttaaaagaaataggcaaacttcagaagccttaatggatttcttacagaaaacaaaccctccataaaattccaccttagcttcttgcagccctgaattcatgagatgttaactaaattaaccttgactgtcttttattggtctgtttaaaaaattagaaataattaatttaaattgtcattgcttggttctaaatatctttgctggccatgtctatagagagtaggggagcatttttgaagataatcattagcaaatttcctagattcttccttactactgattgctttattataaagctaatattcatagtttgattatattaatgcgatcttgttttcttaatctaactgcatgaaaacatacatggaatgacagatctacctgtcatttacaacatacttaggagattgaccaatttctaaatagtggcctaattaagaaataatggacattaaatcaaactgtgtgtatatgtatcttcacatgtttgtaaattatcactgtggcaagttctttatagcacatcaaagatctagttctttatcactcctctgcccttggagtttttatgcatacctttgcttctctgtggctaagcacatacccttaaattatatgattgcatgtggcagcagtctctcttatcgacatcttgaagacggatgaagtgaagctggatttgtggattttgccttcatttgtgtcagaaaccaatgccctctctcctttgggagccaatgccagttatgaacaaaaagccgtaagcagttgtgtttccccactcccatattctaagtgatcagaatgtgggatttcaatgatttatcgtcttccaaggataggtacatttcaggttttttaatcatgttgaaaacttccaaaacccattactgctgtatgatatttacacggttctttactctgatagggcctgttttataaggctaccgtgtctaatagtaagcttgcttttaattgtgacagtctgaaagcttactttgaaagctgcttctagagaaacctaattattcctggttgggaatgttcttctggtgataccactagcctcctgggtactaagcatgtctgatgataggtgattcataagctcaatgtgacatttcccaatgagttgttttgtcacgggttatccattttgtcagacatgttatttcatcctgagctttaatgtgactatcatgttgctgggcaagtagctgagagtgtcatatagcttgtcaaaaccgtaacaccatttgaaccagaatatgtaattttaaaatcagagctgtgaaatttaaacgaggatcttgctaagtcacagctaattcctttcttacttggtaacctggggtctaatgtaagagtattaggttgccgtcatcagcctttgtaaataagttaaatcaactgaaggacatagtttctggctagggcagggtctgtcacctgttctgggttaagttactgtggggtgcatttgaagatttgaagaaagcagtctgttgagatgacgaacttcttgaatcaactgtgacaaatgcaaaaacccatctgtgtttttttgagtatcattctagtagtcatgcctctagtgttgctttacttactctccaaacatgaaagttagcacatctattaaaaagcaaatctgtaatattagtagaaatcattctgatatagtaactttgcatgttctataaattcagaggagtagaagattacaaaattccaacaccaatacagcatagctatcaaagctgttcttaaaaatagtttgttaatatgactacattttaaaataaaattagaagttctttgtccacatagaattccctttagttaaattattttgaaattagctagtaaaaaggcatttacagaatttgaattagttgacagcacaattttaatacattcctttgtgttggtatttggagtttgtttccttttaaaatgtttataaatatatagatatacacacacatatatatacacacacacatatatttacacacacatagataatacattatatttactatatatatgtatatttgtgacagttacaaacttttctgaaacatgtatatatatatagtagtggtgcctgagtgtttctaaaatcattgtaacaatacattaagccaattagtagttgaatcaaaataaaaaaggcagaaaaagaaagacttcataaaaaaatagtaagctttgcaaatatttaaatataaaattaatacttagcaatcaagggtaatattgtaacagaggtgtacaaatgtttaaacctaaagaagataagtataagaatattcattttaaaattagaaagtacaaagagatgacgtagggacatgtgaactgctgatgtcttcatattttacagaatcctacagaattataccctgtattatagagttttaagatggaaaatgacatcacttcttaatattttaaataatttcttaagcaaaaaggaaatttaaagaaatcatatctttgttggtaaagaaatattagaaattcaccactatctttagtgttacttcagatttattttgttataatctataaaaattaagtttaagacttaaaaaagtgtttataatgattaaatattcataaatgtatcatttaccatccatccatccatccattcatccatccatccatatctacgcacagaaaaatgcctgaaatgaatttcccctcatatcaattccagttatttctttgttaggattttgtgtgtttaaaaatattttgctgtacttaaataattttttgaggttttttttttttttttttttttttttttgcagtgaacatgactcctagtaggaaaagcaaggaagaacactaataaaaatatgctaagatattattgatggttaactctagatggtaagaatatgtatgatatgggtgcccttgtttacttctttaaacatttttagtatcttttcaattttaggaaatataacttttaaaattaagagagacaaaccatggtagaacctattattagcaaagtatggtatttagaagaaaaaataattgaataaattgttttcataatgtggagttatgtgctgcctgttaagacagcaatcccaataatgtttccattcctttaggaaacacattatgaaccttataaaatcgggtgggattttccatagggatgaaattcattagagcaatgtctgcattctatgaaaacatctggtggttttggtcattctgtcttgtgttttggcctaattttctaccacgttgtaaggcacagttttaagaataattcacacatttttccatctagagatttttgaccaaaaaaagtatatttatactgatggactaaacaagttgcattataattgtgacagttacaaacttttctgaaacatgtgtatagttttttttttttttaattttaaaagtagatgtcacacctaaaatgggtaggtccatttcattttataaggaaagcacccagaagggtccatatgtatttgtgctcgaaaaggaagtaattgtgtgtgtcatttccgccccctttttatcaatattgcctaatatcaaggagaatcagtaataatagaattattaatagcagtaatagaatcagtagaataagagtggtagagttagtactcatcagtgaaaaactaatcaaccttattactttgaagggaaatctgggaagaaagagaatagaatgaggtacatgttagaaatggaaatggcgaagtaagtaatttttctgattttcataattctgtttcactagttaaatctattttccacttttctttccttcctttatctggctcggttctcactttagaaggcaaaattttgattatttgcaagagtgctcccaactcaagtctcttagtcaacatttccttccctcaggcttcagtctatgatatttcatgtaataatttgtaaaatatagttctcattgcgggactcctcacttctattttaagatatttttcttaaattattttatttctattgctgcatgcattcattgatttgagataaaattttataagtttgtggaaatcattgaataggaacttctcagtcagcgctgaaagaaattttatgaatgaataatacaattccctcctcctaatgaaagtattgtacatctcacatttagtttatattgattgctttctgacatggaaataaaacaatctttatattatgcagagttcctgttagtggtactatcaagaatataaatctgcccttgtgacttctatttctatgcttttctccaacctgaagtaaccccaaccaggtttttaattaaagtaatgtgagtcactgagtgtatcaccccttttatgcatgatcaagttaccatagcataaatatattccaactcttttgtaaacttgaattttatggataggtaatacaattcttctttccaaagtttgcagttttacttccacctttaaaaaatgttgtagtctcttggcagtgcttatataaaaatatgtgaagtgtgggtaatactagatatagtatatagatgtactagatatggtttgcaaaggtggacttggaagccattttcatttttggcctatttagaaaattaaatgatactactttttcctatacaacttatatttggtgggatatttttatttacttaatttgaaattttagactgaatagtcttaaatttccagcataaatattctatattttaatcaatgtttccttgtatgtagcatttgtacagttagttttttgaagtttttaattttttttttgtttgagacagtgtttcactcttgttgcccagactggagtgcaatgggcgacctcggctcactgcaacttccatctcccaggttcaagcgattctactgcctcagcctcccaagtagctgggattacaggcatgtgccaccacgcccagctaattttgtatttatagtagagatgggatttcaccctgttggtcaggctggtctcaaactcctgacctcaggtgatccgctcacctcagcctcccaaagtgctgggattacaggcgtgagccaccattctcagcctgaagaaggtctttaagaatatcaatgaacattaataccagtaatatcaaatgttagccacacatcatgaatattaccatatataagcacagatggtaatatcgggtagggcttaagagtgtggtgtttggaggcagaccaacttccaacacttactggcgttaggacctttaacaagccttcccaaacctcagtttattcatctgtaaaggtgagaataattatattactgcctcttgggtttgaggagattagagataatgcaattgctgcagggcctgactcaaagaaaccactctaaaatgttaactagtctcattagttattcattcatcaaatgacaaaatctgttttgctcagttctaaataggaggcctcaaaacttttagaggatggtttaggaacttgagtatagtacactaaccaaagttcttggctatggtcttataccaattgaggattcttcagaagggcttcaaaaataggcaggtgtctatgacaggtctgtccatagctcaaattatttcaaaaaaattccttgcgttttccttttgttctgccatagaagatgattattttttttctccatgatgttgtcttgtttttctgttagagggctgtcatgtggtgtgctaaacttttagatagccagagattagctatctaaaagtttcagaatgactgaaatagttattttttctttctttctgtttttattatgtgtctttgcaaaggtttgttgagggaaaattaccaaataaagtttgaaatagtattagtacctttaaatgttttctttaaaatatcttaacgatagatagatagatgatagatagatagatagacagatagacatagagatatatggaatgcttcattacgcatactagacacttgttgattttttaaaaggaaatgaatttagaaagcaattttcctcgaaaccagtttttttcttctttggtaaaggataagtcattcttacaactctcaatgatgcaaggtgaaatttatccaattttaagtagggatgctaaataatgtagagaagacacaagcacttgttttggagacagaatatttgccctctgggcccagatgtgccatttaaaattgagtgttctttcattcatttattcattcttgcccttgtttggtaaagggtattgggaaagatctgtaattaaagataaaagtgtaaaaagaaagaaaaattgccttgaaaacaaaacaaaagtgccagcaacggggctaaaaagataacataatgttatatgcccttgctataaataggtcataatttttgtttcaagatttctagcagccaatgcaaaaaaggaaatcctggtgaaattacacaagtttaggatatcttccagaccacgaatcaaccagtcacaaagaatatgaatacttattttcttaatattaggaacagaaatctcccatgggtcctagtaaggagaacatggaaagtaagtgattacgtcaattgtagtatcttttaaaagcagtattgagttttataaggaagtcacttcttcttcagcctatacacttccataatttggagatgtttgggcttcctttaaggttcctttcagtttcaacatacgtgactctaagctggaacccgatgagatcagtgagttgttaaatgtgaacatgatcaaactgaattaaaaagctgttaagaaattagatatctcatcttcagtttttggactttatgatttttctttccattcctaatgttttttctatcacagaaaaaaagtctcatggtaactgcttttaattttgactattttctattcttccaagaaaatcatttattttaaacatacaacttatcttttttagcatattctgattgatgcaaatactcttgtataactttcaatagtcaatgaaatattggataaaatgtatttctaagaagatagccatatatgtgtactttttcaaaattgctgctttttgcctattattgtttgctcgtttgtcttttggttttgccttactataatagaagacttattagttatatttaactttcctcctttgaggaactaatcattatccaacttaattcataaacttcacagatggcatttcttcttaacttagaactatttttgtcttactattctgattctttcttctataagacagcctcatgaaacctaaacacccaacatggaaatattagatggcaaatatgttttccattttgtttggccttaattttattcaggtaaataattgggttgtgcttaacttacatggaatactgcagtttatatgatgtgtcataacatcaaagctaaattaaggaacaagggagagagttgtgcttttttccaaactagtacaacttataatgttatgctgttttttaaaattattgtcagtcttgtttctcttatagcacaaggtctctcttaattatgtaatttaaaaaatgtatccttctcttcaagaccagcctgactaacatggtgaaacgctgtctctactaaaaatacaaaaattagcctggtgtggtggcacacacctgtaatccgagctactcgggaggctggggcaggagaatcacttgaacccaggaggcagaggttgcagtgtgccaagatcacaccactgcactccagcctgggtgacagggtgagactccgtcttaaaaaaaaaaaaaaaaaaggtatccttctcaacatttctgagactatatctcttaaatttgttttgcagctctccaaggaccagttgtttctcaaataactggtccttggggagctcagtggattgcctgaaaaactctgattgagttggggaagatttctaacaggatggaatatttgagatttacataggaattttccaggtgaagaaggggaatatgccattagatctacaaagactgtaatccagtagttgggtactagaagtagagatgaaaatttcattggctgttaagttttcagcatcaataattagaagcacactgatacagcctgaaacaggtaacaaggacactcacatagagtggatcaaacaagatagaaatttacttctctttcctatcatgtctggaggaagataggccaacgagagcaggcatgtggctcatcaccttaaagatatctaccgcctcagattctttctatcttattatcaaccgtttttacatgaatgcgtgaagcttcctgaactgtctgtatattatggcagtaatagactataagcagaaattaatgatcatctctctttttttgttcacacaaatcagattttgaaactttaaggtttcttagggaatttatagttctacaaaacacttagaaatgctgccttcggttacggtatctccattaggttccaattctttggtgtcaggacaatttcttacgtgttttggagcccctctgctatatagcagactctcaaaaatatgtaataataaggggagaaagaaaagtaaggaatatgactttcatgtagatttgaagttgtaatttcattgatctcgaagagttggaaggatttaggtaatcttatgcagataatggtaattttaaagaaaaggtctcattatgtcatagtcactatgtggactaaataaaaggaaataaatgaaaaggttgtgttacagttatcattcaaaaacatccaaatgaaaaaagtattttttaaatcagatatgcatttattttggggtggattttggcattatgcacaagtgttctcttgaaaagcaattcataggaccctaactgaacttttggattataacagaggtaatgtcattctgccaaaacacactgaaattagcaaaagccagtacccttactaatttgattcttattaagggaatccaagtgattgaaaacctgagatgagatttaactatttccgtcatcaaattcataacataaaggggaagcataacattgccagttaggagagggtaaattcaatttggaattttccagtagtaggacaaaaaataataaactcattattctcttcagattattaccattattgctgctgttgttttgagtacaatgactgcttacttgtgctctctgacagtatataaccaattaggggatttgaaatatagggagtcatttttgaacaaggaaaaggcagcatagaatctatctatttgcatatcttcaaaaggatttatttttatagctagtttacccattgcctatttacatacatgagtttggaccaaataatgttctaaaatctatccaagtttttaaaaaattctgtttggaaatcaaattttgtactaattttgtcaattattgttgtaaaaatctgaaatgccagaccttttatttaaaatatcaacatgggtatgaaaaataataacatgggaagatggtatctatcatttgacgggctttcatcaaccctgtatgatacactccaatcctatcatgagctctttgaaaaggatttagtctctttttgtcagatgaggataaccccagacatttaaggagctgatgttttctcaattccagaaaaagaattggaactcaaatctgtgaggcacgaaagtcccgaagccctcattctccactgttacaaatttgcagaaatctgagtgatatgaaaaatatttatttttattgatgctttatacacatatccatattactttacatacaatgaatacttgtgtaaaattatttaaaataaggtgcttcatatgttcagtgttttgtttttgactaaataaaatatttattgaatgccatttaagagccctgctacatgttgggaatacagttgtaggcacaaaaaggcatgattcttacttttggggagtaaatggtctttagggatcatttggtttttgcaccataggtgagcagaacacccaaagcaatgagtcaaagtggatgatataatttttcttattcccaaatgcaaataaaatgtatcttcaataaagtagatctgtagtatttccaaggaaagtgttattttcattgaaaaacacataccatgctttctgtagactcttaaatatcaatcttcaaattaaaaaaaaggttttacttccactgccctccccaaccagcccatgaacatgtggcgcacacaccagcagaacacatacatacatagaatctgaaataaacctacatgtgaaatgaccaaatggtgcatctggattagagttttagacagatctgtgctattatttaatttgttagcataattatattttatgttttattttcttacacttaggaatttttaaactgtaaaaaccttatattatatcattacattattaccgacatacctcattacatttatcaactggtttttttttttcagaattttcaagagttgtagcacattcataagattttgtgcctgttattctgtcttgaatattggtgcaaattttgtattttcattgcaaaatgccagcctcttaagtaactgtaactcatcatatgacaggtggaataaaatggctaccagtaatgcagagttaagctaggaaatagtttagcttttagtgttaattttacttcaaggaaattagagcattttatacatttataaccatcagtcttggctgaaatacttaatggaggcatgataacatatcttgtacctttatagatgttgtagctcaaaattatgtttaaaagttgcttttccaattaggagatcctaacttcgttggcaaagaaataatacacggtaaaacaaacaaaccaccaatataggcattatgaaagaggaaaaacttaataattggcattgcaaatgggtaattatctaattatctacagaagaaaatgttaaatgacataataaacagaattagaaaaactgggcaagatacaaatattagcttttcaggtcagaccatagcacaaaaggagatagcaaagtaagatttcagtttgggattaaaacctcttaaaaaggattttaaaaagatcaattaaatttgggcttcaatttctccatgaaatgctacaatgtatgggattaaatatatacattattgatatgactagtttaaaactgttcatgacatcttacctgaagttgtatccctcctggaagacaagaatgtaacaaatattctgaaaaaacttcagaaagtatattattattggaattataattatttgatgaaattcaattagtgtttattaataatgagcttgacatagaatgcattatatagacggtcacccaagtgtctaatcttacacactaaaatatacatgctgggaaatgaagatagggaaaatataatgatggcagaacataacattaccaaaatataaattgtctctagagattattgtatcttccactgttccacagaaagaataattttgatattctattgcacattgatagtcatgggatctcttcaggaatttttttttcttatgataatgcttgtgttctcgtcttacaaaattttaagaaaatttcttgtgaaaatgtgctactctctaagacaggctactgtctaattgttgccaagcacaagctataactatgataatgagattggcttatttcctttgtgtttgtcattcagacctgttttaaaatcttgcagttttagatgtcaaatagtctgtgatgtaaaatcacctagatgacatgtttccacacttgtcatcaacatgaaataatcatatttcagcacagctcctctgtcatatgagaattatgtgccacagaatccagatcctggaaaactacaggaccctaatgtgtgtgttatcagattaaaacacctgaaaatttagaatttatgcataattagccatttcaaagacttcacagaatgaaaataatctactgggcaaaacataatatatatatatatgaaatcaaacattgaatgaacacatgctttgtgtcaggcattgctctaaatactttaaatatattctcatttaacctttcaaattctttatgggttgagtactattatcatttctatgttatagtttgtaaatagcttccagaaggtaaggtctaaagtcacattgctagtttttggttgaaagggactctgaacccaggcaagccaactccagggtttgcacactaatgtatagctatacttttaagaaaactatgattactagatatttcaattatatttcaaaggtcttaggtaagttaattgtagaattgggataatgtcttgggttcttggagtacactgcaatcaccatgttcagctctttaggataatatgacaaattctagcctgtgcacaactgtttctctgccgggtacattttcagctgtttctctccttaacctctgcaatagtaatccaatcaccctgagattcctcataggtattatagcacagcattaaacactagccagtttcaccagggctttacaattcttgttatgctctatctaggagaaaacagaaccagtttttttttcttttaacttttcatcactgatagaggcctggtctgaaagttttttatcatttgaacctacagaactggattctagaatttatagtgcctgccaagttgtgtgtaaccctcgtgctggttcttgggttctaattgctgctgcattcaacccaacctcctggcaccccatttggacattctacatggaacaatcaatttcccaccttagaatctaaattctgattattttaatccgtgttggctctccttgtccaggctccccctgcccatggttctgatgtcccaaaaggctttcatacagaatgctgctacgtagcaaaataacttttataatagttcttgacttggatctgctatttggctgtaggtctgtgaaccctaacattacctgcaacattatatgcatgttcataagcacatttttttttttctgagcagggcctagagttttaatttttttctttcaaaggtgtctgtaatccaataatacttaaaaccactgctactaacagatacaaagcaaaagagaagggtggtttcttgttttgacacctgtgttagtccattttgtgtggccataacaaaatagcacaaagtgagtaatttatgaagaacagaaatttactctctcaaaattctggaggctgtaagtccaagatcaagactccagcaggttcagtgtctctgacggctgctgtccatttccaagatggtacatccttgctgcatcctccagaggggaggaacactgggtcttcatgtggcaggaggctgaagggcaagaaatcctaatgctacatgaagcgttaatccccttaatcccatttacaaggggaggagccctcatggcctaaccagtttttaaagtccctacctcttaatacatcacattaaacattaagtttcaacatttaaatttggaattttgggtagtatatattcaaaccatagcaacccctgaattaaattatttaaacataaagcaatatgttcctgaaattactatttcacatgtttaatatgtgcatgtgactagtggctaacgtattgaacagcacagcttatagcaataagtgatgttgtgcaagtttaaaatatggtggcagagagtaatattgcaactgggcttttgattgtttgtgagaacccagtattaacagtcatatgaacagtagagtatgcctactaagaaggtatagttaaacattattgtacatgtttgagtctaagaaatgctagctgcatttgatctatatcaatgccatatgggtttttaaaaatcatgtattgaatgtgattttcaagtggttcaatgatgtaacagtgttggtagggtgatactttatagaaataaagtaaattgtgtaattgaattcagtaggaattcataagttctgaaaatgtggtaatagtctacaaaccttgaaataaagtgtaaaatatcacagctttaaacaatgctggaattggtaaatattgttatgaagacagtaacaaaacatactaaataattgataaagctataaaaacaaatatgaatatagtatgttataagtagtggttactagagagcagatgataatatacattatatttaaacatatctctatagagtcaacaaaataaaataaacattttggtaaaaattacgtaagcaacaaaatgaattagagtgtatctctgcctcattacaagtataacaataaatattttacaaacaactgttagaaatcatgtgataaaataatagacgttaaggaactgcaatattttcatccatattagtaaatcaggagcatcaggaaaaaagagaataagtgttaatcaaactgatagatcattggatatccttatgaaggttgtatttgcagcatcaggtagagttcagctcttcctgtgacgggtaaagtctttatctctatttttctcccaagtgttgaccttccaagatattattctgcaaatctcttagcaagcacatttctgacttgtacagcattgagcttaaatctgtattggaacaacatttcaaccgtatttgagtcatagattatgttagtaaaatgtttatgtttaaaatttttagggaaaagcaccattctacttctaattcacagtgtaggtgatgacttatatttgtaggaaaagtaaagctacagcgcggtgttttctctagtattgctctaccgtcagagagtattaccctattattgttctctttaaatacagggtaatatttggctgtgttctataatgccaacaaatacttcaccttaaagggcattttggaaaagttcttgtcaagattggttgacattattataatcaaattaaagttttccttgaataaaaacatcatatactgagagaaaagaaaaggatatttgacggataaatgttgcttccatcttgttaaagagtctttaccattccttttataaaaatctcagtattaagagtcatggtctctttagaacattgccttaaagttatctgtaacaataagcattcctatgaactattagttttaaatagagtgaaaagatgtttctttcaaataatttttctttgttgccaaattcccaaactttctttcagtcaaaaaaaaaaaaaaaaaaaaaaccacagggcaacacacacacagagacagagagggagaagagagacagagacagagagagagagcgagaattcacagagggactgaatgaatgtccaagatcttgatataacgcaagggaaattgaactgataatcttcacctgtttgtcctgtcagtttacaaaaatataggctttgagctcaggcaccatggattgggatcccatctctaccttttacttactgtcatttaaccactataggtctcagttttcacaccttttaaatgcagagaaagtagtaattccatcataaaggcaaagatcttatgccttatttatcttttcctagaggtaagtactctatctagcatataatatgcatgaaataaacagcagttaaataactgaataaagggccgggcgtggtggctcacgcctgtaatctcagcactttgggaagctgaggtgagtggatcacctgaggtcaggagttcgagaccagcctggccaacatggcgaaactctgtctctactaaaaatacaaaaattagttgggtgtggtagcgcatgcctgtaatcctagctactcagaaggctgagacaggagaatcacctgaacccaggaggaggaagttgcagtgagccaagatctcaccactgcactccagcctgggcaacagaacaagactctgtctcaaaaaaaaaaaaaaaaagttgaagaaaatattatggatatttatgaatataaatattcataataaaataaaatgtttatgaatgcaattgaataacataaccaacagatgctaggacaacagccaacaggtgactatttggtaataatgatagttaattatgcttccacttactaagttattcttgttaatttaagcatcgtttaaactacattttgtatgaaatgggtgtattattttatttcttacattctacttcaactggttatcttatatttatattgttgtgtttcagctagatatgctgttgtgttagaacatacactgttatacacgatatatctagaacctgtattttagcaaactttttgtttcagaaagataatagaacttttttcattattatacataaagtatgctttttttctcctgtgctaaaacctaaagattctgctttaattttggctaaattatttttttcccatcactatctatatttagagcttacttctgagttgtagttggaagaattaaatgtgggagagtatgttttgccaaacccaatcagaaggactgcctggactctgtacatgagcctgttgtgacctgattctcatgtattctcgacacaatgctgaaggtccaaagccctggcacttctagggagcaaatacctccagagttgagtaaacctgaatcaggaacactttctctgactgaattctacctcaacaatatgcatattcaaaaaagaaaaggtaacatccttggaaaatatgtgctgggaactgccatattcaaaatacttctaaaataaatggagagtttttttttttttttaaaccaggaaaaaaactcttgtgaagaattagtttctaagtttttggtttctaagtagtttctaagttttctttgtattttattgatctcaaatgttgttgggttttatacatcacgtaacttttgatgttacttacagaatactctaattctatcattagatgtgtttatttctgaaaagtgagtgattgttgaatagaatcccattagcaacattaatgttacaatttaaagacaataatttcttgtagaactatgacgaggatacaagttttgcaatgttaaacatttttggaggtgtacttcccttgagtgggcacagttttagtcattttgatctatttttaagcttcagtttgaaaaagtcatacctcatttgtccttataaatatttatgtcatcttataaccaaattaactcctagattttcatttgaaataactcactttggctgagtgcagtggctcacgcctgtaatcccagcactctgggaggcctaggtgggcagatagcttgagctcaggagttcaagactagcttggccaacatggtgaaacaccatctctcttgaaaatataaaaactatccaggcatggtggtgcatgcctgtaatcccagctactggggaggctgaggcacgagaatcacttgaaccctggaggtggaggttgcagcaagccaagattgtgccactgcactccagcctgggcaacagagcgagactctggctcacaaaacaaacaaaaaaacctcacttcaatagtatacactgcaaaagcataactataaaatggaataagactttatatgttttgcttgacattttatatgccttatatataactttttttacttaaatgagaatagaatacaatatttaaaccaatagcaaggatggactatatgtacaaatcttcactatgagcttcaaaggaatgtgtactaattggaaaaacagaaataaggctagacatagaggattctgttatgtctcctccgagtgactaaatggcttcacaatattacatatagaacctgcagatgtagcccattattgacaaatattatggttattttgatataaatattttgatattattttggttattatcattttggtatcatctttatggctcaaataagttttccaattttccttgaaacatctttaaccctccttaaacatccatttataagcaaagaagcatatcgtctcccattaccatgttggtccaccttcagaacattaaaaataactcattaatgtagtcttccacctaaagagttcttctctaattttctttaaaaagttctttaataagttgaattacttcaccagttaaattttaatgtatttgagggcgaaccccatattcttcttttttttagtatctattatgatcaatgaaatgtttctgtttcattgattatattagactttttgttcgtatggtgcctatttaaacactgtattaatagcagttaatatatattgaatggttaacatttcccaataacgttctggcatctgtagtaactgacttaattctcaccctaatcctttgagatcacacctattttacagacaagaaaaccaataagaaggattattaatttgcccaaaaccaatcagctattaagtggccatactttttttgaccccctagagtctggttccagggccccatgcttttcactgccttagtgtttctaaattcatcttcctaaatataggacaaaacctgaaccctcctgaaagagcagtataaagtacaaaggagagagaaaagattgagcaaagggaataaaactgcgagtatgccagttgagcaagccacacggtaatttaacataagccacctgaagccagggtgaaaatcaagggtggaagcacacacacttcttgtgatgtgacaggatgattcataccagtcacttttaaagcactgtgtaatgagcagagtccttagaaacatcttagcatcagatcaagatactgctattcctcatactgattgatctttactgatgttttagacattatattttaaaaattctgtgaaagtgattccacgagggcattaagattgtgcaaatccaaatatatagacttctgctgcctttattaaactgaaagaattttaggaagcctagagaaatgtgatgaaaatgatgatgttggtcatggtcatgatgaagaatcttgccagtttactagcatcaagtataaattacaatcttttgatgtcagtgatgttattttagagctcaggaaactggatcttggacaggccaaggggcacataaggtcaaagagcaagtaggtccctgaagctcaatcagcatctagacccttactcaaaaatctatactcttcatccttacactatagattttttctcaaatcggaattttgaaggaaaataactacatgagaaattaaccattatactctctagtttaggtatgtaattgataattttgattaaagacagatctacaagctatccagcaggtgggtggtaaggttaacattttataacagaagcagggacaaatattgaagtacttacctacttcacctggctctactggaagggagaagataccaagcaaaacaaaattatccttagaatgaagttctggtttatttcaacttgctattgttgttattgctggttttaacatgtgataacattagtttgtttgggctgctataattgaataccatagattaggcagcttaaacaatagaaatttgttttcacacggttgtagaggttagaagtcatgatcaagggctttggtttctggcaagggctctctttctggcttgtagatgtccgtcttcctatggcctcatatggcttttcctccatatgtgtgtgcacagaaagaaaaagagtgaattctctcttgtctgttcttataaggacgctaatactgttggatcagagtcccatcattatgacctcgtttaaccttcattacttctttagaggttccatccctgcgtatagtcacactgcgggttagggcttcaacatgtaaattttaagaggatacaaacattcagtccataacaatatgaaaacctcaacttgtctctaggtttatcagaggctctctaaaagctttgttaaacctcgtagcatggagtcacattgctatctatattctcgttgtaaatacacacatccagattcaagttgtcaattgcttccaccctttaccacctccaagctattcttggggccacattctctcgctttggctcccagagtttcaggcagaaaagagagtgctattggttgccacttctcaagccctccagtaacatctacattcaactttgcctcctcctccaccttgttatgaattgcaagaccccatgaaaatcaatggaacacatcccttagaaaaagaatggggagccctactctagaacttcactaatattttgaagagcaaattcttcaagggaatggtcaaaccaataatttctgcttctcagaaaatacttgtcacaatagaaattgaggtttgataatacagattctgtcctaaaatattatgattcctttggtgattaatgaaagtaaactatcacattaacattttgatgtgatataactcattaacatatagtcttatgaaaaaaattattgatttttacatagccatactaaatattaaactcactactataaaattagcttattgtttaattattccacaaaagaggaatatatatttcagatcattttccattttctaaaatagcccttttcacatatttgcataactgcaagtatgtcttcagcatccattgatttactgattttatatatttaaaggcaaattttttaggtatatttgaagagccattggactttctatgctttcagaaacagtagaatgcatattaattataataataatttatatcaatgctgaataataatattgaactttatattacaattatggttccaatatgtatttcataaatttctaaatcttaatacctaaatagaatgctatgaggcactggaatgtttaatacacaactaaattttctttcttttgaaaatttgtcaaatttctgtgactcaaatttgatagaagagaattctttgacctactggttcctatgattcacatacgaagggtgatacctatgggtatagagcaaatgcgtgttttatttataatagcaactttgttttagataaattcagtgaaataataaatgtatatgacttttttatgtgaatggttaaggaatgattttatgtttcttttattttacctctttaaaaaagaaatcatgtgtttgagagtttgtgcatttctatcttcttaaatattaacaacatttctggatatatggttatagaggtttgcataatatttagtcaaatcagatttatttatatgtactttagaagtattctttttaaacagtattcaactttctctgacatatgcagctgcagcaaaaaacgtttactgaaagataccttggaatcatttgtgtacagagtttaaaagttaatgttgtcttatttaccaaaataaaataagaaaataaagatttgatagggccagaatgttaattagactagaaaatgcaactttttattctgtaaatagatcagagtgtgttaaagcaatctgaaaatctgaagcataaatgtagaaaaaattttaaacttctttactctttgttaactcatcaagttgaaatgaaagttaagtgcatttaaaggcattttcagtagaaaacagcttttctttgggagctgctgggcaaacatcctttttttaatgaaatagatattgtatatatgataaaggtaaataaatacagataaagcacttagatgaaaaaaatagactgcaaacactgttatacattcacttgtaggttcttaagtcattttttttgttcttttgttctgtaattgattgctagcaccccctttaacccaccttaaagggcaagcaggaaattcatgttttcgttcatcagcccatccctctgaaaagcgttcgatattaaaacagttttcaaggagcaaaagcagaggaaagaagaggcccagctagactgtagcaaggttagaagatacacgcaagattgcctgccacacacatcgggtcttgttcctgtccagtatttgcatggagatatcaagttaattagggtaggactctgttcttcgctttctatgtgaccttttattatatctgtggctctctagttcatatggtgtcataaagctatgggaaagtctttctagtgtttgacacaaactgcaaaagaaataagcattgatatttccctttgcctgaaggtttttacagcagcaaaatactgcagaggcaaagttgatattgtggtagatttgctgtgggtgtaagaatgtttcttttgtctttcggctccccgcttcccccgatgatgatcaggtgcgacctagagagttgtggagaggaatggggtattggttggggagggggtgcgggttagttcaggaggaggttacatggcggaattcccacgaatgctggcgaaggatgaaaaagatgaagaaatcttgtttttctgaacgagaggattctctgcatgacttccccactgttggggtgatgagctttcaggctgagattttattaacaattcatatggagattgagggcagtggaggagcagattctcacataaacttgatctgtccatgaatgcagttctctgtttgccctgaccctgcatggcttaagacactgcctgtgaggccagtgtgccagacacaaagaaagaaatgaaaagcaagcacattccaggagtctgcacaaaggagcccggccgtttctagtcgtctccccagagaggatcttatctctgcacagccaaaaacctctaaaatgtttatttgtgtacttaaagttttaaaatccatgtggctgttcattaagcaacagtcaatagagaggttttgtgaggttttaaaatgttgttttctgaacttgttgaaactggaaaaatatttgcaagggtacattttctgaagtttagctttagaagtcactggccttgagttgtttttactttgtcaattggtaggtagcctgcaaaatgagtcctttccagctttgggagaggccagaacaacatcttaaatcttgatttgacttcgtaatacatcctgacactgcaagctctgaaacttgtggcagagagttaatgcatgagacaaaactgacctgggatcacaagtggacatcctcacgctcatgatcacagaccacagtgttacattagaaaaactacgggagaagcaagtgcagagaaaagtttgagtgagaagaaagagtgagagaaactaggaacttttattataatgtttttacaattattggcagttcactatctctagaagcattataacaggataatgacaagctctcacaagacatttctctgtaacttaatataataggttttattgtttgacaaatgcattgtctgaaagtatgacatctttaggttcaggggataaaaactcgatatacataattctgctgctcaaatacatgtttccacagatacttaaaattcagaaaatccagatacacaggctttttaattttgcatatgtgtttagctgttcaaattacttcaaacttttatggttcattaattaaataaccagtagaggaatgtagacaaatgccattaattatgataggttttgttcctttcattttatagtggttttatttccatgaaattaactgttgtacttaggctaattgtcagtaattggtgacaaaatcacttcattgtttttctatagcatgatactaatgaggatatttgcaatattggcccaaccatgtgtgtattttaccttctgtgtttagtcagtggtagataatatcaaatgcaactttttaagagaaccatgagataaaacatttctattaataattaaacaagtcttttaaacagcctgtcataaattaattttaaaacatcgagattgaaggaagcttttattttaggtttagttggtttcatgaaatatcaactaattttcctgatttgaattgaattgttttggaatcatctatgcaatatcgcaattacaaatctcaactgcttagccacatgtatttttattattctatttgtgtaggcaatgctaaaattagcattgctaaacatgcttttgtgaggtatcacagagctgagtgggattgcctttcttttcacacctgatggttaaattctcataatatatagcaatattacttattcttgttttctaacagtattttcctgtttcattttgccacatgaaaatgtttttcaaaacattgtatttcaaatgaatatatatgaaacagttgagatcatgaaagcttggttttatgtatttttttcaacattaaaaaaatatacttccatgtaagtaatgggttataaagagaaaaagcagtgggagagtattccattttgtgaagtgagatttaatgccaatggcagaaaatattgcaacactacttatcccattaaaacaatcacagccaatactgctttgctcacttcgttccttaaaagaattcttctcaatagattcccctatgatttttatgaattcgtaagttacaaaagttttctagtactttgaagtacagtctttttgcttctttttcttattctaagatgcttttaccaatcaagtgccattttacagtttatagcccactctgtttgttttaaatgcaaccataatgtataccttagagctgagtgtctcccaatcatcctgaaaaaagtttttacaaagcaattagaaaaataattgcctattaaaaggtgaagattggtttgagtagggagagcagaaactgaactctgaaattgaaagcattcattgttagaggaaacatatgcaccaaatccaaaattaaagaaaactcacaaaatacgtatcttggcaaggggaattgtttgaattttctaaagctgtcagtccattttctctactttttttccggtaaagaaaaacttcaaatggaaagcttcaccttttgtacaaagttgaaatgttttattattgcagaattgttctacactgtacaaaaccagaacaattcaatagcttccggggggccaggggatggggaaacaaatgagaatctttccatcattctagaatacccatagcagagcaaaaataagtataaaaatctatggtcatttccttgaaaaaaagaatcttttgattacagcagttatttgaatacccattcaggctcttttgtgacatgtaataagtgctcttctcccaaatgaaaaatactcttagggaacaaaaatcaaacataaactacgttcagatgctgcatttcaataggtgaccccataggattaagcaaaggttatttttcttttttgcatgtgctctaaaaaataaattccccagagttaaattttgtttgtttgtttttcatcttactggtgtatttccaatatgttttcttgctttttgtcagtttcaaatatatagaatgtgaaaaataaacaaggcgggaactgacttcaagttttaagagtgataaagtattgtgaaagttacttagagaagatgatttttctctgatttatcctgccatattatagactctggagaatacaataatatggaggtttttttctctttcttgagtattctaactgttcaaggaaaatactagaaagaagtaggactctggtaatactatgagccatatccatgggcatctaaatcctgtagaaaaaaataataaatacagtttgcttctcacttaatcatacttgacaaccatatagacactgctggggccatcatgagtagcaggcggtatgtttgactgttttggccccagaagtctttataattgtaatcagtttcttcatcagtccatgctgtgccaatacccctaactagccatagtgtcattttaaaaattaaaaataacccacattcaataacatcaacaacaacaaccacccctcagcataaactatgttctctgtgtgaactcacagtacggagcagttgcatccaacccctgggctctgatttacttggcacacttggggttaatcaaattcccccactgtgaggtgcacacacatttagaggactataacacactctaatgctacctaactctgctgtcatttttaatattttcatgagttttttttaagtgatgtgcatagcagaaatagcctgactttttcttactgctaaatagagtgcccaccaactaaagcaaacaacaataaattaaataaaaaatgatcagatgtagaacatatttattccaagatagttttagtttctgttgcccaaataagtttcacattctatgaaacttgccttttcccaggggttaagctcctgcagcacttgagatagtgagcaatggcttcattaaaaaacataaagcataacaaaacgatgtggtaaaccttggggtgcttttgtttttacttattttagaatgtactaacaattttgtatgcctcacaatagaggcatccatgtataaagacttgtaactactcttattatattcacattttctggggccttaatttcatggtgaacaatatcaatctgtaactggggcaaatttacatgacatcacatacaaggcccagcaggtcaaaggtggatgaaacaggttcactgctgcatgccatgtgtcttacctggacaggcagccatcagctcctgcttcaggtgaccactgtctgcaggtaaaaccaaactctgtacattttgctcttagtgccttatgaccagttgttttcactcataaataatgtttgaattgtaagctcttttgctctggaatccagaagcaaccagtcactaatgatcattttgcaaactacctagtcatctaccagctaagaaaataatggcctctcactctcttttgtgtgtgtgtgtgtgtgtgtgtgtgtgtgtgtgtgtgtgtgtgtgttagagctgttagcattcatcaacaaccttagttgtccctaccaacataggcttcatcagaaacttttctttttttttttttagtagcaaagataggctacttaagattttatctccaagtatgaacatagaaaatataaaatattcaagctctaaatcatactttggatataccttctaattctcactttgaactacctgtgataagacgtgacatttatgttttgtcatattattcaacatataatttaaaaataatttaaaatcacatctaaaattttaaaagaacttaggcactaatatgttttgtagtcttacattattatttaaaataataaaagagtaaaattttatagagtatatttgtaggtacatatttttccttgaagggttacatgcaatggaaagaagatagattaagaaagaacagtcacctatatgtaattaaatttcaaaatgatatagaaaaaatttactggaatgaagaaaaaaatctgccttttagacaactacatggaaggtttatttttattttgtaatacggacttttgttcccggataacttgtaacaagctcaagatgtggagtattaaatgaattattacaacatatagcctagaagtaggaccgcattgtaaaccatcaaaggtataacacactaaaacaggccatgtgattgtggttaacgcactcatagcgagtgcaagcaaaccttaaccttctggatttttacatgttatgttttactctttggtttacttcttcctgtgatcaatacccgggcaaagccagagctcttcaggagaaggttgagattataacaatgtcagcttttgcttttagcggagtgatgaggttatcaataatgcattggagatcttgggaacctttgacatacacatatcacagctgccccacgtttatcgtaggacttgcaggtctgagctgagttgtcacctcatctgtgtttgagccagccattgatgcagtcagtctcaagtaatcttgggcacctagggaaagctgttgagattatttaactgaaacattgcatttgaggaagttatttaggagtgagaatacatctatgaaatggcttttattaagaagcttgttcaatattcctttaataactttttgtctccctagctcccttctaatgtttataagtcttgttgtttctgtgacaagtttattcatatcctaacagcttgtctggcagcagggttcgtgttttttacttgagctttctggtcacggtggtggctgagagtaatggagggggaataagtgggtgtggaaatgcaaagctgtctcttgttacattttatcgatctcattctggtgtcattcaattaagacagaaatgtgatggatagtctctgcccagattcctgggttgctctccatcccttgcagatacagcttttgtgttttattttgggggaagggatggggaaagggcacgggcaagtgagagaaatcaaatatgctatgtgatctgaattacaaatcagtgtctctctaaggatgctccaaaatgtcaaacatgccatgtttatattttcacatacacagagtacttctgttgatgtatgagatgggttactagaatttaagttggggttaattattgttgatttattttcaaagacctgtgagctaacatcactcttctaccagctcaagataattaaaaatgagccacatagaaaaatacttgagtccaactcatgccatttttgaagtttgcaaatgagaaattattttctcattttttttttatgagactgtgattctaagttgacctttctgcaaatagactttcaggctgataaaatgaaaatagtaggtatttttttttttagtttataaacaattcattctaattgttgcctatgttatcaagaagtgtactattgtgagtaaatttcagaatttaggactgtgtgaattctgatccttacccttgatgatgtattttcccttagctatatcactacctttgtttgctaccagtgttataatgagggttgtaggaattcatggatgtgagaggctctaaaagtaacagttcatgtatgcaaagttttttttaaaaagacattaaaatcgctactgcaagcacatataataaaagcaggatatgttcaacaaactcccttgcccttctcaaaacaatgccagattcaaattgagcattcagaattttctaatcgaggttatggcttctgataattaatccatactaaaagggagtatggaataaaaatataagcaggagttttaacattagatcaatatgttaatgtccaggctcccctatatactcagtatatgaccttgggaaacatgcatacagcctgtagtttaaccttaatttcattatctgaaaaataaatagcattgctttgagaattaggagactcagaatatgaaaatgattgctccatgcttatcctgtgtacttggcccacgggagacatccaacacgtttagttttattctgaatccccctttatggttttgacactgagtaatttggtcctataataagcttgctcagtcatttgggaaaggaatgtaagcaaagaaaaataatacacttgggtcctaccactgtgagtcaaaaatattccagatcctaattcacagaagctaatttaccaatctgtgtgattttttttagtgattttattaaaaaaactaattgtcattaaaaagttatcctaaaattttgtttatggaaggcactccgtgtgttttgtcttaatccaaatttatcagtgattttaaactatcatgctttcatcctaaaattaaagagaagctgctggttaaagcagttgtttactaattttacaaaaattatagggcacttggaaatgatttaggtgggaatttaactgataacccacattgtaacccactcaatagtgtagaaaaacacaaaatcttatgctgctggtatatgtcttgtaggtattgttaaaaactatacatatatatgtgaggtgggacctggctatctttatttttactgtttccttctgaggttgtaaatttttaaattggatgtttaaaaaaatcatcttcatgagacaaggcttaccagatatacatcaaagtataattgatatctatttaaggaaaatacatccataagacgtaggtagtaagtaaaaagtttttctacatgatccaaacataagacataattagagcatgtctgggaaaaaaaaggatgtatcctaaatattgcacatgacttttttcaatatatacttggtgtgtgctaagactgcttaatgcatgctttatgaaaacactaccaacactttggttgaagatgtaatgagaacaaatttctacactcacataatcattgtacactcagtaagcattactgcataatgaacatatttgtgtgcttgtgttgggaattaatgcaaaccattttattcatttcacaaagggtatgaatagttctccttgatgtgctaggataatgttataacttttcccagatagggtaggaattgcagtggtatgtttggtcattctcttatcctttgagatagttcaggtctaaatctgggtgtggggtgcttcttcactctcttggatccaagaaggtgctactgaaaagcaactttccaagttgtactacattccacagctaactgatggaattttaaatatttcataaggtagacttaaaaaaatcacaagtaactatgatttacagaatttatagaaacagaggctctagtttggggtcatacctaatacactaagtttcagtgttcaattccaggagaatacataaccaaatcatggtgacaatattgcctccccttaaactcttaaagaactcttttcgtggcaatttacaagatagttaagcaccagttgtcaatgatatatgtttttctttttaaaaattctttgctgcctgtagttaatattaaaaactttgttgttgtttgcgttctatttctttataggctttctttccaattagaatgtaagctttgtaaagtaaaaggcaattggagatgataaatgaaggttgaagtaatcatgctgaccatacttagtgcgctggagaaacagaaggttcctatattcgccatttttattttctgttcatcaaagaggatttaaaggaagatgccatcccttagaccctggcagttccttctcttcaacgtttaaacctccactttacattattgaactaacaagatgttctaggcattctattgcaggcaaggtatgaacaatttcaaatttatcaacaatcaaaatcatcaacaagatgatgttaagtttcataatcactctgcgcctatctttgtgtttgcaagattctgactggtatctacctccattggtttctctgtctttgtcttaatatctttcctgcatggctttctggctatagcagcatggtttgaaatactccctcagtagtccactaccatttatctcaaatagattgttcttttgaaacgtcaaagtattttttaataccttttttgttacagttacaacctaagacaacttcaagttgatattctccaaatgagactctgattcaatgaaatctgttctctctattagctcattttctctcaatctctatctctcttgcttttcacactttactcatctcttcctctctaattgtattggaaactctttagaatcctaacattggagttttggatatggcgggaatcttagtggtcacagacttcatctctgtgctttcacagatgaaggtcccaaggctcagaaaacctatgggagctcaaatctaagaggaagtctaggaaaggtctttgccctgtggaggcctctaggtgtcttactgagggtcaaccctatcatctggtcttagagtttgctgggcagagttccttgtcttatttatctttctgcccacagtgcctggcaccctggaggaggctaacgtatgcttgttaaaatagtcagaaaactttatgccatatctgaagatgtttttaacatatgatgagttaaatttcatcttcccaaatgcagatgctaattatgcgttctgagcatgagaaggaatttgaatgttttataactatatgttgataattttctctttatagagatctgttactccagaggaagaatttggggtcctgtttttctgtttctcctcagatcatttctagaaattagtattagcattaatattctcataatttttatattagaagaaggtacctccaagcttgttttctgagtaagatcctttttgagaataactgggtgtctgctacataaatttgacaagctattttggtggtgaaagtttaaacaatactctgctaagaatagaagatataccctcaaatcacacattgaaaaaggtagtccagatgaaacctagaaattcttcatgttgatcaaccttctcactatattcccaccgtagcattttatctttcctctcatcaaaatctgattaatctcttatgggctttttgttttgttgtgttttgttttcagtcattaatgagtataatgtcagccttttggctatcacttgaattacttagttgaatatttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgcgtgggataacaggcgtagagccaccgcgcccgtgccattatattaaatatggacccaaatttgtctctggcccccaagcacagcaagttttctaaaagattgctttgtcccagattgaattacgagcgtgggacagggcattggaataatctgggcaagtgggccattgagaataggggtaaagcaacacagccatgctactttcacctgtcacttgggaacaataattttggagtgtttacccataactaaagatgtctggaaaatatagacatgcacttctttgcttgtttcctgtcatgttatattgtaaagctcactgttttgagctaagccataaaaatcctcagctgggtccaagtgttccacgactgttgaatttggtcaggaagcttatttggtcattgtactcaagggtgataaaagtccttgaggattaactctcacataatcaagtttacaggaaaatcaacaatagaaaaaagaaaacaaccatggataaatgaaggatgtatatatttgttagctgatcaaaacattttctttccagtagaatagtgaattcaggaaatcatattagtgcttatatgaccattacagattataaaatcaaaataaattgtatacattaatcctaatgattatcaccagataactatcacctgaatttccagtcaagtgaggaggaatcaggagtctccaacatggttggcgggaaactcctttcaaatggactctgccgtcttgtcccttttttatcctcatgcgaattatcattgcttatgagtaaaataagtcaacggaatgcttggtatcgttcaaaacagataaaggtaactaagcaaaatatcatcacaaaagaacaagctagttagcaaaagaaagcatgccgcttatcagcatagatgtctgttcttgtcctctttgtttatcgatctgtctggttttattttagcaagtaacagtttatctagcaaagtttcaaatgcaagtaaaaaaaaactgtgggattagagtacctgtaattttgcttccagacttcacaaatataagaaaaagtccccaaacaactctacgattttgcaaactttctatattttggaagataggttttctgattttcttttatcagcaaaaactaatcaaagttgtcttaggtgagcactatgctcagtagagagtgatgtgagtgtacaaaagaccactttttaccttaagcagtttgcaatacagctaggtagaaagcatcttgaaatggagggaagactaagaattttaagtcagttctgaatgctaaaaaagtgatacaaatcaatcctcttcagaacttcaaaatagaattgggcatttttttttctacgtagcccagagcaatgagagaaagatatttggaggaaatgtgatttgagaattgttctaaaagaaagttagagacagacaaaccaacagagaaaaaaacatcccagagaactttgtatctctgctcccaatctcaggaccgtggagacgtactcatggatggagaaaatggacccacagaagattgcctcaggacatcacaggggttatctagagcaaaaaaaaaaggactaacattcattgcatgttctctggttgactttaatcagtggtttcatgatccaaatgaaattacatgtctcaatgaataaatatgtagctataatacaaaacaataggggcacttttgtattttgggcaggtgggtgagtgaaagtatgtagggaaacattattttcacatcttgtatacattcttgggaggtacctatctgccaacaccctttagatcttttttgatgtagactaaaacattatacattcaaaatgggagagagatgtataaattgtcataagaagtaatgacatgtgtgaaacaggcctcatattttcccactcatctactcctgaaatcctgctcctttccaatttcctgtctcagtaaatggtaccaacattcacccacccagtaactccagtgtaaaggcaaggtgtgatagatttctctttttttctgacactcacattctttctatcctcaagtcttgccaactttactttcaactctgttccagtacagtcaattccccatacccccagaactaccgctttttctgaagccactgtcatctgctacaatagccctctaactgatatttctgttttcattcttctccccctagagttaattttgctcacaccagttaaggtgatttttcaaaactgtaaattagataaagcttttctatagtctctcattagaagaaattttaactgcttaccctcgactgcttgagcctacattttgaagctgctgcgtatgtgtctggcttcatttcctaccactctcccttgcatatcatgtcctaaagacactggccttgaagatgttcctctaacgtgccttaatccttctaacctcagagactttacacttactctatctgcctgggacactcagccttcatatgggtttctctttgttacattcaggctaccactaaagcatctcttcctcagaaagacgttatccagcctcccaaccattacttccaactcattactctcatctcattatcctcatttgtttagcatcatggtacttgtcaatacctggactcacattatatatttctgtatttgtttgttgtccttttcctaacataagtccaataatagcaaaggcattgtctcttttacttaaccccaggatctagaagaattcagggcacaaaagaagtatttgataagtatttgttgaatgaatttattaaggaaagtgggacatagtttgcaagactttatctgaaggagtgaaaagttattttgtagccaggaggacctggattataatctcattttagacacatgctttccttctggacttggagaaatcactaaacaccccagttttatcctataaaaaatggaaattacctataaggctggtttgcagagggaattagagataataaacattatcaacacaatagttggccaataggagatgtttactgatagaataataatacaatagtgaatataagtgtaataaccccaggaggctgagacatgagaatctcttgaacctgggaagtggaggttgcagtgagtcaagatcgcgccactgcacttcagcttaggtgacagatcgagactccatcacacacacacaaaaagagtaataactcagtgccccgaattgtagccaggatacttcaccaaagaaacataaaatataaacacccaccccccaactcttcaactcattatcagtgacttctatcagactcttgaatatgcacccttgggaaatggagtaagaaccatagcttaaatcgtttaaactcatatgggacaaaacgatgaaaatatgcaagagggaacaatcttacattggaaaagaaatcaagccaatgacccaatatatctttttattatttcttgggagaacctgtatgtttaattcatggaattcttcactgtttctatgttgaaatacacttatgtgaaaattgcactcctattaataaaataggactttaaaaagcccaaggattttagtatcgaaatgtttctgtgcaatatattaacattcattgactatgtgaatccccacctgtacttcgtgtaaattaccaaaggtgccctttcctctgtgcacatgacacgtgtgcccttgccggtgtaattggactcatgcttagggcttagtgagaagagcctgggctatatttcaatctcactcaccaccctggccaatctccctttcacagggctcagtccaaacaaccatatgcaacatcctgtaaatgttagataatgaatacaaagacagaataagattccaaatagagtgaactgaagatagacaaacctcagctatgcctttcttccatcggaaattttgaacagcatgtagaataaaagagacatgtagtttctctgacagaaaaagcaattacaagcatgtcacatttaaatgtggatcactgattattattgacccaaactctaaaaaagcactattgtccaagtagcatgcttgtcaatattttaagcctaaaaactaatttgacaaagttgtagtaagcttagggtaggaaagggaggagttcatcaggaactgagtaatccctgctttttagagaatacctttggttttaaacttaattctaatgattttactgagtatcctctcctctgttggacatttcgagttgtagaaaaatgtatgcaagcagttttggaccttatggaagcaacacttaggagcaccatatcagtgtatgagtcactgtaaaacagaacacagaaatacagaagccatgacaacaaagaaagcaggtccaaggaggaaaaacctacatatcggcaggtggatcagaaaagttgcatgggaaaagtggactattgcattggaagcctgtaaagggcaggaccactctgtcatcttaactagcttggtaagcagatcctgggtttctgtattaaagctggtcctttgaatgaatgagagcactaatattttcagctggaggaaaacaacatgaataaaagtaaaaatggaagagtgtagggcctttttagggaaagtagacaatccactttggcaggagtgcagggtgtatacatggaaagatggggtgtgagttgagattggaaagatacgaaagtgttcacctgtagactaggttctaggggagtgtgttgtttttctattttcctattgttttccagataatatatttcttttgaagtcttttgaccataatcaagcctataatctatgaagaatgaattgccatatgtatgtagaaggtatcatttgagtcaaggagtgtgagaatgatatgtaagaggatgttcttatgtaatatgtaagagaagcaataaggacttaatgtgagacaaaagtgaatataatgaagatgaagttttggcatgacttaggaagtgtttgggtgaaacaacaacaaaaaaggaagcagaagggttaaagacaactgacattttgtgcctgagtaaatggaaaaatggtgtcgagttaacagattaggtaaagctaagaggttttcctagaactctggaaatttattaaatattttttcttaacgaaaagtgtaaactggcccataatgtaagcaaattttgactgagattcatggtagattcttagctcttttataattatttaagtaacattaactcttgtttattcattaagctccaagtcatcttatgtagtcatatatttgtgtatatattcctgtcttatcttatgtaatgcaatcagatttgatttgcaaatgtaaatgaactcatgtatttaatcaagaataaagacataacactgaataacagcccttaatgctggtatttgaatatctttctctttcagagattttgtatacatataccccttttaaatgacctcacattgctgatttttaaaatttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttttgtatttttagtagagacggggtttcaccgtgttagccaggatggtctcgatctcctgacctcgtgatccgcccgcctcggcctcccaaagtgctgggattacaggcgtgagccaccgcgcccggccaaaattttttattttgagataattttaggcttacagaaaagttacaagatagtgtacacagtttttatatacacttcaccttgctttcctaatgttaacatatgatgtaactgcaatccagtgaacaaaactaagaaattaatgttggttctgctaattgactttaatcctgtttctcaatcacttttataaaaatgaaacatatataaaaatacaaaactagctggtgtggtggtgcttgcctgtgatcccagctatttgggaggctgaggcaggagaatcgcttgaacccgggaggcagaggttgcagtgagctgagatagcaccattgcactccagcctgggcaacaagagcaaaacaccatctcaaacaaacaaacaaacaaaaaacataaatacagagaaaaataatatagtctactatttatgggcttggaatgctattttaaactttcagacaatgagaactaacatgacggattgtactctaaattgttagctaattactattaacacaacctacctcaaatgatcttagcactctgtaacagtctccttttgtgctatttattttaaattccaacaactttgaccattatagctgatgtaaatgttttaagtaatagattgcaaaacaaacaaaaagaaagctaaaaaatctgagaaaatgtattgctggatgtagaacagcaagtgtagtagaggctggggatactatcaagaaaatggtaatgaagatagtaaaaacagatcattggcaattaggaattgatgcaaattctttgacattattaagggaaatagtcatgtccctggaggctggaaagagtggccaacaattctgcaaggaataggaaaggaaatttaggtttggggaggactcgtacgttcctcgaatagaaaattctggagatgctgagtttccggcctggcatcaacccactcttgttggatttccagccttattttactatccacccttgttaaattccctcatccacccaattgctcaggccagaaacccagatgtcatacttgacctctctttctgtaattaccccaatctcattgatcaacaagtgctgttacttttacctcacaaatatatttttaaaccatcccattctgtttatctccattgctaccaccctagaatgcgacactcttctctcacagcagaactattgcaataacaccccaaatgttcttcttcagtttttaatccttctctttctctatcctctttcccatagggcaatcagattgatatttttaactcatagatctgataatgtcattcttttcttaaaaccttccgaagtcttttcattgcacacaaattgaacttttaaaagaggtgcaaatgtcctgtattaactggctgttggtcatccctcttgatacggtttgtctgtgtccccacccaactcgcaccttgaattgtagtttccatgatccccacgtgttgtggaggggaccaggtgaagataattgaatcatggggccagttccccccatcctgttctcctaatagtgagttggttttcacgggatctgatggttttataaggggcttcccctttggcggggctctcattcttctctctcctgagccatgtgaagaagaacgtgtttgcttccccttccgccacgattgtaagttttctgagacttcccagccctgcagaactgtgagtcaattaaacctctttcctttataaattacccattcttgggtatatctttattggcagtgtgagagcagactaatatacctctcaactcatcactccttttgcctagatgggatctgctgcaggcaagatattcccggcctcagaagctgaggggagaaccttctgttcttccccaccttcggcttgcattcctccttcagcatcttcttaaggacagtttctactgcacagtgatcaaagttgcagaggggtgaagtgtggatatccaggaacccccattttactgttactgtctttactgcactttccactatccagggagggtagtttatgccctttgggtgcttttgggtgcgtatcagaggaacccactgggaacattcgactgtacttcctatgtgttgggtaatagagtttcctctcattgtgtgtcatcctcagctcacctttttagggatctattccacacaactttctcccttatgatgtccagtatccttccaggtgttctgttagagagcttcttttcatgcttgggaacacaaatatggctcacaggctatattcatctatttttgcactgacgaattctgggaatttaagcagattatcaacattgtaggaagctcttcttgaatcgaaggctgaagcagttagctaatccaagtgtgacatttacattgtccaacaggattcaaagtcaattccactctgtcttcaaacttcagctccccaagtggtcctactgaaatctctttcattaaaattgagtggaaaggcaggcccaatgctccccaaagaaatcttcctcagaaaaccctctcacgtctcttcatttcaggccttatatagtttcaatgtgttcacagccacctactttgaaattcctactttgccacttaatacctcctatataatggtactccaattaaacacttttaatgtaatgcactgatatatacccaaaataaataaaatcttatataaagtgacaactttaactctgattttaaattagacttatcaaattgaacaccaaaagagcatttcagtatgtaattattggtacagatgacccatgtcaaaaaacttttaaattaaagccaaagtatctaatgcacttagaaaagtggaccatcgcggggcgcggtgactcacgcccgtaatcccagcactttgggaggccgaggcaggtagatcacgaggtcacgagtttgagacccacctggccaacatgctgaaaccctgtctctactaaaaatacaaaaattagccgggcgtggtaactcacgcctgtaatcccagcactttgggaggctgaggcgggtggatcacgaggtcaggagtttgagacctgcctggccaacatgctgaaaccctgtctctactaaaaatacaaaaattagccgggcggggtggcatgcgcctgtaatcctagctactcaggaggctgaggcaggagaattgcttgaatccaggaggcagaggttgcagtgagctgagattgcaccacggcactccagcctggacgacagagcaagactctgtctcaaaaaaaaaaaaaaaaaagaaaagaaaagtgggccatcaatattaagtacaaaattctacccttaagtgtattaagcattctttgtagctttattttcatcttctacatgattaaacataaatttccaagaaggggtacatctgtaaattagactttgtaaaggagcaagatacttgtttcgggagaagttcagtaaagggaagccaccgttaaaaatgtcaactattgtatatccatggtaagtttgaaacatgttgcttttaatcttgtgttctaatagccagaatttacagtgctgcaacaatttgtttttaagtggctggaaaaatgtagtgaaacttgttattaagtatcttatttagcagaaacaccttgtaatttgtcttaatagttgtgttattaatttcttatcctgcttgggccacagcctattcagaatgatctgaactgcctatccaatctttagagcatttaatgaatacattttatcttcccaaaagagatctaaacagttaacttaaaaatttttcttaaaaacataaattatattataattgaatattcttggttgttaagtagaaaatagtatcatgtctaatcgtaacataaagaagcagcatacatgtatgctactcaattcgtttagttgctagtatactgaaactacttgagtcaatccttttcatgtataatatgatgcccttaaattttgtggttgaatacttagacaaaacatagaattaaaggaaataatatcattggtgaattattttgccgtataagtaggtaaactcagaggacacacctgttcttgactgagaatgttaggtatatatttgctaccagaatcacatacctcaaccaatagccaaattgacctgttagcattaacctataggaaggaaatggtttcatttgctcttgagaaaaaaatcataaaccagtgtccgaagtatgcaaatttttcagttaagcaaaatgagaagaccagattattcaccaagtaatgccacaaggattgtttatgatattgttaataattattgcctaatatattgggttgcaattgatggtcctcaaatctaaggagattttaaaaaatgttatatcccacatctcatttctgagagatggtggtacctcgggtgtctaatgccttgggaataagatcctagcctctcctaatatgctgagtgcctttctgcctttggtccctcacacaagctgttccatctagtgcagaaacctggtgtgttctgattcccataacggggtcattctcattttaaaaactcatttcacgcattgccttctgttgccttctgaagaccttttctcctggcctttcctgaccattctgtctatgcaagaactctttctcttcttcattctcattattctctatcatagcatataatcctctgatcatttaaaataatccatattgcgtttttagaagcttgaacattgctaaatagatatatagaaaatatatgttgaatgaacaaatttccttcaaacccaggatagcataaaggcaattaaaaaatgttagttcggccgggagcagaggttcctgcctgtaatcccagaactttggaaggccaaggtgggtggatcactcgaggccgggagttcgagaccagcctggccaacatggcgaaaccctgtctctacaaatgtacaaaaattaacctggtgcggtggtgggcacctgtaatcccagctactcgggagactgaggcatgagaattgcttggacctgagaggtggaggttgccgctagctgagatttggcactgggcaacagagtgagactctgtctaaaaataacaataatatgttacttgaatgaatgattggattttagaccaaaggactatttgatgtaaaatgttgtcaatgtctatactagtttatgagttacttcagaaatgtcttttgagagcaaggcctctaataaaacatcatatcccccaaagaacagttgccaatttattgcaagtttttatagcttattatatttatctttcaaaccatatatatataaacatatggttgttatctgactgtctggaagaaataatgctctctagaaatattgtcatgttccaactttcattcaatgttttttaaagtaaaatatgcttagagggcaatagttttccatttctagaacaagtttcacaattatatgtataaattgaagtgtattggcttttgatagcaaaagctataatactacaaatgtctaaattgtattttgacattattaaatataaattgagaagtgtgaggcagtgcactgggctcaagatttgaacttgaggctttgctttaaagaacaatataaactaagatagattttttttcctaaaatcacagtgacatgtattttcttggattagtgaacagtgtggctcatagatggggttttacttttagtccaaagcaacaatgaaagcatataaagttttcattgcctatttaggatatattataagcatattcagcatggggctataattttgtgacataaaatattatttataaagtcttgacatttaaaaatagttttaaacactttctttaaaaaaaacattaactcaagctcattacttttaccaaaatgtagtatagctaatggaaaagtaatacaaaattatgttaattagattgttttaaaaatcccttcaacatggaaaagtatcatgttttatgatttgatatatgaaactgagcatctgtgaacaaatttaattttaaaaagaaaagtaaatcatatttagccctctttttttcaaatgttagagaaaaataaaaaagctgaggaaatacagctagtgatttctgatcttcctttaggaaatcctgacattccagagaaacttggatagactctgaaggattaacccatttctgacttttcaggaagtttatctttcatttaaaaggatatctgatggggtgggatacaaaacttaaaataaagaatatgttaaatgccatctcagggatgcaagtttaacagcggtggtattgggctttagaaacatataaaaacatgacattaacataaaaaaattacaaaaaaatattaaaatgagcatataagtgttttttgtttgtttgtttgcttgcctgtgtataaacacgaaagtggtacatctctcatttaagttatggcccatgtacttgaaacaatttttttgctttctaagtgattgtataatgaatggcctaagctaacatttactttagcattcactctgtcctagtctatccgtgtgtcagctgagttactgtcagaggcttgcttggcttgtctatctctgacctctgcattctgaatttgctctgatgaagttttgtggcctagagcatgatttctgcaagtcatctgtgagtgtggcgcctgctcagtctaaggactagagtctgatagatcagagagaggcaagaatagactcagatgccgtcagttttggaggccaatgaaaagaaggaaacaaaactgaacagcagctgtgttgaaggctgtgcaaggccatcagaaattgggttcttgaggtggattggaggagaacagcctctggatgtctgctgggcagtgacgatgtgtctggaggctttgacattggattcattaggcattgctaatgtacacaaaaaatgtagcaaaaatgatgcctgtttctgggtgagaacatctggagcaccatagaagatgtgggagtaccttcacgtctcaggcattatccataggcttcgcttgaaaaaagttcagtttacttcttatcactagaaagagagtttcactaataatagttattataataaacagattattaaaagatgacagagaaatgtgacattataaggttttgcagaaagaataaaatattaaagcaaaatttgaaattgtttttctaagtggataaaacttttccaaactccaaaatttcaggatcatatgatttgcattaaatgacatagatttttttaataaaaccaccaaattatttaatttaaatttgaattattcctcatctatggaaggagcatactgcattttaaataaggaatatatttcaatattataactcagagagctataaattgtgattttcttgaagacattcattacatgttggagaaaatcatgagactgtaaattgaaatgtttaaaactgatgtgaaaaaggaaaaaatccttatttctaaaataaagtgagggaggaatgggagacggtgaaagtatataaagcgtaagaatgaatatgttccggagatctattttacagcatggcaactagttaataataacgtattgtattttgtactcaaaaaattttacaagaatagatcttaaaagttctcaccacaaaaataagtatgtgaggtgatttaatcattgtacaatgcatttgtatatatcaaaacatgagactgtatactataaatgtataccatttttaaatttgtcattctatcttaataaagctgggaaaaaataaaataaagggaaaataaatcattgaaccaccattagtgttggtatacagtggattatctgtgctttctaataatttacatatatgaagattatcttacgtttagtgcttaaaaagaatttaaaatagtgattctattatgtgtaaatggagtatacagtgggcatatttcttttgtttactgggatatgctttgtgcaagaaaaaatctagaagcagtaatcttggtcattttgatgtaaagtaagagtaatccaaataaagtcattttgctgagagatgagaggaagctggtattttaaataaaggatttcttatgctaatttcaaggtagaagttttggtgtgtgctaattttgcttgaaatatcaaaatggctatgtcatattagattaaaaatagaattctttctcctatggtttttattgtttaaaaaggattttttaaaatgcagcttaaatgaagagagtactctccatttttggttggatcctacattgcaatactcatttaggcatatttgctttaaatgaccaggtacactaattaaaaagaaaacaatttaccaggagctgtatcaagtacagccctgcaaacggtataagctttttccgagaatccatattgtccttggacttggctgttgtattatactttaaacggaattgattgtatggttgtaatgaaagtagcagattgatttttatccagtgttacaaagagtaaatagaaaaatgttcctgtcttgacctgcattcgtaaccaatgggatttgctggctttagacccaatctttaataagagataacatgcaaatgtaataaaactggcttcgaagtttaaggatcttttcaatgctcatcaaagatgtttgttgaggcatttaaatgtgttgtattgattagatcacaatcacctaggaaatgttactttctttaaatgttattcataatttattatgtaattagcattcatagagttgtgcctttatacacatattaagattattgaagtgcgggttatgacacaatggtataccttttaattgtccttaaaattgaattgtcttttattgttatttaagcaaatgatgatggtttaatgactgattatttgtgagtaaatttttacattgcaaaatattagagaaaggtgtaattggcttactatagcaggatattgtagcagtgtttcttgaagggtctattcctgctgaattcagagttattgcattatttattaaaaactgaaatacttgtttccaatagtgaactcagtcttttttctccaccttttcttggtaatttagaagttaaccaaatatgcgtgttatagttacattttagattctaatttttaggacttcatgagcctctattcctgttcatcattttgtaaacagaactcaagcccacaaaacaaggaatttaaactataaagtgcagttgataaatttgctttgctataaatgaagggatgcaaaaaaaaaaagtaacaattcatttgtaagcaacagtttcttcacacattatgtgactttttttggatttgttttatgttttgggtaaaacagtttagtataatgatgcctaaatgagacaaaacaaaataaattaaaaaacaaaacaaaaacaaaaactaacacatttgactgccgatgtttctcagttgtagcttccaagagctctctattcttcccagcccacttgataccctgcaggttgtggcagacaattcacaggaaaagcttagacatcgagcttgcacgcttcttgactccattttaaaccttttgttcacaccagggtggcattttttcacaccgcatgtggcagttttgactcctatccaacttgtcttataaaatcaaagtctgtgatttttacattcacggggctgcttcctgaaccgctactactgtttgtgtctttcctagtgattggtgcagaagtttatagcaaaatgtgttttagggagagggaggaagaagaatgcaatatgaaaaatgttctgggcctgaaacacaggaaataaattttgaataaaacagaggttgactctgaaaagatcatacccgaaataaaatacactggcctctatttctattattttttgcagcactatgctgggtgttcaggtaaattctttatggaaacaatacaatgacatcattttcaggttgcatgatgttatttttaaaaagctgtcatgtaattgcaaaacaaagtcttatcctcagagccgtacagttattttcttatataatattttataatattcagtgagtgcaaatgaattttacttttagataaaaccatttggtatgctccacttaactatgaacaaaacaaaacctattattttaaaaatctatactataaaccacacatttaaacaatttcaataacaacatcatcattcggaaacttttcttctttcccctatgtttaattaaaaatatcacttcagtcatttatactttctaaatataagttgtacagctatttcaaataaattacatgaagaggatagtcataaaataacaacagaagtgaaaaattttaccaaataccaaagtaggtaaattggctttcttctgtaattattaggaagacataaaactatagataggaaatctctgcagacaatctgacagtaatcgctatataaatctttatatttttcctttgaaattcttattttgttaaaatatcatcttttagttgtgttagcaaaaacataacgaaagaatattctaaaatatttgcaaggcatatgtttaattcagttatttttttgtgtagggaggacagaggaggatttctgctttcatcaacaaatagaaaatcataattatattattttttatatttttgcaagttatagaataagcactcttatttttaaattactactttttaaacattaacaattcattcaccaagaaatcagtcaatagaagtaaatctttatgaagtaataagtatttgtgaacagtggtaaacttcaagataaatattatgacgtatttaatttagcttttagctacaaaaccaacttaatgaaatcatttcagctaattcaaattgtataattggtatatcaaaataaccaaattattgtatttaagaaaaaaataacaaatagttgtagattatagtcttattcctccttccagggaatacctaattaaattaagtgcatttgaattattcattacaatatttgaaatatgaaatggatccaataaattgagaaagacttcaatttagaatttagattttttttttaaactttctggacaagaacatagggaaatagcattttgttgtaagtcttgtaacagtaggcatactagcagacagaacaactgtacactttccctttcacagatagaaaactatttcaactacaatttctataaagtattagggaagaaaatacaaacaattttcaagaataactaaatccaaatggttaatgtaagtaaaaatctatttaaaacaaatgaattgcaataaatgttatagtctgggatttctttttattatgcacagatatttatcaagtacaagtttttgcccctcttttagttaatttaaaaatttgacctcataagaaatagaaaggaaaatattttttgtatttgcatatacaaattttataaagatcaaataaaatccttgtcattaaaagcaaaacaaacaattgaaagcaagtgaaatattcaaataaacatatacgtatttaacccaagtttaatattaagccctcttataaaactaaacggcatctagagatctcacaaagcatttgaaactaaaaatatgaaaaacaaagaaaatcatctaaagaaaggtaagtttatgaaataaaatttacctacttttgcagctgttgtatttgttgaaaaaaagtatgactttatttcatgtgcatgccaaagaatgtagaaatactgtatatttagttcatcatttctcattatctagtatagaaaacccacaacttttattactttaaatttcttattttctaccctccccgcctatgccctcgatgtcttcagagtctcttctggccagcatatcttctgcttgaggtggatcaaaataaagcccccaaacagacacacacaaaataaccaccatccagctgaggagaaatagtttttctgcctttgccctatccttatgtgttaataaaatcagctcatacattctgccacaaaattcagcttggaagtaatcctctgctacttagagctggatgaaaagagtactcattgtgaattatgtttcatctgtcacaataaccttctttattctgtcagggacctcccctttgcctgtggcaattagagaaaataggtatgcgttgaagtatgaaatagtgggttcttaaaatgaaacaaaacaaaacagaaactgatgacacatacagacagtacttgctaagcaatatactgcagattagtagaggaggcattttaaagtcattctgattttacaagaacacagtaaaagaatgctttttagaatgagcaggtgttatagttgctattagttattgtcaacattagttattgatgacaagctgtgaattgtaattgtactaaaaatgaaatgtgaaaatctttttatattgtgtactttctaattaaatcatgccataagatatatatcataaatatatagtatttatttaacatatgaaatcgccatgattttatatgcctttcacagatcataatgaatttatgtgcttttgagtctattttaatgctccagaataacatttttgcaaattttttaatgggcaaaaacaaagaaaaactttcccttgaaacagagcttatcagacaattttgtttaatttaaaatcaatgtgattatttgatttacttactcttacaaatcactgaaattacctggaggcagttcaagttcacctttctggaataaacctgttaaatgatagacaccatctcattatctccttgaaagaacacctcaactttttggcttcataggttacagtcaaagttatactatctctagttacaaatgaattaatctagaagatcttaaaaagcttaaaaggaaaacaaacatagttgacagaaaagaaaatgctccttctaataccaaaagaaagtcactgctgacgaagtaactgaaacggtcatcgtaacagttggataaagacatataaataatttaagctaacacgaaattcataaagtctgaagaaaaaattcttgaggctaaaaggaaaaccttttggcccactgcacaggttgggcacaaaagtgcttgctaagctatctatttcacacatgcaacgacagaaggttcgatattcattcgatcgatgagtgaaaaggcacaatggcaaaatcagacagacttcttttcaaatacagatctccaatgtccccctccagtctgcagatgcacggctggtggtgtggctcagacggagcaagggttacatcaaggctattctctggaccgtgcaaacagtctagaccaatgacctgcagcatcatgtcctttgaagaagaggcaagttcggtcatgatgaagaaaaatcaaggcgtaccccttttaacaatagggagcagctcgaggctgcaaagaggtaagcagggtgagaagaaaacggcatctgcttccatggttacaggccaactatgagaaccttgcttttcaaaggagtctgttctcaggctccctcacagggtatgtcatgcattataagcaaaggcaggttgagctgaaatccgcatagttatttcagagtaaaatgatacggagcacatggctggcagaaaaaacagtcacatgactgttaagaaccagacttgggctatttcagaaaagattttttttttttcttatatcagttaaagaaagacagtaaatttgtataaaacaaacaaccatgataaacatgattttcatttctcaggcttttatgtgagcagaggtcaagggtcaagacacccctccactccaatggcaggaccatacagcttattgttaatatagctttattatggatatcattttaaaatattttcctcttttgggcggaccataacatagaatttgtgttcttgtgaaatttctctctctgacctgattctctttgatgtgctccccaggattttctgtgttttagatctcatgttcatttccgttgttagatctcatgcggagaggtagaaggtttggtgagaaacttccttgttgtgtggttactcctctaagatagcgcgagcttgcctctgcctcgtgaaatctgcttatggataattcaaatctgcagcaaaatcattcgcctctgacaatcgtcctgtttctaattcatgcctttgtagtttattcgatgtgtaatacatcaatgagtctatagattctaatatcaatgtttttttcttttctgcaagataaagttgaatttcataatatgatacactagcagctaatgttatctgaataaaaatttgacaagcatgaaatgtaacatattctgtattattaaggaaagaccatagtatatagtaaccacacaaaatgcacacatatataaaattaacatggataagacattcctctgacaatgtaccacaactcaatattagaagaattaatattgggttatgttctaactatgcacaattaactacagatgttccatgcagtgtatcctttgagcaatttttgtttgcaagtatattgttaaaattagggagtgaaaaaggaaagaatctttcaaaggacaaggcatgaaaacaactttcattaaatttatttttcagaatttatgtattttaatataaatgggtaccatatagttttgtgtgtagatattcatttcaaatactgaccttgtaggaaaatatccttatagcttcgcaaaagcaatgaagtgttggtgatcatggtagaaacaattttacgctttcaattaagaaaccagagaaatatttgctggtatgtttctcatatagatgccttgatttgagttgggttcatgggcaaacatatgcttattgtttggtttctttgaatgtgttgaggtacattagtttctattcttgcatggtgagaataacttaaggtctaaaaaaagtgagctattggaatgtcactattatagtataataatctatacactagtataagcactgaatgtattatcttaaagtagccatgttctatttgctttaaataatttacatactaccaaaacaattcaacatcagagtttctttgatgtaacaacggatcacactttctcccaaaggtcaagtggcaaatatttctccaatgaaaaatctacctgtcagttctccaaaggaaaacaaaacaaaacaaaaacaaatacacgaaggtttatacattgcatgataatttgtgagttgtgattaaacggaattgtgtctattacctgaaatctgttgcaaaatagatagttggattcttgttattttttcagttagcatttagcctactcctgcttttttgtttttcaaaaacatgttcagtgttaggaatatttacatgtgaccataaattagatgaacttgctaagtgtggacatgtttaaacacttagaaacattctaatagagtcaaattggtggttcataaaatgctattatttaaacatttaacaaccaggtaaaaatatttaatattgagtatttagtgggaaatgacagcttcttgcctttaaaaaattctctatatctgagttatcaaatagctgtgtattatgtacatcctgcatatagtttgcaaaacctccactcctaacatgtgttagatttaaatattcctttaaattacattttagattaattattgagttttgccctcctcacttcaaaatttgtttaaaaaaggaaaactaaacttggccttgcctaatggagcatttatccttaaacgtgaaaaaagagtctgaaatgtttcagtgacttagtgtcccgatagtgctctgaatatagtatatgctcaataaatacctctctaataaatgaatacaactatggttgcaccaatgaaacaattttcagaataatccagtctcatgaaaatcaggaaatagtcccttctatttattcatatatcgtttctaacctttttcgtatgaccgttctatatgcatgaatccttcttgtcagtaatttgctattagtaaatgactactttgtgtccagtatgactagaagtgtgtgcctacagccacatttcccaaacaaggtcctgtgaagcattattattctgaaacatgttggaaggtattctgagggaaaaaaatcaaagagtcaaataaatgtgagaaagatgctatgttaaacaatggaaattaggtttcttatgtacaatagattttaggacatttaaaagactaatgtatatagtgcatacctaagaagggtgtatagttgacatcatttcacagaactatttaatcaacttttttcagaaaatacttagtaatgtaatatgacctaatttcacagatgtgctcaagctggcttaagccagattgaataaaccaattttaactatctcttcttatattccattttcagtgacatcattttcttagcttgaaatcagttgtggcaggagtatttgcaccatggaaatcagcaaatgctataaatcagggctttttttctttttccttttttgagactggttgttgagcatttaccagcacagcattgcctcattttgtctctgaatccatttttgtaggtaagctgtgcactaaaaggtcagtaagttcagaggctttctattcatcagactgtctaaaatacaaaacaatttaaagcaaattgtgaacattagacataaaagaaagggatagcattaaaaaatattggacactcaatttttcttttaagatttagcggttatatcaggatttcaaagagtttatgtttctgatttctttaaattacctggataaacatctatgtttattcatttatcccttttctatcaaaacatttacatacactggtatgtaattgtctaatcatatttaagtgagttctcaacatgaaagctctgaaaatctccagacatcctttaaaagtgtctctaactcagacccacttcatacgaactttgagttcgtataatgctgagatgaagcatctttaatcaggatatacactttattgcatatcatgtaatttacggcattttatcagacatgtttacctgcctgacatcttgggtgagatttttaggagaaaaacaaaaatggaaaatctatgaatagagaatttgaaaaacacattttaagtgataaatcaattaattcccaactaatcttttacctactaaatttctgtgaataggttaacaagtaaaatctgtaaatataggtagcgtataagtatagatattggctaaataaaagatgtaaaatcatgaatggattcttccttggccttattgcttgaagccatgagttctatggtgacatgttttgaagggcctctggaatctactttgtgacagtatatgagatgatttatatgagggttctaatttaccttcccaaacccaggaacccaaagcactaggcacttcagtttacagagccctcaaattaattaatccgagtgtctattttgagccaagttttgtgttatttatcagaaactaaaacatgactaatacatggtttctgtcgttgtggagcccacagtcaaatgtgagaagaaagcagctgaaatgtgttatcacaagagaaaattttctgaatataacagaatatatatatatttgatctaaagtgatatatctatcaaatttaaagtgataaatatatgtgtgtgtgtgtgtgtgtgtgtatatatatatatatatatatatatatatatttaactcccagaattcttctggtttaatcccagaatctcatatactttttggattctactctcatcacataataggtattggtacatcacagagagctccatattcacaaaacattaatgaatagtacaaccaagatggcaatgatatgatccttaatatagtcttgagtgaggagtaagtacaggttgcgttacagaatcttgctgtccatcctgtttgtaaacatagggaagaatttcacataacgtcaagattctcaaaggatacttcactattaaagataaatacaagcaattctaaacccagtgaaaattctcacagacattcagcttagataatactgtatgcctgtgtgtttatgtatgaaatacatatttgaatactcattggataagatgttctttgtatttggaaaaaaatcttttggacatactaacattatacttctgaaaactctgaagccaatataaagttgtaaaaggctttacttttcattatatcaaccacgctggaaattcatacacaattttatcactggaaaattttcttctctgtgccataaaacctggaactcttctttcaaacagcacctcccaaatttgaaaacgtattactgtaaaatatttatatatgaaaggtttttaaatgaattattgaatgtcagatatttaataaaaatacttttgctatttgatagataaatttataagcactattatctttcaattttagataaaataattttatatatttttaaagaacatatctcacatatctctgctcttgataacaaatagtgttttttttttaagaatttctatctagaaaatttaattcatttttctgggcctagttcaactattctctcttttgtatgtctcttctcactggactatcttctctttctatctttcccccttatatatactcatctgctcttcacttctgttccgcttatatttttgctaaggtaggaacaaataatggtaataaataggtggcaaagggaaaattttaaaatatatacagaagatctttacattggaatgctgtagtaattgagtctaaaactcagctctgaactttgaaccacttttttaaaaatgctgtgtttgaaccttaaaaaatgtaaaataaaaacaatctccctcccttctgaaaggggaaatgaccttcttactcctgtccattcttttatctgagcaatgaggggtgaatgtgtttataaaaagccatgtttaggctctatattgccctgctttccaaaaattattgtttgtttttactaacataagatcacccaaagcaatttcctttaattagcatgtcataaccttcctatttttgttgagtatcaaatccatttgacttagccatggtgtgtctctgtgtatgtgcagaccccctaatgttaacatgtgttaaagtaagcatcgctcaatactttgtttttacagatggatgtcaactattgtgcttgctacattactttgtggcctcttttgtattctttttttctcaaatgattgactccatcttcatttacttccaccaggctgttcaattttgcttccattaaaaagaggctcaatcctttaaatttctttttttctttgagggccacatccatggacctaaaatatgtttttttaaattcatattcattatcatatattttatataaatcatattatcagttaataatatatattgagtattctttataggatattatttattgctttgttaattatacttatttaatatagaaatagttatattaatactcagtattaagtaagaataattctatgtgatagtgttactactttatatatatatatacacatatatcaatatgtatggtgtgatggttcttctattgctatatactatacatactgctatacatatgtatacatgatgaaatatacagttttctatatatactgtcaaatattgtcaaatatatttagtcaaatacatatagtttgactatatatagttatattcatatataggatatatgaatatataaatatagaatatatttattcatatatatcctatatataagaatatatataactatatgtaagccaaatatatataaaagtaacaaatatattttactatatatttgaatatataaatgtatttgaatatatatgtatttgaatatataaatttatgcaaaataaaaacataaataaaatatatatagtcaaatatgtatatatataagaataacatttctatgtgatggatcttctattgctgtctgtctatctagtcaaatatatatcatcatgatatatatatttgaaggcagataggttctctagttttataccagttaagcagttaactttagtaactctaagtgagagtaactcttcaagtgaaactttgaaagagtaacagctcacaggagtgtaagtgtttctccttgaattttacagtgctcctccctcttctttgggataaaggattggagagggtgattctttctgcctcttttcgtcctcctttaaatgaattattatctttttactccagcattccaggactcagggtgtactttttaacaacacacctaaaagttgttttgttttaccaattcttttttaaaaaccccaaatcatccagaaagcagttgctcctctttcatcctgtaatgaacctgcagagtaacctggggatattgttaatactcaattaagattcaggcatctggggtggagtctgagaatctgcatttccaataagaccccaggaggtgatgatgatgctggcctattggttgaggttagaatgtgagagttagaagactttgcttcaagttttcgctttgtcccaattctgatcttaacctagagacttaacctccctgatcctgttccttatctataaaatgggtggaatcatgtttcttctgcctgcctacccatagaattgttctgtacttcaaattaaattaaggaggaaagcactttataacaaaagaacagaagagaaggtaatgcagcaggatatttcgccttatttcttgaagagtatattttataccagtaacctaatttcctttagagtttgcccagttagcctaaaatgatgacccctgttttaaagttatcttcagtagttctttatcctcttttactctcctctttttgttcatttattcattcatcagacacttattgtgtagctactatgcacaatacattgtgccagctgctgtggttgcaattgactctttccatttacttctacttttttctcattctttcaaatactttgatttattgatttcactctgtgctccatgtctcccatatcttttacttctgccttcagtgggatgttgaaatcactaatttgaaggttgcattcgtctctttgaatcaattgtatttaatttcacaaatatttactgattccccattatatggcagaatctctacaaaaagaatacagaattgaagaacagtacttttttttaggaaaaaaaagtttatatcctatttgggaaataagatttttaataatttttcaatgaactatagtaccaggcaggagatttttggtgtcataagaaacactttaaaggaggaagtcacagctgacttgaagggtttgaaaaagacttcttaaaagatggctaaattgtgacagaaatagatgagaggaagaagaggatagatattacaggtggaacaaattataccttcccctctctttgctttcattcatggtgagtgacttgggaaaatggtctggtgtaggcaaaaaggtcttaaaagtatatgagggaaagctggaagctcttattggagtcacactgtgatagccttggatggaagctatgggagtctgtacttaatttggggggcattaagaagtctttgaaagttaatgttactgttgaccttcctgccatgcattcaaagtcaacctttaattcaattctgtggaatttaaatgtaagtcaactgtcgggctctgggtttgtacagagcagattggcaacctccaggtagtcttttgccagttttcatcaaggcagcatatcataatggacacaatatagtggactgcatgaggacgcccggctgctaatcctggttcactaacttgctagccttttgaccttagagaaggcattcatctgtctgagtcttcagttctttcttataatgatgggaataacaaaatgcctgttttcaaagtttatgatgagagataaatatgaaagaaaaataaattttgaaaatgtaaactttgaaagagcaacagctcactggagtataccggtttctccttgaattttgtagtgcgcctccctattctttgggataaacgattggagagggtgattatttctgcctcttttcctcctcctttaaatgaattattatcttttcactccatcattccaggactcagggcgtactttttgagaacacacataaaagttgttttgttttaccagctctccttcaaaacccccaaatcatccagaaagctgttgctcctctttcatcctgtcatgaatttttgttcatgggaggttatattaactacattgtcattctgaccttagcttaaatatcaccacttaagatatccaccacccctgggcacagccacagtgtccctcatggaacctctcaccatctttttattttccttatggaattgccttcctcatttatttgcttgtatattgcatgtctctttagccaataagattttattagttcattatgtggcagacactgtcacaggaactgggaaaatgtgagtgggtgtgtccttaaagaaacagacacataaatattgatactaataatgatctatttacctatgtgtataaatgccagtaagtaaaaagtgctataaagaaaaataaagcaagctgaaggattagagactgaaggttattatgcctttttttttttttttttttttggtcagaggttcagggcatggttccttgattaggtgctatttactcaaagaccaagaggaagtaagagagtgtgccaagcctgtacctagagagaaagtggtccaagcacagggaattgtgagtgcaaaagctttaaggtggagtcatgtgtggtatgttgaaagacaaggtaggaggccagggtggctagagtgcagtgagccagcagacagcagtagacactgaggccagagggttagaggacagggcctgggcaccatcaaataagctttggagttcctgttagggtcggagatctcactcagtgtgacatggggagcctctccggaggctttgggcagaagagtggtatcatcccactcaagtcacgtcggctgccatgtggtgatgaggctattaggtggctagtgtcaaagaagggagaagcagcgttatatcggaatgggctcctaccaactcagcagaagccatgtgtgcatctcttcctgaaccatgccctcatgtcacttgaaattagccacggcgaaggtaagtccatgtggaaatctgcaaatactatagaggatttcttctccctcccttgtcccttccccttctcgtctttcctgcatttcttcctttcttcttcttcttcttcctcctcctccagttccttcttttctctttttttttacaacattatatatacttatttattgtttataagcaaagttgttgataaacacttaccagcacatctcagaagagacttttagaagtgtattgcaaccatttatgtaaaagatggtggtggcttagactagcatggtaacaaaggaggtgataggaagtggtgagattctgcaaggaatcttcaaaggaagcacggacaggttttactgaatgactaagaaaacggtggagaaaacattcctcgacaaaatagtagagaaaataatgagtgaagcctggcttccaggttttcatcttagtatctaaaagaatagttatcgtggattaagatggaaatggcttcaataaatgagcagtttgtgaaatgagtgttaaaaacctgatttcagacatataaagattgacatcttaaggtgtagccaagtggagatattgagtagaaagttggatatatgagcttcgtactcaggaaaggagtctggattggagatatcaatttgggaagtatctgcaaggagaatagtatgattctgttctccctaatttaaatgggggctgattgcatatcagaacagagaggcaatgccaccatacttccactgcatcttttgcagactgctgagtcaggtgtttttttgatgctttttataattttaatataatttgagcaaccaaatgaaagttgctatggattgattgaacccttactttttctgcaattcattttcatagttatgcttcttgcttcctggaaccaatcagctacagcatcacttctcaaaatgtggtctcagtactgcctacatcagattaaataggtgcattgtaaaatgtagatttctgcattccagtgtcagacctatttaatcttaatattagtccagggacccgaaaatatccattttacaaaacaaatacgcattgtctttattatgcaaataacaatttggcccctcctgatgtaatgtttaaatataaagtttaatatctatcgttttgtaaggattcccatggcaaaaaaaaaaaattgtttatatcatttatatatttaaacctgcctgtacatattctaggttgttcagattaaaatagatttaatttcagtcatatagatttcaatcttagttaaataggaaaaccaaatttaatcatcttttttttttttttttgaggaaaagtgtaattttagggcatactgtagatatactgttcaaaacaggaaacctgagttttcaactgtaggtattggattgctatggtaatttaaatagcaaatatttctgattttctcatgttttgggtgacagaatcgtgttgcatttcccagctctcgtgatttagatggtatagaaaagtaattgtgaccaagtgtgcctggggccagagtatttaatttccagtgttccttcatcttacttgtgtctttctccacatttgaggtggaagctgccctgttatcctgcttagctaagatgctacagtcagcaaagcttccctgctaacctgtaatgaacgtttaatgtgagggagaaatactttgtgattttaaactggttggtactccagcataatctaaagcatcctgactgattgtgactttctctagcaaaaatgaactgctctaacctgagttatctcctatttaacatgctgacagcgggaattgatctaaggtaattcattgccccaacaaattagggatttttttgtcaatattttgacctttgacaaatgagagataggtaggaggtaaaggtctcttcttttacaaatttgctactaattaggttgtttcaaaaacaaaaacaaaccaagaaacaaatgttaccgatcgatttctgcaaaggtagagacttttattaacaatcaggtatgaaaccaaatagcttgttctgaataatctggagggtgtctctgttccttgtctttttaggtatgccatccagcactttgtagaaaaggttcactgcagagcaaatgcaactgtattctagtagcaggagcaatgagccttctagtagtaccaggtgaaggaccctccttatatgtccaggagtgggtagcaattcaaatagattttagatcaaaggtaccacttcaaagatgttagactcacaaccttttcctggggttattttactttgttcccacagtggggagattacccagtgtttcttgccaatcacatatcttcatcatcatttttctcatcaatgaaaaattatttgtaactgtcttgtaaattaccaagctcccatgggtagtttcacagtgcaatatttggagacttgaagcatttgccacaggtgcccctagagtataaactactgattaggaaatggtagatcttaaccaatgtaaagagtggatctctaattagatttctttaaatcttagctaacttcttctagtgtgtacattaaagaaaaaccaaggtactgtgaaatctctctactggagcattttaaagtaaagtataggcactaacagaattaattacagatttttgtttattttcccctatgttctactaggactacaaaaaccataaaactcaccagaatcttacattattttattcaacaaatgtagaagtattgcttgatcaagtaatgtggtgcttgatttttaacaatttactgtagactttgttatcaatatttaactagtttacttcaatattaaacagatcaataaccatttgttatttaaacaaatgtttaaccacaaacatacctatatgtatatggatgtgtgtgtttgtgtatgtatgtataattgagctgcttatatatcatgtagttttttaaacaaaaaaatagataatagcatcttaaaattaaatcttgagacattgggttataagtttcaattttgcttttctttctgcgtattcatggtctgtagaggagactagacttccctaatgttttagtttccaaatattttgccaagtatgaatgaactaggtcaacgaaggaaaacattctttctgaagcctacattaatattctactgtttgaaaaactgggctaacccttcaatcattttgttaatatttgtagcttctcacagagttgtaaaacctcataagtaaacataggtttttcaaatctttacctcattttaaattcttttagttactgttgtgaataaagaatttctggatggctaatatcagctaataagattagtaaggaatgaattgtaaatagagcatataaaattacttattttcaaatacttcttaaaaacttgaaatagtgtctctagtattataattttatacatttgactttttatgatatatttaatggtaacatttaaaataaaactgttttttaaaagtagcattttactagcccaatgactgaaaaaaagtttgtaaatttatagattttaaacaaattgaatggtgctagtttttctattcacttttgtctctaaaatatttttggtattttgtaaacagcaataaaaatagcaagagtaaaatttgacttcatggaaacttaactgtgactggacctcttttaataatttttattaattttgactcctgtgaattttgatgtttggaggttatatatttccaaacttaaaaaacagacctacaataaattagattgattattcctagtgaagtactttactaatattattgatattattgtgtagtagttattagggagtctaagaggaagactatttttattatagggaggatggtttcaactgacaggttttaaactaaaatgtttaagcattttagacattctattttaataagtatgttttagttttaatttttttaagaataaatgtgaaatgaatgatttggatataggttagtttatggaaatttttgatgatgactatgtattgattacttttcatttcaggttattgattattaaaatggcattataaagagatagctccaaaataacagtgtcttaattacttgaaagacatgttgttttaatattgcactgtaacataccataccatatttggtgattttttttctctattccagttttgtatgctactgtagggcatagaatgtgagtagcacccctagaactcaaagtatatttttatgtgaagctgaaatgtttttaacttgactcagccagttaataatttttggatttggcaagcttcagtacggtcctatttttgagaaaagccaacaaaagtatttatcttctaattcaatgtccttttttcccttaaagagatttttgtgtgcaaatgcttataaatgtattgttattacagtaacactaacatattctatttctttctacggtgctaaaaataattaacatttatggtacatttaaacttttgtcagtcagaagatctagttattaaaccaaatgaaataggtataacaataccttctgtattggagttagattatctctgaaagtaatacacacatcagatgttatatggtaccaccgctacctcaaaaccatgcatcctaatatgtttatttataataaaaattttaaatcagtcatacattttcttctgaaatgcatacatagcatatgcaatggactggtggaaatactgtaccatttctcattacttattagaatgacttaaaatattggttttggctaaacaactaatcagtattttagtggaacagatttacaacctttcctgacagtaaaatacactttttgtatataacatttcttacccaaagacagttggcacagtagtaaacttaataatcacctccagaaataaaacatggaaaaacaatgttaaattaaaaacaattggcaactttagatatacgtatatgcttgtgtgtatgttaatgtgtgtatattatacacacagagtttatacaggcatataataatataccattatgtattatatatatatataacatagacatataatatatatttaaataaattatataagtatatataagtaaattatataaatacatataaatatgtaaacataattatatagatatataattataaaggcaatagattctaaaactcaaaacagacacatataaagagaaagttactaatcatttcctcctgtcatcctgaggcagccaatgtcagagtgtggtgtgtgtttctttacctcactcatgagcttctccaagctcagaaagcacagatgcacgtttgtacatctcttttgttagaaagagagatgtggttttgtttctgtggtttgtttttatacagaaactatcaaacacattgctcttcattttgttttttatagataccccttcaaattaatatacagaatattcatattaaggcatgctatttttaatttaaggaaataaaaatctggatattcattgtctttcttttatcatagccatagtaaaaagtaccaatattgtcatggactgcaaatctcagggatattttaactccagatctggtaatcgcatgaaaatgactctgatgtctatgggaaagcaggaaaccaagatttacaaagtgaattgcaatttggtagacaatgttcttttactgatctacttgttatctagtgctatctatctccaaaaatacctgatcctcatggtagaatacatgcttcactatgatataatggttgtagttttcagacaccgtatttggtgaaaaaaatcacattataaaaccatacgtcagtagaaaggaatgagttagggaatagatttgctaagcttctaccaatggtataaaggcggatgcaggattttctttagattaagactaggtataatgaagagagcaaaaataagttaagccatggattaatccaagtgaatacagttcaaggaaaataaacatgatacaatcatatgtaagagtaaataatattcctcaatgaaaacattataacaattttgtttagaatgccataggccatcagaaagctgtatatatatatatgtattatatattgtatacactcatctattacatatttaacatgtattacatacatattaatgtttattatatattcatatttcacgtagtatactgatatagtatacctaccatactgttaggtgcatctgactttttccatcttaaattttgcatgcacaaagtatatttcttgttcaaaatttaaatcctaacaataatatagcaaaggtagatcatgcttttgagaagctttttaaattaacaagtgtttaaaagtctttgtatatatgtctgttacatgtgtgtgctatgtgtgtgtgtgtgtgtgtgtgtgtgtgtgtgtgtgtgtgtttagcattgagcctaagttccaagcaaccagtgtgggtcaggcagatttagttcagctggaacgtaaggagaaaattgacaagaatgattcaattcaatctatcaacattgattaaatgcttactatacactaggtactcttctaaacgttcaggtcatagtagtgatcacaaaaagtcccaagcaaacatggttcttatattctacaggtggtgctgggggcacatagagaggaggaagacattaagccaaaaaccaaacaaataaaaagcatcatactgtttttgacagtgtcaaatagtgtgaagaaaaataaagttggttgggtgtctatggggagtgtttcttctatttttggttgcagatgattttttgcagttggtagcatctgagaagagacctgcaagaagtgaagaagtatgctaccaggcatagcccgggaaagggcagcccgaggcagggaaaagagccagtgaggttttcaaggagagcagagtgtggcatatttgagttataccaaagacaataaaatggtgaaataaggccatgaaaggccttgttggccatatcaacaatattggattgtttttcctaagtcagttgggaagcccttggaggcgtttgatcagtgacgtctcagttcatatcatagataagtgaatatgcatattttaagagttcactctgcggccgggcgtgatggctcacgcctgttatcccagtactttgcgaggccaggtgggcagatcacgaggtcaagagattgagaccatcctggccaacatggcaaaaccccatctctactaaaaatacaaaaattagccaggcgtggtgacccacgcctgttatctcagttactcgggagactgaggcaggagaatcgcttaaacctgggaggcggactttgcagtgagccgagatcacaccactgcactcccgcctggtgacagagtgagactgtgtcacaaaaaaaaaaaaaaagagagagagttctctctgctacataaaaactagcctgagaggaaactgggaaattggttcaacgcttatggcagtactttggaagagtgaacttgtagacactaggtgcttcaaaacagaatgatattaataacataatatttgatttataatttatctacttctcacaacagaatagaataatatgtgtagagctttaaagcaatactagcatacagtaagttccatggaaattctaactattaactttatcctctgtatcatcataatcaccatcatcattatccaaatccttaatagatgctcttgggaaaaaggtcattttaaatgatattacaaatatgaccctcttttcctcactaaagtcaagcataagttaaaggatttgaggatgtgccctattacagagttgtttaagaattttacgtgtaacatccaatgtttttttcatccttaagttgttgcatgagttataattaaacctaatttaaaaaaacagctaaactaaattggcattgtttctatttacattttaaaaattaaatcctaatcaaacttttcctcttcatttatatgaaaattttgtctccaaatgtgtacatttattttcagctgacttttcccagcctgttcctcttagatagaaatgtcttctctgtactattgtttttatatgatttttttcaatgctcaaccctacttgatatacatacatatacacaaccatgtacaacattcactgtactctttgaaattcatggcttagcacatgaaaagtagcatattaaactttaaaataatacaaatatatttggttatccttgaaaaatataaacattcgcaaaaaatatcaccagccgcacatacatatattcatataaaataatgtatattaataaaaaacttatataggcaatgatacaatcattaagtgttagcttggaagtagatggtatcagaaaattagaaaatagttcttgtgtaagttattcttctactaattggttcttagtttcctgaggactgctttcttaaaaacagatttacatggtatgcagatcagttttgtgtagtgtttttgttttgtggttactattattttgtttgttttatgtgtgtattttttaaagtctgacagagtgataaatggtgctagttttaacttgagcttcaaatactgattgatattttttaaacatacacctttgatacaataacaaaacaaataaaaacagagcgttaagtcaaatggagaaactagcacagataaaatgttctagttttctgatctatgcctggcaaataaatgtatgtacttagggaaatttggtgtgttttcctatgtgatacataaactggataattttaatatattccccattttggacattatattagagtgagaaaaacagaaaatatatttaaaatcataaaaagtattagtaaagttctgaaattaaaataactccatgagtatttttttaagaaaatattttcaatttagtgataaatgagtttgtatatatacggccaaatccaaaatagtctaaagctaagattgaggcctgtctcagctaaattacataaaatcaaatgataaaagttgacacttaactcatcttggactttggatgtaaaacatatgttgctgatgttagtttgacatgtgtcaaacaccttcaaaatgtatgtatgaatatttatattcttcatacatacctgtttatgggataatattgaaattaaataacattcttagaaaattaatgtgacaatatccaaacagaattgagatctcagacacaaaacatctgagtttaggcctatttgccattgacctattactaaagtgcttctgaaaaatgtcctcacagaaggttgtttggcctttcatcctgctccaaagtgggtgagcatagctcagctgatgtctacaaactgtcagattctatgagcagagatcgtgtttttccttctaacagtataagttgccgttgtttaatcttttgatgtggctctggaagagaatatggtcattggtactcactctagggaagaaaaagagcagttgggggtggagggaggaggatgcagattgaaagacgtaaaatagtggcaaaagacagtgttccttctccagaggtgaagacctgagtcccagctgggagacatgtatcagtttctgtgcctgggaacttcacatctttggcacctatcttgtgctcagtgtaagtccagcattaagatatatgtatttttcctactgcatagcatctaaatggaaaccagtcatatcattaactggttaattaacagataacaaagaagccaaattaaaaaacaaaaataaaaattctgcctttattagactaattgagaggccccaggttttcaccatgcatggttgctttagaacctaactccccaggaagatgtggctccattctgctaggaagcagtctagagcagcactatgcaaagtggggtccatgggccaggcccttctgagaacagtttgatacccattagaaaacatggaagtacaaaaatagagagtaagcctttagaaaatttcatagaaaatcaacccaacatttgtctgttgattcaagtaataaaatatgaatgttttaatgtcagtttttacatttagtttctctagttatccacttttactgtaaattggaaaacattacttcatgatttaggaaaaaaatagtctggcttagaccacagttagtttgagaagcactggggtagcacttttagagtttcaacacagatcaatataagacaagtgtgatcaatggcaaaagtattttcaatcccttgaaacatcaaggcaacaatgaggttgcataattatatccctaaagaaatttacatctttattaataagctttgtcctctctcttttcttaagtattcatgtaaaaacattctgaatgcaaaaaatcatatttaaacactaaatagaatgtcagtagaattgcatttgtatgtgttaaaatcctattgtcattttactataaacttcttctctccttgctgttattgcctaacttctacagggcatttgtatgtggccttcttaaaacatttactggaaagaaacttaataaaaataaatttatcaatccaagatgtgatttctcatgagaatcttgaatatctgcatttagaaattatatatatggtcatttatagaaaaaaggaaagatctccttaaaaactggaataagaaaatgatttatatagtcatgctaacaaaatatcttattttagcaaccacctgtctatcactcttaccagtgaaaattattcataaaatagctgctccttataactaggggtaagagatatgcaaacaagactgcttttaatcttgaaaagcatgcaaaacaaaatttaaacatagacatcaaaagagaaaaactgttctccaatttgtcaccaagtcattgctccctatattaagtccagcaattcacgaaaccctcactcattgtttgcagtgccctgtagcaagctggaagtgtctttatatgtattattaaattgccgttactgccatctagtgggaagaaatactccctgtcactatgtcagggattgtacataaagccctaaagttctaagtgtaaagggaaagccacagtttgtgtgaatcgcagagagcaaaatggcaaactgaagacacaatctcatgacaatagagacataatagacatctattcaccgaataagttaaagaggtatgtaggacgaaaagaaagggtgtggggaatgcatgcattcacgagaattcattttgtgtacacccaaaattacatctaaagtattatttcttattgaacacaggttacctgaaccaggacattttattacatgtagacttattttgtctttaccttttgaatgtagatggattgttttgcatgtgcttattaagtcttaaaaatgaagacagcttagatctgttcttaaaaggtaaggttcatacgaaacactgtaacgagggaatcttgttacaatgcagattcagactccccgggggtctgcatttctagcagctcttaggtgataccatgctcctgtttatagtcagatcatactttaggcagttacaggcttcgagtgggttaccaaagggaaggagtccagaaatgaagcaaactcccccacagagtatatttcaccgcttgttatcttgttgttataatgtaatagactagttcattcaatggcctatacagtcaaattgccaaattcatttcttgagtttgttacttaactatgtaggtaaacttggacaagatatttcacatctctatgacttagtttcatcatctgtaaaataaaataaatcataactaaatatatctaaatagacatacataaataactatctcatggttcttatgggaaataaatgagctaaaatctcaggatgagccatatgaaattgtcctctttatagatgaaaaataaacatccacaattttatatagttaaaactaagtatgtaaattatttagtataatatgtagcacctagtgaacaataaatgttagtatcagcaacaattgtcactgggtaaattcatagacacatgaatgtactaacaccctaaaaagtttctttcaatgaagaaaattttgacatcaaatacacattatgcagtagcacatataaaccacgaggacataaaaaaaaaacaaagactctggataaaattaataatatgataaacctgttctggggaaaataggccatgaaagtatctattgttttctaaattattagagcaagcatacttcatgtttttgaattctttgtcgttcttacgctgtaaacatttttacatgatttcaagctatgttacattccttagttgtatggtgaatcataaaatgtgtgataaattatttatatttataaagttttgcctcaaataatagcatttagcactgtgctttgatgaagggacattcatttgtatgaaaagcagttctgcttcttttgagtacatttagtcactttgcttaaatgaatagatatttcctaattttgaccctcaggttttaaactttgcttgaagtgtactgatttttgctcttgtgaagtattgttggtgaactacagagaagcatgtaacatactataaaactataaactttaaaattatgagttagaatctggttggtattaacttaaattgatgttaatggttacatatacaggctatcaactgagatatattgtaattctttctaaggagtccttctttttctaaaatttgaaatcttttcaaccttttgatgtatataaaatatttgttataaacctgttttataatgaaagtaatttttattaccacgtagtttagagactaaacttgtaagtttcaaggttagtggaagaaagaatttaagccactataatctattccacatgggcaacaaagtacatttaaggaataaaactattagactatatttattgaatgatgaaactcaagctggtgttatataaagtgatgaaggaattactgaattctctttttttcgttttttgagatggagtctcgctctgtggcccaggctggagtgcagtggcactatcttggctcactgcaacccctgcctcctgggttcaagtgattctcctgcctcagcctcccgtgtagctggtattacaggtgcccaccaccatgcctggctaatttttgttaaattctcttttccaaagatgcgatactattattctgttgcagcaacaaaaactgggtatacacacaaaataattgaaaacatgatatttatacatctaggctcatgtcagcattattcacaacaggcaaaagatggaagcaatccagatgttcattggaaaaataaaatatggtgtgtacagacactggaatgttattcagctgtaaaaaggcatgatattctgatacatgctatggcatcaaagatcattgagaacattatgctaagtaatataagtcagacacgggaaaacacatgttttgtgattttaattatataaggaatctaggataattaaatacataaaagcacaaagtagatcagtggctaccaggaactgagaagaggaggaaatgaggagttaatatttaataggtacagagtctcagtgtgagatgatgaaaaagttctatagttggactggtgatggctgcgctttacacttaaaatgactaaaatgatacattctatactgttttgtatattcatttcagtacaataagaataatttataaaagacgctaatgagctcctagtcatcatatgacacaaaggtgtcttttaggaaccatgaaattaatttaaaaaaaaagtctactctcatacctacacagctattttccgtctgttatggtaagaaacagaagttaaggttgttaacaaaaataatttggaaagcaagacaggagatcaactgtttgcatcactttaggcgaagttaattgacactcaatgtctgtctttgtcttttcaggctgctaaaacaaaacatcgtaaattgtctggtgagggcctacattctggttcatagatggcatcttttcactgtgttctcacattggtggaaaggaagaactctggtttcttcacttccttataagggcaccaatcttattcacgagggcttcaccctcgaaataatcacgtcctcaaaacccccaccttctaatattctaataccatcacgtgagggcttaggtttcaacataagaattcggtggtggtggggttggggggagagggaaacaaacattcagaccatatcaatgctttatttttctctttttaaatctggccattgtgagaattacaggagaattaaaggcatctgtcatcatcccagacacatagtaagttcttaatatgggtggttattgttattttttctgatgttgttattgcttgaactttcaagatgtagggacaaaagttttatataaataacaagaagttcaactaaacactgtattgtacatcctgtaaatatgtagaatatggaggcacaaaaatgagctttaggaccaaaatacaaatatgttaaaatagtttagactcaagtgttaatgctagatggtcagtcctgaactttgccaccctactattatcagagaagtgaaaaataataatttttttttcttttttcttttttttttttttttttgagacggacttttgcttttgttgcccaggctggagggcaacggtgcaatctcgactcaccacaacctccatctccgaggttcaagcgattctcctgccttagcctcccaagtagctgggattacaggcacctaccaccgggcccggctaattttgtattttgagtatagacggggtttctccatgttggtcaggctggtctcaaactcccgacctcaagtgacccacccgcctcagtctcccaaagtgctgggactgcagacgtgagccaccatgcctggcctctaagaataaataataatcttaccaactattctatataagcatttttggcccactgaacactgtgatatgtaacttcattgcaccttcacatcaaccccaccaaaatatacgtaacaataggctaactttaaaattcccaactaaaacaaaaattgtgaccagtaaattacaaagttaataagagacacagtcaaggttgaacaccaggtcttctgactctaagtcaaactctctctttattccctgttgtgtatcataggttgctgtagaccaagtattgaaaatcttgtgttttcttcattttgcattcttagtttatgggattattcagaaaaaattaggagagaatacagtaattcaaaatctacagattttttaagacacagatttttggacatcagtgttcaaatcaatagaaagtcatgcttcccttcagcagcctttattttgacaattttaaggggcaggtacactaaatttctgctgattagatggaatgaatcctatccttaaatcataaagagtgttaatgaatctggtagcaaaagttgattgcagacttcttacaatgacaccatgggatgacaactgtgttaacacaattttgaatatctcattaaacattttttctctgcatgtatatttttcctttttttttttttttagacgagtcttgctctgtcgcccaggctgagtgcagtggcacaatctcagctcactgcaagctccgcctcccgcattcacgccattctccagcctcagcctctcgagtagctgggactataggcgcccgtcaccacacccggctaattttttgtattttttagtagaaatggggtttcaccgtgttagccaggatggtctcgatttcctgacctcgtgatccacccccctcggcctcccaaagtgctgggattacaggcgtgagtcaccgcgcccggccttcttcatacaaatttgttcatgtaatatattaattgcctgcctaccttcctattacaggtttcttaaactttggtagattctcttttgtttctgttcaccaaggtccttcttcatacgaatttgttcatgtaatatattaattgcctgcctaccttcctattacaggtttcttaaactttggtagattctcttttgtttctgttcaccaaggttttgccagaccaagctacaggcagatttttaccattaacagctccttctaaagttattcacgtttggtcagtactctgggctgaaattccaaccatcagtactctttcactttgaaaaataagcttgtttgactttatttggaaacatataactggattgctgtgctggatgctagtgagcaatggtttaaggaccccgtttattgtaggaaagtttattacattttgttttcatactgctttacagggttggaattttttgcagcattggtatatagacaacatgtcatttgttttagttgctacatgacaccttaaagtttattttttctccaaaggaaatggcaactgtattctttaaaaacacctatgtaaaaatgaaataactaaacttgtttttagagtattctatattctagatggataatgccggaaaaaaaaagatgcatgtgtacagcaaaacttgttttatgaaacaactccatgggccaggaaaaattagttgcctaagaaagatgtatagttaactgaaaattaaacacatattgtctttgaaatttataagacatttaaagcatccatttaacttatcggtggtctccatatctgtatagttgatgccagaaagagagaataaaagattacctagagaaatggactttaggtaagattttaagatatgaaacatatgaacaaaatttagttttccagatgatttgtataaaatactgccagataatttgctaattatatggcactggggacaataacaaggattaatgaaaatgttctaactcaacagatttttaaataatatttttcttatacaaataataaagatttattgtaaaaaatagaaaatatagataagaaagagggaaattattcataatttctgctttttaatataaactatgcacatttcagtatatcaacatccatacatttttctatgcatatatacactattgcatacttgaattagtccatattgtacacagtcttttaaaattcacacctttaacataaatattgaaaatacctttttcatgtcataatagtttttgagaaattgagtatcattttaaaataaaagcaatgtccttattgtggaaaagcctagctcctccctgttgattttcacaaaaaatctatgtttggaaatgatagaaaacaacattgtatcatagtgttgtttttctagcaataccacataagctcctggtgtacaatctaggcacttgtgggtgtaacctttgagcatggcttcatgtgtttaagccttagggcctcgagcacgtcctagaacaagtatggagaaatgacattgggtatgctaaggggctgagaccatggtgaggtgtagaatatagaagggctcaggagtaggtctggctcagaagtcagtgtatggggtctaggaagcagctcaatgtaggaaggatgtccttgaacaaaaaggtcaaaaattggataaacacgaattctctgaatgagcacgcatccataaactttaggataacaaaaggccaggctgcaagagactgtgaaatggatatggatcacaataatcaattaaaaaatctttgacatacattaattccactaatatttattaagcataggatagttttatacaccattcccagcttaagacagcttataacatacacaatatggtgagatgattgttaagtaataaaaggcaatatgtaattcatatggtccaagaataagtgctatagggatttgtttattggaaggtttgcttctgacttttgcaaagtagaaatttataatgataatagcggccgatattggcaagtattttataggccttatttttatgttcacaacaacatgtgcataaattattattttcaggaacacagtgcctatggtggttacagtcttggagccagactgtctgagtttgaatctcagccacttactttgtggcttttggcaatttatttaactctctatttttcagttttctcatctatagaaaagaaataatggtagtatctatttgatttagtgattgtaaatactaaatgtgtttatatataatacttataaatagctctacaaatgttagttattgttattaattttattttcgtggtatagaaatgaaggtttggataattaaggtgatatacctaagttatgcaggtagtaaatgttggagccaagggtgaatacagctctctcttacctgaacctgagttcttaatgtagccactttgatgtctcaaactttaagcatgacaagagtgagtcaaagatagtttggattttgattatggatgactggaatcattcgtgaaatagggaagtgactaggagaggttgtttttattgctattgttggataaaggaaaggtcagatttaagatgtcttgaattggaactggtgaggaggcattcagggtgaaatatgtagctgtgagatagaaatcctggaccagaactctgtggagagttggagtggaagctgagattagggtagtatctatgttaagttaataataagattggcagggagataatattttaagaagcaacatatataaaaagaaggactacgtcgagaagtcatagcattattaaccatggggaagagaagctattaaagaactcagaagcagaattgatagggtccaaccagagtcagtgatagcctgtcagcatgcaagatgaagtccaagaactccactaacaacagggtggaactctcaactatgtgagtagagaggaaagatttttctatttttttgatcatgaaattgcttatgaggtacaggccccaggtgttatgaagaatatgacttggttcgtttggggcactgaaggtactgggggaggcgctacttttagagcgctcaaatatgccacgatttcatttcattttgctttctccaggcctgtgacatactaaggcagtttttacttaggcatcgatatcattttcaatttggatcatttcaaaagaaagagaaggacttctatgtgtgtgtgttatatgttttttggcttttcttagtcaagtatttccgaggatattctaccattccttctttttaatttcctgtttttgtttgtttatcaaatgcaccagacaatttatctttcccagaagttttaatttttgttcctatctacataggaaagagctgggaaacagagttttttttttcatatttagattgacattaaaggtatggcaggttctgtttggggagcaattttatgataaataaaactaaattgtgctcctagaagttcatagtgctgatcaaatgacacttatatgttggtctttctttaaaaatttgttacagaaaataataaaaattctaataaaattaattctacttctaattaaagtctagaaataaatccactatgattattttgtcagctttagctgaggaataacaaaatgaaataggataattagctggagcatggattttctgaaatagaggacagtaaactacagttttggagagaaatatctaaatctgaagcacaaaaagaagcaacaaagttgttggaagttctgttctaagcaactatgaatttttttgtagttgctctgctgatttctagggtatttctctatagctaatacttggaaagatacttcctcattgatatgtgtttcctaaaggcatcattggaagttgcttcctatttgtctgatgggttcaggttggtatgttgaatccagtgatgctggaattcaggggcctaaagttcaaggcagactttaggtccccaagattagaaatggattatctgtttgtgtagtctggaatttcatatttcaagttgtatttgaaaattcattcctctgttgcattatatgacttttggctcttggatcattcaaaactctgtcatcgtcttggtcctttgtgtcaatttgtttggttataggttttcacaaaacatggagtagctatgctgcacaattgagatttttcatttattctacatctttcctcagccagcacatgattatgtgattggttcaatagtaggtcctcaccaagactcttcacattttatgttgcctccactagtgtcatatcagtgtggctttagtatcagccaaattcagatccaggattttgttgctgaaaacttaaatttagaatcacatggtgtatatttaaaggaactcttagattctccttttaaggaaagatgtctgaaaattttaaacataggtgtctgtcattgttatggtttggaatttatactatggctgaaaatatcattaaatattggatgggtatgatagcagtattgtcacatctttagctcttttttggttatatatatatttatataggttatatatatatatttatataggttatatatatgtgtgtgtatttttggggacatcttgagttctgggacagcctgctttggtgaaaagagccccaattttggtgtcagactgagtgtgagtgtaggctacattcagttctatccctgctattttccaacggtagacactttagttaaacttattttctctgagcttcagtttctcaactaaaaatgggggtgctacattgtcaggctgctaaaagtttccaatgaggaaatgctaggaaaaccatcatagtatttagtagagtggaatcgtaataaataccagctgcctctcttctctctgccttattccaaattatgtacaccaggatgatttttaatgcaaatgaataccaaattttagctatcatccaattcttccacgatcattcaatccctgtttagttcatagaatcataacagcttggacttgaaagtgacttaaatagcatctagtgtaatctttcacctaaaaggcatggagtcttccagattatggttgaatatttcccatactgagaactctacttcacaaagcaacccactataatttttaaacttgatcttcaataatagcttaaaatcaattcctgtaattatcaaaaccttttgcatatctaaaaccatctatattaccatgctttaaatattcacatgtgaagacttcccactatcttctgttgtgtctcatgtgataaatttttcagatccttcaccactctactaattttcacttttaaagtagtgtgttttaaaataagttggacatttttccctgtaaaatacgattgtttcttgctttcctaattctaataaaggcattcaccttctcctggccacacaagaaagtacagttagaatgtacccatgccaatgtttcttctatacatcttttgaaataaaagtccctaacttggatataatattatactttatatcaataaggtgaacagaaaagaacttggaaagcacccccattcatgctttcacaagtggatattatgtactagcattttagaaggcacattaaaatagtcaagaatttatttcagcattcagcagttcgtgaatccagcagctccagaccacaaactgctcagggctctgacaaaggggttggggaagacttttacagggtgaatgtagaagcaaggcaaataaaatatttgatttgttaaagtacagcagtagccttatttggatcattccagtgggaatccctagtcagaggtatgattgacttaaaatatgaccatttacactgagtggggttttgacttgcttacataggaatcaagggcgctggagccacctcaccccgctggcctcccagttaattttttaacaagagaaaacaaaatgaaaagatattacttttgctaaagaacaaaatgtctatttgggaaaccaagaaaaataacacagtattatcttctctaatatagtgcttctcaaactacttgtggtgaaggaaagtttaaaaagaaattttaatatctgtacagactaatacttttgggaaatacaaaaaaaaacgaattactagaaaaagttatgtttaagatacaaatctctatttgttgttttaatccacaaattattacttttttattattttaagtttagaatcttgaaaaagcttctaaattcttaatttgtatacttactttgtcccagataggtaatgaatagtttgctgagaggcaccactctcagtccacactcagggtaacactgtattagtgcacataaaaataaggtacaactgaatcaaaaaaaaggatcttgtagatgctagagatacaacagtgaacagaccaaaggtcccagagtagagaatgacagatactaaacaaagtaaaatacatagctatagaatttataaccatgcaatggttataaattccatagaagaaaaaataaagcaggcaaaaaggataggaataacatatcgagggttgcaagaaaaatttaaggctatttcttttgattcatggtataagtttttttttttttctacaagcgaacgtctaatcacttatctgtgatggtgattacatgaggttagctcttgtaatcaactattttgtaaatgataaaattaggttttctgaggagaaaatagccttttattcacaagggtaatttttatttttaatatgttaattttaatattttaaaatagattaatatgtttctgattttggctactatttgttttaagatattttacctatggtcataaatgaaattgggctataaattttttattgtgttcttcttattggttttactataaaagctgtattacccttgtaaagaaaattggatggcattccatctttttaaaaaaatctgtgaggcggtttatgaaaaatagagtttgtatgtattctttgaagagaatgatgaaatctacctataaagttgggtaaattgatgagtgttatcattcagttcgctatttctctctttaattggtatcaaatctataatactttctatctactgaggcttctattttaatgtctgtattattagtttccaatatgtctaattttaaaaatcagcctatttttattcatatctgctattataagctcttttaaaaatggatattattaagcatacttatttttagtctttgttaggttgttacatcaaataaattcaaagtaaattaaagtgacaattttggggctgttgcttgtcttttctatctatactaggtcacttgtttaggtacttaggtttacaagcttattctgagtgaaaaggcaagttagaagactttcctcccctccttactcactgtcggcatttttgcagttgcctagcccagaccctccccacatttgagttgaagccacttcatcccaattgcagaagctgttgggttgcctggttcaatttctgactaaaatttatctgtatttaagcccctgtccttttataaagctaactccccaaatagcttcagctgtgagtattttgttttgcttatttctcttgttcaacctctcactcaacaagggagctctacctcaacctctggtttcaagcaaacagcatgaatgtctctggtcccccaaatcatgtggaagatactttgtttcctccttttaccacaggaggctgaagttttggccacctgtgttcactgtgggcttagccctgcagctccacttgccgatttgcatttctctgctgattttcagtcattgagttttcattctgttcttaagcctggatttgtcttttggatttttttattcttatactttatttacattgccatgtgtttgaagtggaaataatattttaaattatgaatgctgtaccatcttgactggaattctccttttgtacaaatgaaatctataaatgttttcttaaaaaggactgtttaattgggatctcctaaagtatagcttctttaagtaaaaaaattgtatatttaaccggatggtaagtgggactttgcctggtgaaccagaatttttagtaagcctccaaatctgaaacaatgttatgggtgcccacacattctaaagacattactagatcctcagattggacaccagagaaagaaacctggctgtttcatcttgtttgttttagagttaaaaatatataatttattttcaaagtaattataagaaaaacaatgatcacttctcaactattacaaaaaattatgacagggtttcagaaaaggtgttttttttttttaattgagatagtgtgtgacattttagagttagattttaaatggatacgaacagaatgtaggaatcaacaggaaaatgtaagcagctgcaccaaacataatctctatttcttttgaagtcattgcccacaagaactcacaaaaactaccccatgagaagtggcaccaacacgggttacaactgcactaattaaataagattctctctatgccttaagttctccatctctctgctgtaaccatgacccagcataatgagtagggagaaggaactcaagctgtgaattgtgggaagatgtgactatgcacacctttccctctttctctgttactgcagttcctaagcccgtcaagcccagcagaagagataaaggtattagactggtctgtaaatttcaatgcctaaaaatatccaccaagctgtagatcttcccaagatatttttcaggaacgaagcatgtaaacttacatgagtgaaagacagtggtaaaaaaaaaaaaaaacagtctattttgggctttggctcctacctaaatctagcttgttcaataaacctgttcattaagttttatgttaaaccatattcgtgcatttttccttgccattatacttaataatgcaactttaaaaatcttaaaataaatgaatacttgatttgaaatgttcatgtgtgtacagactttttgattgaagcaaaaaatatttaatgaaatcaaaccttccagactttaaattgcaacccaattcacatgaatacaaatgagcttaaaaataatattgcatatgtataaaaaatcaaataagggaaatataaatcaacagctatgcttgtatcggtttaattttaaggcatgatacaagaattactctgctgcggctcattaacacactactaaaaagcaaatcatatcttttctccattttatgtaacattttattttgcctgattatgtgttctcataaaataggccttcatgacttatataaatgtggaaagaagttatttctgagaaatgttattggcaataaggaattggcttaggtaaactattttagaattggtaagagcctatatggagatcaaatgtattaccatgtaaattcatataccatatacatttcatttcatagctttgctgttattgttgtttcttatgtatatagcccaatacatattttactcacattctccagttgtctgatatcttcgtcagatttttttctcgggtctgtctttaagatttagataaattgaatgttattagcggtactcgttcaattagaatgtttttatgaaacccataaaacattacactgctagagtaaatgattcagcatatgattcaaaccaaactaaatttcccttcaacccaaaataatctctaagtcatagtggtctatacagaatttagtcatattttgatatttataaatattaatcataaatataatatttagagttagtactgaaatcatatttagtaatgataagaatctacttgcttattttgagattaatcactgtagctcctattgtcaaatatctaccgacataaataaaaataaacatgagtttgaacatgttaaatgcacaaagatcatctgaaagtaccaggttgagtaagaaatgattaaagacatgaatgaatatttatattttatagaactttaatttcataataagaagaaagaactaggtatagttgtattatttggcctttataatgaatagtttttcttaatatcatttacatgtaatatgaagatattctgggatgttgaacagtcttccagataggtaaaaggaagggattcaaaagaaaatttgaatacatatttcatatttatctttttgtgagcttcgtaataaaccacacaaagctttcatctggaatacttattactaaaacttgcactgtagctgtagattgacattaacagggaaaaataaatataacccatttcccaagacactaaaatatgctaaatgaagtaaaaaatgtaaagtaattttgaaaacttaaattgatattgaaatgtgagttagttttatcttagtcaacatcattgttattgaagaaaggcagattttattcaccggaattatttattttagtttagattaaaagctgctttctgacatatgagttgactcctgtatctacttttctgagatactattggctgaaacatgttgattaaattttgtagtaacttaattacaagattcagagatagtaaagcttttaatgtaggttataattttataatatgaactgacatttctctagtgctctgcagttttcaaaatgctttcataagcattatctctttccatttctacaacaattttgcagtaggaaataatagtatccctcttttagagatggaaaagttaaagtttcagagagaataaatcacttagctactagatggctgaatcagaactcaagcatgtgaagagaggtagtatatagcatatcttaagaatcttcgtatcaagattaacagccttggagacaaaaggtctttgtttaaattcatactttaccctttggttgttgcgcgctcttgggcaactgagaaatctgattgggtctcagttttttaatctgtttaatgggatagcaaagttcattattgggtattgtgataagtaaatgagttgacacctagaacgtacttagactgtaccttgtatatttttagtggatgcccagtaaaaatccattgattgttgttgattagtaccaattcaaacgtgaagttgcagattgcagttatttgatgttttggtctgaattgttgtctttagtgagagacatctaacttaaaatagcttaagaaaaaaaaaagggtgacttattagaccactgagttgggaaaagttgctatactttcatacattcaaaggaaaacctgaatcttggattaaatggcactgaagactcagttcttccccaatctatatctctgttcatttcttctttctgctgtctctgcttcttcatggcctagcctcgttatcttctaccatagataggctttgtccagagtgttcatttttccatcccagggaagggctctgattggctatgcttaaaatttgcactggctctttatttccaaaagtattgttagagaaaatggggatatggatgtcatatggatatctctgtgtctaagggattggtatgttaccagaagcaattgaaacaacatggcttttggagaaaaactgaaaaaccagaaacaagatgataatgaaaaagatacaaagtagtatattctatctgactttctgcaaatcagaaagaaaaactgttaaaaactaagaaaacttggttttgaactgagttttgagatcagttttaagaattaagtcttaaaactaagaacacttagtttggaaaacctttgaatataaagctgccctataaggttttcagaggattagtgttccctcatgccaccatcaggctagcaccaggcagaggtatctagtgttgcctgacagtgatgtgcaggggagaatattgctacaacaacagacagaaaggatggtgatggtctgatttcaaaaacagatcagtgtaactatgtagctacttagtcaatagcaaatttcctagacattcttatgttttgctaagatggcagtagaagcttgactctgacagttgctccaaatgaagtaataaacctaacattctagttaccttgtcattcatctgtcttcaaggtggaatacatatatcacctttgagtgagcattcatattgttaaaatattgaaatgtcatccaatgccataattttcaaagcatgaaatttaaataaaatcctttgcccaacctctcaaatacctctgtggtctctggatgacactgtgcaaaccacaaacctatagaaatttcaggggaggttgaattaaagaactatcgaattaaagggttgatttgcagtaattaacatttcactttctgaaaaccccatatatttaacaacactattataataagttaacatgtgcttcagcttctttctcactctacaactggtttaatgcttaaacatttcttctctatacttggtatgatttcctccttttcttgcattatataagttctgcacttgttttcaatgtccaaacttgaactcatcacctgtccccaaaacctgtcttccttttattatgtctagctcagtagttgcgcaaatttgaagcctggataacacccttgaactttttctcaacccatgaattcatctttagtcagtcagttgactctaattcttaaatagctcttaattctatctatttatgtctaacatgatgcctccattgcacttttagcattaagtttaatttcttgacttgaacttctaggtcttttgtaattggttcttgttctgaatctgaagtccttcaagatgcaattcaaatagtgttaaaatattgcataggttgtttacataatttcacagaaacttctgacaaagaatatcctcaacatcatgcaggtagaagcatcataaaataccactatatgattaatctataagggttcatgaaacaatttagttaaaatatgcctattttcacatacttagataaattcattaattaatttttatgtcactatcttgcctggtataaagtaggaatttggtttccccccaaaagaataagataatgaatataatatatagctgtaaaatgaatatacaattgggacctggttagtgttacttctttttatggtcatccccacttactatagctgacaaacactggcacttgcttctgtttcttttcacagttaatattcattactgctttgtaatataggactttccaataaaacgttttcaaatagaaactatcctggaatgctcatatgttttttgttttcttttcatatatacaagagccaacaagtgcagtcattgtagatacttttgatcattgcagatggtcaaaatgatttttcaataatttagaataatctattcatttcctgaattagggaggctagtaatatcagctatgtttattaagcgctggagtcagttctattttcttgtaaagtttaggtataatgatcattaagaatcaccatattctcctgaatttcccccagtctttatatagacttttattttattattatatgtatttattttgagacagtgtcttgctctgtcatccagactggagtgcagtgatgcaatcacaatccacagcagccttgacctccatggctcaagtgatccccctactttagcctgctgagtagctgggaatacaggtgcacaccaccatatccagctaatttttaattattttgtagagatagggtctcactatcttgctcaggctgatctcaaattcctgggctcaagtgatcttcctgcctaggcctcctaaagtgctgggattacaggtgttggccaccatgcctggctgaatgaatttttaacgtaaatgtataaaacatgaatctcctctgaactttcaactgttgattccctggaaaatgaaggttgttgattaaatgcggtagtaacatatgtatgaataaaacatactgtatctgttggtgctatataggaccttgagagcacaagatttttcctaactattcattcttcacttttttagctttgttgcttaatatctattagtacttatttgatattttaaagcttaaggggactgagaaatgtattgttaaaaataatttaaattaaatgtaacaaaagatattttattatttctgatcttatgcaacagattttattggaggtggaatgaagtttgttggtaaccaataagatctatttcaaaatgtatagtatgaaatattttaaagaaaaaagaaggaaaaccagaaaagaaaaattaaaaaaaaaaaacaatgtcttggatatattattttttattttttgagatggagtttcactcttgtcactgaggctggagtgcaatggcgggatctcagcccagtccaacctccgcctcccaggttcaagccattctcctgcctcagcctcccaagtagctgggattacaggcatgcgccaccatgtccagctagtttttattttcttttgttttcagtagagacaggattttgccaagttggtcaggctggtctctaactcctgacttcaggtgatccacccacctcacctcccaaagtgctgggattacaagcatgacccaccacgcctggcctatcgtgggtattgttattagtggaactttcctttcttcaaagtatattgcaataactactaattttctccatgtatctagcaaagataaccccaataaaaggtattaaattataaagtaaaacctagctattggaaagaatttaaaaatagaaaattaaagctacccataattgtattacctaggaataaacaagattggattccattcattctagccctttaaaagtaaatatgtgcatgttgtcttagtttgggctgctataaaaaattaacatacactggatggattatacaacagagttgtatttctcaaagttcttgagcctgggacatctgatatcaaggtgtcagcgtggctaggttctggtgagggccatctccttgctgtatactcatggcagagaacagagaaagaaaaagcaagctctctcttgtcttttcataaaagcactaatcccactcgtgaaggtttcacggtcatgatgaaattacctttaaaggtctcaaatcctaatattacattgggaattagcatttcaaaatatgaatttttgtgggacacaagccttcagtccatagcattttttcattgcccacaccccaaatttatgttctcacatgccaaaggcattccttcaatctttacagccctgacgtgccagtgttacctctaaaatttaaagttcagagtatttaaaaatcatctaaatcagatatggctgagactcaagatactattcatctagaagcaaggaggaaaaattggggtatatattagccttttgatcttaacatagttacatgaatgttgatcattgtccaatattctattataatggctatataattgaatatttattgctctatcattctttattttataattctccaattgctgaatatattaagtttatttaagtttttactattataaataacactttgatgaacacatatgcatgtaaagtctatatttatacttccttaacatggattattaatacctggaaggaaaattactatttcagaggtaaagttttatcaatatcttcacttctggaaaacaccagtgtatgtggtgagaagggatcaaattgctaccctggtataattaatatgatatatttaggttttcattttcatttatatttcttatgtcacaaaaaacagaccttaattattatgtaggtactatacgagtgaaatgcatgtgttgttggtataaagagatcttggagctaagataattggctagaagtattgtcttcttgattggagcttgcatgattcatttcagatggttaaagtgtttataactgctttgaaagtttacataagagattagcttcatttaatttgttctagagtttctcagagtatcttcactactttcttttcttttcttttcttttttttttttttttacaagtttctgttgtatctctattgatatggtttggatctgtgtccccaaccaaatctcatcttgaattctaatccccatatgtccaggcagggacctgtaatccccatgtgtcgagggagggaagtgattggattatggaggcagttccccccatgctgttctcatgacagtgagtgagtttcatgagatctgatggatttaaaggtggcagtttttcctgtgcttacacttcacttctttcgcctgctgccatgtaagacatgcctgcttcgccttccgccatgattgtaagtttcctgaggcttccccagccatgtggaactgtgagtcaattaaacctcttttctttataaattaccacgtctgaggcatttctttatagcagtgcaaaaacggactaatacatctactaaatagaacacttatataaataagttcaattaaaaatatagtaatagtgttataggtagatagataggcttgaatggggaaggggagggttctccccccaccttcacccactagaaatgtcaagggatggttcggcagttattacattgcctgtctaaaagtgatacattgacagccagtgccagggataggccattttctgagggtccacacctgttaacattaaagtgtcagttaaagacaggcctcgggggaaacaacttgctgggcatgcatattaagagacagaaatgacgaagtatgatcttccaggtaccctccactggaaaaaggaagaaagccttagatgggcatgctaacaactccctaaacacactgcatgtgctcaattcccaagggtaaggaaggcactgtgcatgcgggaagcccaccctaagggaagaatcatgggaaagaggtgagcctataaagtcccaggatcaaggttaaagcttctcctttgttctcccttttaccttcaggcacccacttgcatctcttctgggggttctttcctttctttcctgttctaaggctttttaaataaacttccatttcttctctgaaagttgcctctgtctcttttcctgctttatgcccctcagttgaattatttcttctgaggaggcaagaattgaagttgctgcagacacatatggattcaacgtggtaaccttggagtaacttggatctcttccactgataaaaataacatggctggtagcacatttgtttttaaggtttagaagagttttgatgatgtcacttaataagaggatagaactgatcaattttgtacataacaagtcataatgttgaataactgtatttggaaagaaggcaaaaatccagaatttccacttcctgaattggtactatttgtctttccatttaagggttgatttgatcacagatcagggattcttaattgttggtcaagaatggttaaactcatctgttttttctagtgggtgtcatgattatttaacaaataaattaacttgccaatgatgtacatttaaaaaaaaaaaatacctgggttctgggattggaagagtgatcctggtatgtttgtgaagacacaggagagtggttatgggtagagcagaggaagcaaaaggagtactaatagaagagaaaataagaaaggtaacaggaggaagttttgtcaagcctactggctttaaggaatggacttttattctgaatgaactagtacaccattagaagttttgagcagagaagtggcatgtaatttccatcttttttttttttttttttttttttttaatttttaagacagagtctcgctctgtcgcccaggctggagtgtggtggcgcgatctcggctcactgcaagctccgcctcccgggttcacgccattctcctgcctcagcctcccgagtagctgggactacaggcgcccaccaccgcgcccggctaattttttgtattttttagtagagacggggtttcaccgtgttagccaggatggtctctgtctcctgacctcgtgatctgcctgcctcggcccccgaaagtgctgagattacaggcgtgagccaccgcgcccggccgtaatttccatcttaaaagcattagcttagctgctaagttgagaatatgcggtcggaaagcagggcagttttagtaagacatgttggaaatctgcttttcaacatgtaagatggtgatgtattgacccaggttgttagcagtgcaggtgttgaaaagcaagaaataaattttggagatagagccaaagtttttactagtggatgaggtggggttaggtatgactgcaaactttttagcctgagtaactgggaatatagagttgcagttatctaagttgaggattgatatggtttggctgtgccccacccacatctcaacttgaattttatgtcccagaattgctatgtgttgtgggagtgacccagtgtgaggtaattgaatcgtgggggccggtctttcccgtgctattctcctggtagtgactaagtctcacgagatctgatgggtttatcagagtttgctgcttttgcttcttcctcatttttctcttgcccctgccatgtaagaagtgtcctttgccttctgccatgattttgaggcctccccagccacgtggaactgtgagtctagttaaacctctttttcttccccatctcaggtctttatcagcagaatgaaaagagattaatacaagggtgaacgcagtaatgcaggcttaagggctgtggagaatcacaaaccatatctgggcatgttagggtatctggcaatttttagtaggcatttacttggagtgtggaatttaggagaggagtccctgctggagatatatacttggattttgtcagcttgtagagtgcattgaaagctacaaactgaagctattaatattaccatcattagattcaagaaatagtaaatacatggactcataaaaaatattttttgtatagtaatactgtctcagcaagtagacagttggagaaaacaagtttagattttgtgtcatcattatagagtcccataatctgacatggatttatagttaaatatttatgtgaagcacctattaaaaacaatggtaagatttattagaatgatataatttaggtcattcaaggttgccttgttcccctgtaccatctgttttcattttaaggtgtatataaactctaatgatataattttcaaactttatttattttagttttgctttcttgtctttccaatgtgcaacacattcctatttgtgatatccctcagtccaggtgaaagtgtgtggataaagatcttcccaactcacatgcccaacctccttccccacttccaccctaaccctcacctctttaatagccctttctctactgaaaatatcactgataaagtgactagctattttactattgcagttctcaaacaaaaagcacagtatggtggagagaacctttagcttcatggtgttttgatccgtaaatttaatctacatttttgtatgtgcatttacgagtgcttcatgaatgtctcctttttcattattaggtgctataggttgaacatagaatattaggactagcatataagccttgtattatttagttagtttgcagttgtgaccttatttctcgagtgctttcagatatacttcttcattagatgctcataaaagccatgtgaggtaggcaggatgtgggaaccccatatataccttaaaaaactgaggctccaagtgttttggtcccgctgaaggtacagagtttcatgacaaaatgagaacccaggtcttttgtatctaataaatatatatgtaggtgtgtgtatagtggaaatatacacatgcacatttgtgaatgtatatatatttcaatatatgcctatgtgagtgtgtctcctcataacaagacagatggtaatatatatagtgaaatgtgccagaggaaaaaaaatatattgttatctgtttatgtaagaatgctaaaatgtttgcaactgtctacaaagaaagaaattgttaatgtttttaattaacattcaaacaatttaaattttcattgtgtgattagttttaatagcttattttatattacttgagaatctaatacatatacctattaagtcattaaattcaaaatgactattcagaagatgcatatttaataaaataaaataaccaagtttgacaggttattttaaaacacttacagaccaagatttccaaaggtgtgtttaaaaagtaatagatggcatcaactttaactgtcagcaaagtcagtccttatggagttgcctaagaaatgtgattcatttgaaagtcatatttgataattctagggtaatattcaatctaaatttaaatttcatttacattaagtgaaagctcaaatttttatttttgtttttaattctgtggtataactctctcctttttggaaactaccacttggcttaagagttaatcatgattttgagagcactcttagttctgagatggaaagtaatatagtagtaccttcttctaaagagttttttttatgagtgaattgaatgtcattgaaggacagcagtggacatagttgagaaaaggaataaagacaaagattggttcacaaatttaatctaatgctaatgagacttcttatttagtttgtgtaaataaaataatacatgtaattagtgctgagcagcatatggaacccattgggaatgtgtatttctatgtgtatttcaagggcaccagagtcattttgtttacaagtacataaactgtaatgtaactttccactacaggcggcaacatcttaaaatatttcacacatatctgtttcctgatgtattttaataatcttcttccccaaatattaaatttgaattctactcaactttcagttggactctactcttaagtaatattaaaatgtttcatgccctttttttttgagatggagtcttgctctgttgcccaggctggagtgcagtggtatgatcttggctccttgcaaattctgcttaatgggttcaagtgagtctccggcctcagcctcccgtgtagctaggattacagactcacgctaccacacctggctagtttttgtatttttagtagagacagggtttcgccatgttggccatgctggtctagaactcctgacctcaggcgatccacccatcttggcctcccaaagtgctaagggattacaggtgtgagccaccgctcccggcctgtttcataccattttatttattatatctgtaaatgaacttatgctagtttcatgcctgaccctccatatgcattcaacagaagcttgcatacatgatgagagaatgaattcctataaacattgaacattcttctgtaaaaacttcttgatcttgcaggttattataacactggtatttcaaaagacactggctctagttagttttggacgtcaggtttttagctcctagggcaccatattcctctcattcctaattttttctgtttcattgatattttactgtactatgtttatccatttgtgaaatatgaattaaacattaacttttgatatgatttgatcaacatacttactaatagatgtcaattggaagtgaagataacacacttttgattgtagaggaatgtgatagtcattggttgactgagtggaggatttgagttataataaaaaaaagattactatcttttatttagaagacagattccttgggaagcagaggcaggtggatcacgagatcaggagatcaagaccatcctggctaacacagcgaaaccccttctctactaaaaatacaaaaaattagccgggcgtggtggcgggcgcctgtagtcccagctacgcgggaggctgaggcaggagaatggcgtgaaccctggaggcggagcttgcagtgagccgagatggcgccactgcactccggcctgggcagcagagcgagactctgtttcaaaaaaataaaaaagaatcagtgcttccacatttctcactgtgtcatgtaaaggtaatccccactaagagtcgtgtaagtagctaactcactaaagtgcatgcaatctgttgttgaacctcaaattttaaggaagcaagagatagtcctttgactcctcagccgtgtggggtgtgtgtgtgtgtgtgtgtgtgtgtgtgtgtgtgtgtgtgtgtttaagcacatataggtgatgagtattagaagggggaaatcttgcaaagccacaccacatcacaataaaaaatgtgctattcttctgagttgactctaatggtagggtatagatcccggggagtcttggaagaacatctttatgatttaagatgtcagaggttttctgagtaaaggaaatgttccagatcatcattctcttcctttttctattgagctcatcattctcttcctttttctattgagctcatcattctcctttctctattgagctcgttaaaagagtagttccccgcctttctataagatcacgttaatataatcagagactccacttccaacaggatgatgaaaatatatgtttatttgttttaagctggatttctaatgtttgcataaatgagtaaccttgaggaaaatagcattactattcattctcctttttcttcttattatttttttctgttttgaaagctggaaataagcctcagacatagccttcccttctaggttttcttaaatggctgtatgttagcacatctttatctacaaaagtagatttaggaaattaataacccaattaacattgtaaattaaaggtggtaacacacttgttcaaatctggattgattctaagtctcagacacttaaatttagagattttggcaagaaccaccaagtggctgaaataaatgaagaaaacaggaacagtgccaattagaacactggaagaaacccagaattcagtcatttaatgaagtgtttaatattgcagagcatgttattgtgatatattttatgtcaaagtgctaaatatatttgatcatttcaaatgatctctgccaccattttataaagtgttcatgtttggaacactcatttcaccatacatatttgtaggttctgtaaaatttgaagccattaattaagattgctaattttaaatgaagtatttttcccagcttattatactttctaatctaaacctcatataaactaagaaatagacccaactccaaaataatatatttagaaagccagtatatttagaatccaaatatatgtttattgaactaaatttgacattaatttatgaacaaatttgtgaatatgtgaaatatccagttttttaaagttttattttatttagaattttcacataattgtacatatttatgaggtacagtgtgatatttcaatgcatgtatacattgtataaggatcaaatcaaagtaattagcatatccattactttaaacatttgttgtttctttgtagtgataacattaaaatcctttcttgaaatatacaatacattactactagctatagtcactcaactgtgtgatagaacacccgaaattattgttcctaagtgtaactttgtaccctttgaccaatctcttcctatctccccatgctttcccctccctagcctctggtaaccattatgccactttctgcttttatgagatcaactattttagattcctcatatgagcgaggtcatgtggtgcttgtctttctgtacctgtgtaatttcatttgttataatatcctccagattcatccatgttgccacaaatgacaggattttattctgctttatggatgaatagtattgcattatgtatatttacatatttttttcttcattcattcataattggtcacttaggttgattttatatcttggcttttgtgaatagtgctgcaataaaaatggaagtgcagaatctccttgacatattgatttcctttcctttgactatatatacccagtaatgagatcgctgaatcatttgatagttttctttttaagtttttgaggaatctccatgttgttttccatagtggctgtactcagttacattcttaccaacagtgtgtaacagtttccccttctccacattctcatcaaatttgttaatttttatcttattgattacagccattcgaagtgggttgaggtaaatactttattgtggttttgatttgcattttcctgatgattagtgatgttgagctatatatatatataatgtttatatattatatatatttatgtatattatatataatatttatatattatatatatttatgtatattatatataatatttatatattatatatatttatgtatattatatataatatttatatattatatatatttatgtatattatatataatatttatatattatatgtatttatgtatattatatataatatttatatattatatgtatttatgtatattatatataatacttatatattacatataatatttatgtatattatatataatatttatatattatatatatttatgtatattatagataacctagaaagatatatattatatatatttatatattatataatatttatatgaatattattatataatatatataatcttatataaaatatattatatataatatttacatataatatatattatatgtaaatattatatattatatataatataatacatttattatatattatatatataatataattatatattatatataatatataatataattatatattatatataatatataattattatatatgatatataatatataatataatataatatataatataatatataaattgtatataataatttatatataatatataatatatattaatatattatatataatatataaatataaattatttatatattttccgattgtatgtcttcttttgggaaatgtctagtcaggtcttttgcctatttttaatagggttttgttgttgttgttgtcgtttttcctttttttttctgttgagttgttcgagttgctcatattttggaaattagcacttgtcagatacgtagtttgcaaatactttctcccattctgtaggttgtttcttcactctattgtttccttagctgtgcagaagtttttagtttgatgtaatagaatttgtctatttgtgcttttatttgtgcatttgaggtcttattcaaaaaattattgtccagaccaatgtcatgggagcttttccttagttttcacctggtagtttaatagttgggatcttacatttgccttcaatccattttcatttgatttttctaaatggtgaaagatgaggtctagtttcaccccactgtctgcatgtggatatttagttttccagagccatttattgaagagactgtcctttccctgatgtgtattttttggtgccattgtagaaaatcagttggctgtaaatgtatggatttatttctgggttttctgttttgttccattgttgtatgtatctatttctatgccagtaccatactgttttggttaccataactttgtagtgctttttgaagtcaggtagtgtgatgaaatatccaggtttagaaggaagtaaaaagtagaacacaggatattatggactgggaaggttaggagaaagggaatgatagaaaatttttaaagactataaaaatacaactagacagcaggaataagtcctagggttctataccacaataagatgactatagttatcaataatatattatataattttaaatagcaaaaaggaggaatgttcccaacaaaatgataaatgcttgagatgttgtatatgctaattaccctgatctgatcattatacactctatgtatgtacacatctctatatacctaataaatatgtacaattatgttatttttaaaaataaaatacaataataaaaaatcacatgtagcccataaatatatataattattatgtattgataaaaaattttaaataaaaaaatggtattcactatttctaggtcttaaaaaattttttaaatctttaattttatagaaaacccaacaaaatatttcttcaaaaaatttgaaatgactatttaatatataggtacaaaatatctgatatataattcatgagaacaccagacaccagtttgacttataatttgtctttcatattcttttttttttttttttttttttttttttgagatggagtctcgctctgtcacccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcatattcttaattctataacaattacaacaattcatggtatgttgttattaaagtgagttttatagaggaaggctgttacaatatctcatttttaacccatgtattatatatagttatcgttttaatagtaactgaaaataggaaagtttagatacataagtaaatatgtgcacacacacatgcatacatttataaactgccttttcttaagtgagaatttcacattttcaaaaaaataattgtgtatgtaagagttttgtttttaccttactgtcaagagagttcgatcattatcatctggacaatgggctaaaatgtaggagttgttctgtcttataatatcagaaaaataaaggacctattttatttcatagatgaattaaaacacaaaaatatattaatatagtagcataattttaccaggggcctgttactttctgaattggagtatctaaaggaaatttggggtactgtgttctatttacaaatgactagcaagactgattccgggatgaatgaccctcctttattcatgtgctctgtataaaggagaattttgtcattaataataatgattgtaatactgtgtgttgaatgtaaaccatcactactttacacattaaaacctatcctaatttaattaataaaattagccatcgctgcatcttcaacaaaaaattataaaattcttatctggattgattaaatttagttgagcccttaatcctgatcattctgcttgtttttgataaataatttgaaaataaattcaaattcattcaaattacaccttgatttcaagtaggaatagtttaatagtgttccaaaaaaaggaatgttaaactattgaggtattcttgacaactcttagagctgatgataagaaggttcatagataggaaggcaggaatgacttattattaagtcatctgagtaaatctgtcattgaaacctaacatagcatagtacaactttgagcaaatcaagactctgctgaatgccctcagttgtaaaataatagtgttgtactttacaatcactgactgagccccattttagttctttcataattatttttggaaatagtgattttcattttgttaaaaaaacactattggcatgtataacaaataatttataatatcttccccaaaagctctcacattaacccaaggaaggcattgaacatgcaaataaaatataattcaaagtctgtgttaaatcttgagactcaaagctcctatgtcccaaatgtgttgggtctgtgacacatggattgtcaaattcagaatcagagtaatgttttgtacaactagtagctccagcactgttccctgtggtctctggatggaagaggcagtcaaacagatgggtcctaatagccttctaagacgtgaatcaaggagcctcatcagcaaggctgatggttgccttttacattatccttgtgatgaacaaaacccttgggcctgactggcagcttcttctttacctcccttcacttcaaggctttccaggatacaattcccaaaagccctgaatgtactcttccgcagagggaaggctgtagaagtctttgcaagcttcatacagagaaatacaaaaggtgtgatgccattaactggtcctttctaaagcattaggaatttagtgaaactctcaaacacaaaactgaaaagccatttgaacaaatctcatatacttgtagataagctttttttatttaaagcatacaaattcaaatctttcaagcagaaaattcagtcaagtgagatccattggtggtttgagttcaaagtcagtgagcaaatggaaatcattgcggcatctctctcatttccctagtggacattagaccactcaaaatgtgtcacataatttacagccccttggtagtaattgaatatacacgttgagagtgcactggcagaacacttaagaaagattgaatgcaggaggaccagcttacgttatttttggctctactctggtttttgcttttaatgttttttcttgagattaatttcaattgggttgttccatcctattcaaacaaatgctttgagagaagagatgaacagcagcatcaaataaattgtgatatttagtttcagagacatcaggtgttgtaatcaaataagacagaaggacaaagtaaaatctgtgatttgccataaatgaatttaagctgtaagaatagcagaattgagaggtagattagcaatatgacttttgaactattatctaaatgtagggtgagattttcaagatttattttaatatataacatttttgctaatatttaggaaaacaaagaattttgtagttaaaagtgtgaaacattaaaattatctgtctttaaatattaattattctaaatctctcttttgtgtatctgttactagacacttttaattcttagacacatattttatgaagagttattcttaaaatggtatgctttgtttgccagtcaacatggaatctccctaggtataacctttaatatttaagagaatacagatcaaaatagtagagatttcaacttgattttataaagacgtccaagtattctgaacttataataggaaaatgagtcctgatagaaattgtcatttgaaaatttccttccttctcctctttctcctcctccttcttcctcagagcgagtatgtggtatccactgtgtacacgcacacaacataaaaaaatggaggtccgtggtacaatatgtgcatgtgtgtttgtatgtgtgtgtgcatatatgtatacacacacgtatatatatatatacacagaggtatatatatacacacacatatatatacactaaaatttcatatatattaaatataaattatattaaatatacaacatatatattaatctttacaatctgttacactcttcctttgagtgcccagattaactggctactaacatttactttaatatattgctttttattgagacaaaaacagtggaaaaaaagtaattaatcacaaactacttataaagttaatattttcccatgctgaagataaatgagaacatgtgcaagcaacttaatagcaatacaaatctatgtgagtattcacaaggaagaatttctctctcagatattttgtctggatttcaacttgctaagtagactatatacctaaaaaaatttttttaaggcacgacatttctttttctgctatttaatatgtaaataattgcatattaagaaataattttttgcttttgcagataaaaggatgaaaacacagactcttagctatccaaagcaatcttatcatattcatatatttatttgctatatctaaacatacatacatatttacctattaactttatcttacttccaatttacttttgtttttctcctgatatcttagcccctttatctttaaaatcttaatattgttttcttctaaatcagtctggtgtttttttcccctttcctcaagtttttttttttttttttttttttgagacggagtctcactgttgcccaggctggagtgcagtggcgcgatcttggctcactgtaacctccacctcccgggttccagagattctcctgcctcagcctcccgagtagctgagattacaggtgtctgccaccatgcctggttaagttttttgtttgtttgtttttttgtttgtctttagtagagacggggtttcaccatgttggacaagctggtctcaaactcctgacctcgtgatctgcccacctcagcctcacatagctcctcaaatgtttttaatacttgttaacctgtcaccaaaccaaaaactgtctttcatttcatatgtgacgtaccatcattttaaatcttttatatgtattactttgctttccataacaaattggtgtttatatggtagatagaagtcattgttcatgacattcgtcatttagtattaagagcatctttatgcgtgctgtgtataattcataatagttaaaaccaattcataatagtaaaaaactggaacatttctcagaaaaagtaatatcaccctcctttttaaaacaaagctaaatcctgttaattttcccttggtgagaaatagcaccacacattacagcctttaatggcttaaataaacatgtataatgcacagtataaatttgaaaagtagtcaaaatcctctctatcctccatctttgaacaaactgtgctgcctcatttgcagagatttgcagtaaaaatcaaagatggcttacatttttacactatgtcaatatttctttctctgtttcctgttacttacatcagaatgatgggctcttttcgtaaagcagtgactgaaggccaaaagggaacttacaaaagggcattatacaaattctaaatataaaactccccaaaaagggaaaatgatgttcagatacaataaaaataaattatagaataaaaatgagaaaagttatagtcgttttttgtacaataatacagtgtataaaggctaacgtcagtaatgtcaactttgttgaatggaaaatcctgaactggcagttgactctatttctgtcaaatcctgcttttatgttatgtcactctctgattactcagacctttctctatcctactatgaaactgaatgattctcagaaaggaaccaggacattctatcacttaatgccaaacacgttaaaacgaaagctatgaacaggcttcccaacattttgtagggttaaaaaagaaaaaagaaaaaaaaacttcaattaactcaaattgaatatgttcacaaatctcaaatgcacaaatgaacattttttataacaggtttattctaataagtcaaatccatccctcatacagatatctccatgctttatgaataatagaatgatgtgaaaatataaagtagggttcatgaaggtgaagctgaatgcaactagaaaagcaactaccaaaataaaaatacggaacacagtggtagatagacattactatggcaacctccgatccttactaagaagttagtgatcattgagatctttctgataacctgattgcttttgttttctcattcacctggacaataaatacttactgagtagatatctctctcgattatagcgactgactacctagtcatggttccatgctctcagggagattacagtcttgtaatggtaaacgcattttcaaaataacaagaaattcacctccgggctaaaattattttttagctattgattattgtttttatagttcattctaagtagaggggacaaggttattatcatataatgtgacttgtattaagattgctaaaagcaggggggctgatttcattcaaagaactgtgggagagaatgcctcactctcaacttagtgacatgacttttgttttcattacatttaaatacagctttgttttcctatggcggtaacccataacagtatgaagcacagacagtgcattattcaggtttaatttgggcatggttgaactgctgggagtgactatcaattacactggtattttaacatttgtatgaagaattatgtgccaaaatattctaaaatttaaaatttcatagagaaactgcttgaataagtgttccatatactcactcactctgaattttttggcatctgaatgtgtagaaagtttgcaggtgaacatgtgcttgtcaatacattgtcactgacctcctcccattcatgttgctggtcattggcaatttcttcttctggatgctggaattttttcactgagtcctatgagaagctattaaggggccagagacccaatgtattcggtctactacccactgtcccatgtttttcatccctatcagtgtaagtgatctgtcctgagagcaccgtcatctattaagcgaaatgcagatccccgggactccaagtaaaggacattcaggcataattgaggtgaaatatatggttatggacagagactctttgaaattttactgaatattttggattcctaaatggttaccttcaagacactgtgagtagcatatacatgtgtgtgcttgtacatttgtacaagcacatgaacacggaggtaacataaatgcatttcatcccagaaaaacaaggataataataatgataagtcagaaaactaaaagctaagtaaatactttcaataatgaacttctaatatttcaagcactgtttattaattaactttatcttcaacagcaaccttgtgttaggtaatagcattaccattctgtagaggagtaaactgagcgcagcaagattaagttatatgtgcaaggataaatagggagtaatggaagagccggagtttgaatctgaataatccaacttcaaagtgttaatcaccactccaggctgcctctcagccagttgaacctcataaaattcaagactataataagtggtcaaaaacctaagacgaaactctgcttacatggttatttaatatttgattgacaatgaaaaataattttaatgcataaagtcatgttgaatgtaactacaatattaaagatcataaagagtaaagtaagtaaaatagaaaaatcaaaataaaataaaaataattatgtttaagaaagaggattatgctgggtgcagtgactcacgcctctaatcccagcactttgggaggctgaggtgggtggatcacttgaggtcaggagttcaagaccagcctggccaacatggtgaaaccttatctctagtaaaaatacaaaattagctgggcatggtggcatgtgcctgtaatcccagctactagggaggctgaggcaggagaatcacttgaacccaggaggtggaaagcggaggttgcggtgagccgagattgcgccactgtactccaacctgggcaatagagtgagattccatctttaaaaaaaaaaaaaaaaaggattataataaattcagctacaaaagaaggaactaactgggtaaagtttaacagaggaaggaaatttcaagatactaaaagctcatcaggtaaacaattttctatctcaagaacaaatgataccagtgcacaggaatgacagaaagaataacaagatactaaattggctataatcagagacctgaaagtcaaatgccaaagccacaaagagtggaattcaagccagagccctaaagaaaaaatagcgtaacgagagagagccagcaaaaagcaaaatgaaaaagacgcaactcttgtcatagcacacacatgcaccgaaacaaaacaaaacaaaatgcaggaaaaacagtaaaaaattatctagctgtaaaaattacttggctgtacagcctcaattgtttgctccctgatttagaaattatcatatttgccaaaagtttgaatggaaatatacttttacttagcaaaacttccattattaaaaaaaaaaaaaaaaaaaaaaaaaaaaagctggccgggtgcggtggctcacgcctataatcccaacactttgggaggccaaggcaggtggatcacctgaggtcaggagtttgagaccagcctggccaacgtggcgaaaccccatctctactaaaaatacaaaaattagccgggggtggtggtgggcacctgtaatcccagctactctggaggctgaggctggagaatcacttgaacctggggggcggaggttgcagtgagccgaggtcacgccacttcactccagcctgggtgcaagagtgaaactctgtcccctgccaccccctggccaaaaaaaagccaaggtaaagagtacaacatttaagaagaaactttctgtaaacattgtaagaaatctatttaagaactaacagttgatatgcaaattgcaatttagagatcctgaatgaactaattaattaacaaactctcatttgttaagctgaagttaagtgatatgcttaatgaaaaccacagttatactgaagaggggaactctgtgtttaagtcttttcattaaaccagacagagcctaatcaatgaatatgtgtaacattgctgtataggtctgattacatgtttccttgtttttctaaaatgcttaacattttattctgatcttatactttaacaattgaacagcaagatgggctgtctataattcaaatttaattgtctttaaatcctaatctctaaacagtctgttaaatagaatgccattgattaagtgatctacaattaaatcagtgacataaaatccatatcagaatttaaggatttaaccaggagttctctaataagtttatgtcaaatataattcttaacaaatgctttctgtatacttttaagttatctcaaaatcttgaatttgaaatctttaaacatttacaggttccaggcatgagaattttcctgggggatgggggagggagaacaggaacctgggtgagtaaataatatgatgctccaggtttgtttctcctcagctgacatttatctctttggcatgatgaagggtagatcaacgttgactgtaaaaacaaacacgattagcactaacgcagcatatgttaacactgctgcagcctaatgatgaatgagctgtaagcgatcccaacacctgttcttgatgatgatgcgtgatacccaaccccagtggagtaatgagagcgaagacacagcggtgcacatctcaccgattacagtggtttatggaggcgttctggtagcattctcactttctgtctctccatctcttctctgattattctatattcgttcattcattcataacttcagaattggctttaagctatagaaatccacatgtgaggtcttacatgtattagccacatgagacgtattaggttacccaagtcctaagcaactggagaatatgtttttataccagaataattctttctaaaacaccattgttaagttagcctacttggttctaacgttgattgacattatcaagcatctcaactcgattggctctaaatttggcaatgcctgaagagagtttgataatctcaaaacagaatacctgaacttgtgtgatggtgtcttttatatttaatacacaaaatactgaacataagtatgaatattatgtaaagtgacaaattacgaacaatggagttctgatattatccttcggtcttgtttcagcaaggaataaatgatattcctatctgccgcttctacgtcatttaatgttctctgttattttatatatggtgccaatgtcccatatgatgtttctattactatgactatataatgtgaattacttcttctattcttaattttatttctggttatcctcttccttactgcttcaaaactttgttgttgataaaattttctttcctgttctgaatataattcctttacctgtgtttagatcatccttacctggaaggacttgtgtatgcattatttcttcccattttgaagcttttactcttactttccagctgacacttttgctctatttccaaatttgtcagagccttccattcttaaagaacattgtgtttctaattcttgtcttattttttgatgttcttcttcttattagcaatttctcaaacaaatggccaaattcattgctcttatgtcctcatattttttctttttaactcattgaaattattaaagaaatgtcaatatttcagattattaaacatttactcttgcaaaatttgtgaccattggcttttattatattttcttatagttttgcttaatatttattttaatgatcaaataataagttctaaaaataaggacaatatttgttttatttttcaatatttgttttatttttattttttaaagacctatgaagtagatgataaaagtgtaggttctggagctagattctgtaagttcaataccttgtattgccatatactagctgaatgatcatggggaagtttcttaatccttatgatgtggattgtctcatttgtaaaatggcaaataacaggccaggcatggtggctcatgcctgtaatcccagcattttgggaggctgagatgggcggatcatatgaggtcaggaattcaagaccagcctggacaacgtggtgaaaccccgtctctactaaaaatattacaaaaattagccaggcatggtggcaggagcctgtaatcccagctactcaggatgctgaggcaggagaattgcttgaacccacaaggcagaggttgcagtgagccaagatcatgccactgcactccagcctgagttacagagagagacgagactagttcaccaaaaaaaaaaaaaaaaaaaaaaaaacgacaaataacaacgtatagttcatagagatattatgaggaaaaataaattaatatatgtaaagagcgttgtgtagagagtaacacatagtaggtgtcctatgtattttagctaatgttgttatttagctcttgttattggtaccacctctgtaatccttgaaactagcactgtgcccgatatatattaatttttgaccaatattttgtggaggagtgagtgaaatgaattaatgaatcctgcatttaacacaactgatcattatacatttttagaacaattgtgtcttttgacttccacactaataatagatattactggttaaaacataacctttgcaaaacaaaatttcatttctaactcttctatgttagtcagtagaaaaactactctgcaagtcacatccagggaaaaaggaagatatttaagaatggctgaagataaagttactgtgacaattgcctcctcttccattcttataacgttgaaaagcattctcccaatggcagccaaaataatcatttaaaaatataagtcaaacagacttctaactttgcttaagccctcttgtagcttcctattgtaataagaagagaacccaaattccatccatcctgtccagtcaggccctgcttatcctggccctgcctattactctggatctatttgaaaccataagtttcagctggcatgcagcagaaaatcacagtggcctctgtgatttgaagaggccaaacttcatttctgccctggacacttgctattcttgcctataatgctttttttttttccccttggatttggatttggctgacatcttcttgtcattcagtttctgttgaaatgtgctttcctcaaagtcctccttgatccaccacctcccccattctattatgcattgttcctgcttgattttcttcgtatcactcgtatcactgtctgacattatcatttcaatgtgtttgtttatttgcttctcattatctgtctttttcactagaatgcaagttccatgatgaaaggagccttcagtgtctgattcattattttggcccactgcttagtacattatatgttattattaattatctgttaataaattaataaattaggctagaggcaatgcccttattacaaagagccttctttgtcatgttgtagaagtggaattgtattccaaaagtaacagaagccatcatagatggaaagttgaggctgggcacagtggctcacgcctgtaatcccagcactttgggaggcaaaggtgggtggatcatgaggtcaggagttcaagaccagcctgaccaacatggtgaaaccccatctctactacaaaatacaaaaattagcccggtgtggtggcacgtacctgtaatctcagctactcaggaggctgagtcaggagaatcgcttgaacctgggaggtggaggttgcagtgaaccaagattgcaccactgcactccagcctaggtgacaaaacaagactccatctcaaaaaaaaaaaaagttgaagattggcttatgcatgtatgaaaactttacaccagacaaagggtttgagttgaagaacaggtcaatttatggagaagggagaggtacattccggggggggggggtcttagagtgacaggatgctcaaagatgccataaggggtgatgtgtgttctggacatggtgaatgagtagctgaatctgcctattgcataagattcttttaagctagtagtggtagaaagattgaaatggcggaaaggagttacaatatcggctattctttctgggcaaagtgatttggaattgtcctccaacaagcatttgttttttgaaaagttattccactgaaagttgacataatgaaaatcataagaaaaatcatctatgggtgtaccaaagtcctagcggttctttagagcccagcttaagaactccatccttcatataaccctccccaataagaatgctgcaagaatgtccaactctttcattttatatgaatccagattcgagaacgtactgatatccccaagatcacagatgattaatctagggttaacagctgtaacatatatgttcagagtataatattcttaaacagaatcccccaaaacttgtcagcattcaaattaaaacacacataccacacacatacacacaaactctcatgtcccattgaaaacttctcactaaaacatacatcaagtttccaaaccacttcactggtggttttgagtcatatcaagaaccagatgccctctcagtaaaaaaacccaatgaacatcttattcataatggagatataggggtactagcaatggtccaggcatgtctgtcaaaataaagtgtctttcccctttaaatatctttgtaaggaataataaatagttctcctaataacaaatattggccatggaaagttgttagggaccacccacactatgtaaataaatattgtaaaactagcatcaatgtttgtttttgtaattttaaaaattttattggaacatctgtggaatataaagtaacaaaaggctcaaaagattttccattttaattaagggagaaaagatgcacaaaaacttcattcacaagcaaagggatgtgtatatatttatgatgtgtaaaggaatttcttgacaatgaatatctacttgtccttgcacaaaaatgattgtgcaaactttaatagcatgaagataatatcttttctttctagtgtttagtgcagttcttcctttcttcaattcccatatgtaggtaagtacaaaaacaaacaatagaaccaagcacatgttttaaattttctaagtgtattagatctttcatcttatttggtctttacacaaggaatactgtagaaccctgtctgcaagaacctgaaaattcctccatgtgacatggtgacctcccaggaaaagcacacctagccgaccctggataacttttgcttttgtctatttttatttgtgatttctaagtaacatgtaatttaagcaaagggactattcacgttaaatggaaaaaaaaaaaaccccacttgaaaagccctagtgtagaaggagaagaactagagcagtttcttgttgcatttgggatctggtctggccagcctttccactgaaggttgcgtgatcttgggcacgtcttggaacctgtctttccctctgacggtgctctctcagagagctgctaggggcggtaaatggctacgatatcaaattgagctaaggcagtctaccaggtgggtctttataaatcttgacacttttaaccatttcatcagacttttatttttgtaaggcagatgactgtaaagaaaatgaaggtagggattgtatctgcctttttctagtatgtgtctaacagagtagatacttagacatttcctgagtgaactcatgaatgaacaaaggcaatagcatttgacatggaaagttgggaacagatataaaatcctggatttaaaatgtcagtgagggttgaatatcctactgtggcttgaagacgccttactgctatgtcacatgcccatattccagtgccaagaggctaagagacttccaccttttgagttttggcagtggcaagaaggatccgctggggaaaatgagtcgagaagaacttccttcaggagctattgtggtagggctcttcatctgcctattacatatctgtagggaaagagcaactattttgatcaatcaggacaatggtataaagttttcctctgtctgaaaaaatatgttaggcctttctgtgttcatgaagagagctttccatctagcagataatattcacagtcaaatatagtttaaaatataccaattcacagaggagattcatctgtcttttgtggccctggtgagtgcgtcataattatataagcacacaaaacttcttctttgataatgatttgcttcctggcctttccctggaagtagaatttcatgcagcctcttggaatttgttctcctgttctccatttgttcagcctcacttgtaactgagagagtaaacatcttccataaaccccaatgtttatgactgactagtcctcccaacttgcttgtcagttgtattgattttatactccaggcaaccaaaccaatcatatcttaaggccttgctttaacaatataacaccagataaaactgcttctgaggacttgtggtttttaatctctaagataggcatgaggcttgaacgtatagaatatgttactttcaccttcttgcaagtttcatcagcaatggtacacagtacactagatacatctaaattatacccgtcttaggttgtatgttgctgctgctcaatgttacaatataattacatttctgttttcttctttttccaaccacatttaactgtttgggagttaaactcattattcacaggccattccaaatgcttttggaaaaacaaaattcttctccctaataacagtatatattcatagtaccagatttaacaaccattcatggctggcatcatcattattcaccttttatacatgaggcaagggggactcaggaagtttagaagtctgtactacatttttctgataatgaatatttgctatggaaaattattaggggccacacacactgtgtgaccaaatattacaaaacaagtaacaaagtttatattcacaatttattttattttattggaataactgtggaaaacaaagtaacagaagattaaaaatagaacctagcagagcaaaaaccagaccctgtttctcgcctctagagagcattccagagtgtctaaagaatgtccctgtcttctcactgtccctgaacaacctttccctgataactgaccagctcgccctcattttcaaagagctaactctgtcaaccaagggaaaaagatctttcagtataattttctacactgaccacctgtctctttccatatttagacataatttgtgctgctaaataaggttgccccctagccatacagactaaactctgaatttcaagcagatactttgtttataactgccttaagtcattagttctcaggatgagaaaactagttattttaagtaccaaaaatttggtagcagaccagagagaatttttcctctttatttaacgcccatgggcaaaacctcaggatgctgccatttgaatgcactgccatcgagtcagggccttcaccagaggcgcttttgtggctctccaccagatgaagtcaggcactccaacactctaaccacggtccgcagatggtggcctgccaccaccacatctgagctcccaggatttaaaggactcaactatgttccattcctgcccttttgtgggtttcctccttcaccacctctgagaaagccacagtgtccagaagaaggaggcagtccagcatcaacagtcagagccctctgcagcctctctcaccatctcctctccactctacccctcagtctgtaggtcaagaatacagaatgaatgggaaaaaaaaatctcccactagaccaaaccccgtctgtgattttggctttctacatgctgttaaatttttgcagaaaatgttcttttctcttattctatttcccctctttctaccctgtattaggacttgtttgagtgtctttccaagtggggatccaacatacacacgtctgtatttgagtgtatattgtacatgtgtacacacacttacagacacacatatatacaaaaacataaatgtgtgtatatatgtatatgtgcacatatacacacaaatatgtatacaaatgcatgtgtgtgtatatacatacacatatatataatacacactcaaatataaaagtatacagtcattgattttgttaggataacagctatttttagactcctattctgaaggctaacttgtggttaatgtcattttttgtccaatgacagaattacaacagcctgcccatttagtttagtgtcattccagaatgtttattttgggaatcatattatcctgacttcactctggtaatgtgaaagtttaacaataactctgctacattaattgtgttatttatttttttaacacgtcagagctagaactggaaggtttaaatggctaagagacaataaagagaggatgtgataaccatttctaggtgcatccctatgttaatctccaattagagagactgcgtaacatgaacagggacccaggacatgtacctacaaaaaataaggtacattagttagagttaaagtctgggttttctacctattaggaagaggtaaggaaataaaaggcccttaatatatttattctacataattcagatgtagtctaaaatagttgcaattagtgtgagaacaaagaatattatccttaaaaattctgaaggagagacagaataaatgcataggtctattctaagcacaaaattggaaaaatttgaatactgtactgtgattaggcttgataaatgctaagatgattaaaatacagttctcaccctgagagagtgcacgtgctggtttgggggaaaaaagtaatgagtaaataattacaatccagccatatgacccaaattcttgaaaatattgaacaagagccattaactctctcgggaaggttataggatattttccagaaaggagttatatttaaccttcctgaaagtatgtgtgtcaacagaggaagagcaagggcagctccctgcagaagacattccttcctctatagactacagaattagaagtgtctcctgaaaagacactttccttatgcgtgccactcagaggagccattttgctccagccttcaactcctcattgctagtaatttcaaatacttttcctggaattttgtggttctctcagtgattactttcatattgttttctcttttctgtcccatttctgctttgtttagcaagtaccagtaccagtaatagcttactttatagcaatttattttcacaaaaacccgtcagagactttaatagctatgtatatgtcctctatctttgtattcatggcttctagtcattttcaagataattgcattgatccagttattgagctgtgtgcattcaggagaacatgtactttaaccccaacctaattaataaaagctgcttttggtgatactgtgtgatggagaccatagagacatggttttgttgtagtattgttgaatcagaagttctcgtgaacatgtataatacctctccggggataacgttggttccaccagcatctgtaagaggaatgttctactttgtctgaacattctgcaccccagcacagaaagtgtcatggagatgaggttttgtacaaataactgaaaaaaattagttgagacgaaaacacgatagactaagttatttatacttttctaaatacttaatctaagcatacataaaaaattttaactaagatttatttaaagctatttagtcactttttagtcttaatgtttgctactaatcccttcatttatgatatttataaaacatttagccaggagctactaggagacaaagcaaaacaagcattatttcccttttctatgtttcaggttggtgcaaaagtaattgcggtttgtttcactgatttgtttctgtgtccccagtgggtcctcttgctatgcccaatgtccttggtgatatccagctcaacaaggggcaggcacatgtacatgttttacatgtaagaaaataatacagaacccagatgatacctagtgaattatactaagtgtattgtacaaagtaatgagatgagaactttgatgaattaaaaatactgttttaaacaaagatttcaagttaaaacttatattttattctctcactattaaacagtcctgcttttggagaggtgactttttttttttttttttttttttttttttgagacggagtctcgctctgtcacccaggctggagtgcagtggcacgatctcagctcactgcaagctccacctcccgggttcacagcattcttggagaggtgactattgattgattgtttaagtatttcaattcccttctagtttctaagctgaaatctgcatcagttcaggggacgtggccatcctttgtggtgaggcttttctacttcacaatagtgctcattaatatattaaggactcttctctttaaaaagaacaattatgacaagatggggcatttaaagtagagtgcactgtggtgctttgtgcctcatcgctgtcatgttttcaacaagagatattaaaagaagtaaatgccgggtggtctcatgaggatatggcgatttaagcctttgaaccttgggcatccagtatgacaaaatggctggttgctttgatgttgcaacatgagaaaatctgttcttttattgtttgcaaatgctagaattctttcacattgaaatgatcactttgcatatataccacaagttaaaatttaatatgttttgagaaagatacctctgaacaatatggacatggcaaaaatttgaaaggttctttttgtgtttttccccctaaatcatgaccttggatacactgaatttaaattgtttggttgtaggaaagttattaatagtacacattaatagtaatgtatactcatactttgctcataaagtaccttttaaggtaaatttataagatatatttaccaaatgtatttgtttttaggagtaatgtctcaccaaaggttgtaatttcagttattgaaaatatatttatatgggatatagatggtatttgtactgatgtttgttaagaataaactctataaaatggttcttaaatgattaaaagtatacattgtaaattggtaactggtgacagcgtgaagtaaaaacaaattgtagataatttttgaaggttagtctatgtgaataagtacatagctgctagaagtttatacaaataatgtaaatgcagttttttaagtaaagaactccttttctattagaaaagaagacacgtcaagtgacagataatttgtttcttaaaaaactgtttcctcctaaacaaaagatgggtaaaacatacagcaaagagaactatctcacctgtgttccaaccaatatttggtacatagctaaaagctgatttaattgaattttaaaatgtgagattatgagtgccaccattctgattgggagaaaagcaggaacttgtgttaccaaaacaagtttctctgaaatgtattttacctggatttagaacagatgtttataggacatgtcgatttcttattctctctggaatatgaatgtatgatctaaaaattgacatcatcccttttaacttaatcccctcccgaaggtacccttgctcctgtttatggcagaggtagtttccaagtgattgtctatcctgaaagatttctatgaaattattctggattttgtttcatctacttgcatgtagtatgttctcagaaaggcttttaggtacactaacatttttgttgtttgactttgattttttatgctgaaagttggctgaaatatcatctactaaacatatataatcaattaaaagacataccatgttcccagattgaaagatggtacattaatctattactcaatgcaatctcactaattatccaaatgtgatgttttaatgaaacttaataaactgctagtaaaatttttaaaaatatatgtatataattaaatttgtgttaaatgaaattatatgagtagatatgacatttttaaaagtggctcaaaacttaatatagctccattcattctactcttagcctttaaagttgcattccttaattaaaaagagagcattttaaacatgccaataaaaatattgaccatcttaaaatctttaaatgcctaactactcggcatttattgctgaataactaacattcaagatggtttacatattttaaatagtcacaactcttttcaaatcggtcatgacttaaatgcagctttcatatcagtttctgttttatgttttggtaagcaatttttgctattgataaatatccttaccattttagtctgatttctctctttgactgtcagactccggtggccctgaacaatgtttagattattctccaaaacttttggctaaggagataattttggaagtaagcttaattccttcacgttttgaatttaattagcagagaactgtttttgagtgaaaggcaggtgttttatgattttcatggtgctattccaaatataagtatattaaatatcattatttcaagaaattgtatctcattgctatttgaggacttcacaaattctctttcaggaaaaagtagcatgtccctggtaatggttttatatcatccgttggaaactgcatcatatgttttgtattttaaatccactgcaagaatcgtcgctcctggtaaaaaatcagagtgctctcaggattctaatataatcacatgtttaaactgtgctgcagacttcccaagtgtgactcattggccttttggaagtccaagcctaagcatggaagctactcaacatacgatgaggaaaaaaattatgaacgaacaaattctatgatcatacagatatttagctaaagtacattataaacttacatataacaaaaatttaagaataacccaaatgtttgacaataaagtttctttaagtaaatttcatattgtgcaagtattaatgatgtcgaatatcattttcctaattttgatattcgatatataaaaaaattaaatgtctttgaaaattgcttccaagatagtgcttttggttccatagttgtgtgtcctttgtttgtaaaatgtgacttctccttcaacttttaaattagaacttctcatgatatcctaaatgacatattattgtagagtaagtgctggaagtgctcatgtcttttgcttgtttccttagtgtcattctgtagagctcattgacttgaaggtgacagagacttacttctatagatactatatgtaataccatatgtcaatatctatagattctatatttgataccatacatgagtcaatcaatcagtcaacacatatgtaatcaaagttggcagtgcatttactcctgagttagatgctgtagggccactgttgtgtgtgatcttgccttccagaaacttacaaccaagttgaaaagacaagagccataaaataaaataatagcaaattaatataaaacctggataaagaatgtaataactagatgaccaatttgagagtgcttattgggacttatgaagaaaaagaaattgaaaaaaggtgagcctgtgtttaaaatttagaggggtatagatataacacagactgttaatgttttctttcaatatccattttgttttactattcttttttaaggtgttttattttagttgtttttacacgttacatgaacattcattcatcgtaatgcatattttatcacattttattgattgtccaatattcattttattgtttatccattttattgattgtccagtgctgacatctccctatgtcagcatttaataatttaataatttctgttgaacttttaaagggctttgggtatgtaatttctgttgaactttttaaagggctttgggtatgtaattatttaacaaagtgcaccaactagcagaattatctgtatacatagaagcgattttttttataatgatgatgatttagtcattcaatgattatttattgagtacctgttatgagccatggactgtcttaggtgctggtgatatagaactaaaagaaaaagacaaaactccttatctttgtggagcctacattttaattatgtaagtaggtaataaataatataagtagctaaagtatacagtgtgttgataatgattaataataaagagatgctgggtacagtggctcatgcctgtaatcccagcggtttgggaggctgaggtggatggatcgcttaggccaagggattcaagacctgggcaacatggtgaaaccctgtctgtaccaacaaaaaagtacgaaaattatccaggcacacacctctagtcccagctacttgggtggctgaagtgggaggacccatttgagcccaggaggttaataacaattgtaggtagggtagttggtggtagttggtgagaacttccctgaagagataattcttgagtaacaacttggaagacatgaggctaatatcatctatatctgggggaagaaccttccaggcggggaaactgaaggctgttttcttcactgcaggtggctgccacataaggctagtacttccctttcaaggtagggagtatcgaggaagaggcaaacacttattgctcagagaagaaaaaaggactaattttgctttagcaaacctgttatttttgtactctaaataatattatatctaaccattccaatattttgaaatcaagtattatataattctgatcattaatctttactaaaaactttgtatacatactctgacaaacaatctttcttcctcatgagtttgctgagtattgtggagagtgaagattaacaaaaatcgtgagaaaaaataatgtaatagcaacttagagatagttggagtgaagttaggtacattcttattaggagtaagaacaatcaaatccagcacttgcctcaagactcacatctttctaaaacatgtcacttctggacaagaggtgactaccccaattaagtaatttatttgtgtgggaggatctaactccagaactctgtaagaaaaagaggtgcttttggatgctgataaatcccccaaatgaaaagttatattaaaacatacatcttgatttcctttgaagagtgtatggtgtctgtcccatgactggcaattcttatcatccacttgagaagggataatctcactgtttgtcagttgagatggctgtaaactgaaaattattatgtaagcagcctgacgaaagtaccaagaaaactttaattaacacttgcatgattaagaaatgtaataaatatgatggtagatatgataaatagctttaatctcaatccctattacaatcacaaaatttaacttctcagagaaacaatctgatgactatgtactgacattttgaaattaagtttgaaatgttaatgtttttggttgagtatcactctttctgctgccccagattctagtgttagacatttatatgcttttcacttctcaagccagagaaccataacatgattggcatagatatctattctgttttttagcttctaatatctgaaagtctgaaccaattccaaagtgttgacattatacagtcatttttcatggatgtacatgttatggctggcatgtagtaggaccgagaaaactgtgaaatatataaatatcttcaaactactgttctatttcttatactttttgaaactgatctagtgatttgcttttgatttcctattgcagtgtttgattgtcatctaactgattattttaagtgatttaattatattataagatgaataaaattcaggcttccagttaactaactagcttttgttccctgaagaaattggcagaaaaggacatatctatttatgattttttttcctcaccaatttctactttaagagacatgttctcaagtagagaagattttcccacagacggcattaattggaaacgttgtaatgacaataacaagtatgcagaaatctagttgtttagaagaaattttctctttcttcatgaatatttggacaagctattccgtcaaatgtctgatatatttaaaatgaggccaagaagacatgcagttggttcacagttttccaaagtgtgtgttctagaacacttttatcactagatttctgctgggtttgtgtgacagtgcatcttatctccctcttcattaaataccttatttctcattcattgtttcaaggttttttgcttgtttgttttttgtttttttgttttgtgttgttttgagatggagtcttgctctgtcacccaggctggagtgcaatggcacaatctcggctcactgcaacctccaccttctgggatcaagtgattctcctgtctcagcctaccgagtagttgggattacaggcaccccaccataaccggctaatttttatatttttagtagagatggggttttgccatgttggtcaggttggtctcgaactcctgacctcaggtgatctgcccactttggctgcccaaagtgctgggattacaggcgtgagccaccgcgcccggcctttcaaggttttaatatcttctacagcaaagaaatctgattaaccttgcttaacccaatgtttaccaaatgtatttactgacagaccaattacatatttacatcagaccaattacatttacatcagaccaattaacatattctgagactagcatttcgggaagcaaatgctgctaaaacaccttagcaatttctgtgagaatgaaatccatatccagttaacagcgtttttcagtgttgtataaccttgtggacaatttgatactggtttaggttcttgaattattgaccttttaagaagtctgcaggtgaataataattggccacatacacagcaatgcacttagagcattattttaagttccgcacttggaaatttgccagcactactttggaaatggcaactaaagcaagcatttcatatattggattctatggaactttgctgaatttggagacagaaatgcattaagcagcattcaatataactggtcttaaatgtgggagggcttcgtgtttatttgcaacacataattttttgggagccttaaggctctttagactccaaagtgttttcctcacatcctatcactcaatgaaattccagctttggagctcctccatctttcattggaattagataatcaaaacaaccctgtcattttctatcctatgcctctgcttagcctttttctcttcctaaaatgtccttctcctttatgcctcaatcagtgcccttcataattctgtgctaccttcaaatgacccttcctccctcacacctttcctcattctcaccatggtgacagctgtttgtccaggctgtgctgaggtaatcgaaatgtttcctcttttctctgtgtctaaacgggactttgcttgcctctttgtcataacagattctatgaaatactgttactgggaaacacgtataatattccaccaacgttttcataatcacagacgacgttttgcttatgataactagtgtctttcacggagtagaaatgcaaaatcatacggcatggcaacttaaaaattggccttgaccatttcttttacactaggggagtcacatgaaaatgcaggttgaaaatcacattttgagttttttttttttaatttatttactaagatatactctggctacttcacatgtaaacaaagaatttatttcttgaggatcctggcattattggtacattttcttgttgtcacttggttttggccatttttcaactggtcaaaattaaaaaaaaaaaaaatttcaaagcaatatgacacctacaattacattgttaattttggctctccttattctttccagataattgttcttcatccattttattcctaagttagaattctttaaaataaacttttaaataatttcagacttatgaaaaagtttcaaaagtagtacagaaatttccttacagtttttaagcagcttccttaaaggttaacatcttacataatcagggaacagatattgaaaacaaaagattaacattgaaaccatcctattaactcatctgtagacctacttaagtttccttagttgtctccctgaggacttatttcctcagtctaggatccaatccctgatccaacattgcaggtagctgtcaggcactttgcctccaatctgatatttcttcaatctttctttgtgcgtcgagaatttgatatttatcaagagcgttatccagttattttgtagaacatcaatttcaggttgtctgctatgtaagtagccattatatcctttgaaaaatagtcttaggcatatttctgaagattacttgtgtggaaagcatttgtttcccaaatgctttgttgacttgcatcattactttccatgtgaaaaaatgcatgttttagcgtctaaaaaaaaaaaaaggcagaaatatcttattttcccctttcctgatgatttgtcctataatagtctttggaaagatttataatgagattgagtttcagagctttgtaagcctctgttcacgagtatacatcctttatcaaaaaatatttttaaaatgtgaagttatttatattagcattctccagagaaacaaaatcaataaggtatatatgtagatagatatatgagaggtaatttgttaggggaattggctcatgtgattatggaggctgagaagtcccatcacaggccacctgcaagctggagatcctgggatgcctgtagcgtgactcagtgcaagtcttcaatcctcagaatcagcgaagtcgagggtggaactctcagtctgaggctgaagtcctgaaaacctgaggagcctctgatgcaaataccagggtccaaatgctggagagcctggaatttttggtgtcggagtgttataggaaaggggtcctgatccagaccccaaaagagggttcttggatcttgtgcaagaaaaaattcagggtgagtccacagtgcaaagctttcaagtttattaatagtaaagtggtgaaagtacagctactccatagatagagtagggtgttcctgaaagtaagaggagaaatgcatccacactagatacaatacttgtttatgtatagtataaaaaaaaatcatggggacctgtgctctgctactagggtttgtgataaaggattaattttcttaattagtatattttgcaagaatcagtattatgatctttaaagcaaaattaggaatgcttcttttctcaagataacaggatatcaggacactcctaagtctgggtctgtttagtaaacattatcaatctgttcccttgcccgtaaacatctagaggctaggaatacctaacttcctgggaatgcagcccaacaagtcccagcctcatttccctagccctcactcatgatggagtcactctggtttgaaagcctctgacaccaggtcaggagaagaggggtgtcctatctccaggagagagagggaatgagaatttacctttcctctgccttttccacctatattgagggtggatcttctccacccactccaccgactcacacagtaatcttctctggaaacatcctactagacacacccagaactaatgctttactagctctccaggtagtctttaatccaataaagttgacacctaaaattaatcatcacagtctttttttttttttaaaccacacaagttatccattttctttcttagtgactactaggtaggagtattagacaacttgaaatgttgaaatttaattgtttcaagttatccattaattatcctggttagaaaatcaggcttgattggtgtacctctttaatgaatagcgcagagaaatcacattaaaatgtgatactgttaaaccaatgtgttaattctttgacacacttgctttccttctttcattttccagtgtgcctctctctcaaagtttccagactctgctttttcactaacttccttattcattttgaccaattcctgccttgactaatttaccctaatcaatttgcaatctgatttctttccctaccacttcatgagactgctttgctccctcaagaagtgcaaatgactttctaagctaaatctgctacttgcgtgcatcattgacaatgctggccactttctttttcagtgaaattcttaccctcttgtaacatctgacaaacattatctcttggttcccttgctgcttctccaaacatatcttctattctcatttttgctgcttgtcttttcaaatataggcattccacaggtttattctccaaccatgccgtgtttagagaatgctcaaatgctcccaaaacttcagttatcaccttcgtgcaactgactcaatctttaccttgaatttgcatattcatcctgaactttttgttctgaatttcccataggtactacagattcaactaggcactaaactgagattattagttccccttataaacatcaatttatttctcctactctcactccctgatttgggctgaagttaaattcagtgtttaggttctcccatcccacttgtcctctgcctcctaaaccatattattcttttaatctggactattctctccctctgtcactttatgtttgaacatgataatttttcatttaggtacagcttgagttctatctcagtgatacctaccctattcaattcagaaagaatgaaagaactctcatgtaattaacttcattgcatcgtgtttcatcattagttgtagacatgtctgtattgttttcctcatcagaatgtaagtctctcaagcgatctttgtggaacttgtaagtcggtcattaccttctttctttctttctttttttttttttttttgagacagagtctcgccccgtcgcccaagctggagtgcagtggtgcaatctccactcactgcaagctccgcctcccaggttcacaccattctcctgcctcagcctcctgagtagctgggactacaggcgcccgccaccatgcccggctaattttttgtatttttagtagaggtggggtttcaccttgttagccaggatggtctcgatctcctgacctcgtgatccggccgcctcagcctcccaaagtgctgggattacaggcatgagccaccacacccggccgctcattaccttatttctataatgatttgtgaattggcctgaaataactcatccctgctttgttgttgttgtgttgtgttttgtgattcagccctgtaaacggcatgctcctcccaggaatgataatgctacactgtaacacagatcattggtgtttcaaaaaacccatccatccatgtcttcatttatttgcaaaacaagggcaggaaaaactagaattaaatcgttaattctctctcggtctctcagggcaatatgttgggcagttacttgagtgagatattttttatcaaaccaaatatgctgaggcaggaataacatcaaaggtgtttgtgatgtactgttgctctcattagttacctgcagatcaaacaggtatctgttctaacacttcgattttgaaacttaatgctgtgtttgttaaatttacttaattaggacctcttaacacctcagatagtcgcttaaaacaacaacaacaaaaacaacagtaatacccagctgttagccctgcggatgaaacaataaatgcaaagttaacactttttaaaggtgaatatgtacattttgatgcctcgacagcattcagtaaaaatcaagtgtgcttagagataatctactaagttgctgattgtttctggacctgtaactcttaataaatattgcaaatatctaaaagatatggatcattatttaggggaaatgtatgtgtatgcataaatgcaatcttttataatctaaaaatacttttcaggagctctttctgagatgaagagaattctcaatgtcaagatttgaacaagaagagaatggaatacacaatatggtaagtgacttgcaaaaaagatcaatgtgaccacatttctagtgctccattgggcagttatcacttgtaagttgcatgcatagaaaaatgcatacttatggtagtcactgttgcaagcagttctgaaatattaacacagttgatcaaaattgttccactcctaaaagcttattttgataaacttggtgtaaaagatacttggctatcactcatggcaggtgattttactctaatttttaattagggaaaattaaggttgcttatgtgattaatgtcacgcacgtccatgtgaagagaccaccaaacaggctttgtgtgagcaataaagctttttaatcacctgggtgcaggtgggctgagtctgaaaagagagtgagcaaagtgtggtgggattatcgttagttcttataggtttgggataggcggtggagttaggagcagggggtagatctcacaaagtacattctcaagggcagggagagtattacaaagtaccttttcaagggtgggggaatatcacaaagtaccttctcaagggtgggggaatatcacaaagtaacttctcaagggtgggagaatatcacaaagtaccttctcaagggtggggaaatatcacaaagtaccttctcaagggtaggggaatatctcaaagtacattatcgcaagggcggggagggtgtattgtcataaggtcaattgatcagttagggtgcggcaggaacaggtcacaatggtggaatgtcgtcagctaaggcaggacctggctatttgcacttcttttgtggatcttcagttgcttcaggccatctggatgtatacatgcaggtcacaggggatatgatggcttagcttgagctcagaggcctgacattcctgtcttcttctgttaataagaaaaacaaaacaaaatggtggtgaagtgttggggtggcaaaaatttttgcgggtggtatggagagataatgggcgatgtttctcagggctgctttgagcaggattaggggcagtgtgggaacctagagtgggagtgattaaactgaagaaagattttggggtaaggggtgatattgtggggttgttagaagcagcatttgtcatatagagtgattagtgatagtctggatgcagttttgtaggaattgagagattaattggaagacacaagggccaagtaagagaaagagaaaaacaggtatcaaaggactaagaattgggaggacccaggacattcaactagagagtgcccaagggggttcagcctaattatttgcttgtttgatgagtttttgggctctatccttgcatttttttatgttgtcatataccaggccagactgatttaggtaaaaacaacactcttcatttaaaaatacacagagtcttcctttttcagcagtgagtaagtcaaggcctgttcctgttttcttatattaataataataataaaaaaacaaaatagaagtaaagtgttagtgtcatgaggggaacaggaagctgttcggtcctatttgcaaattgattttgggggtaaggctaactagtgtacatgtgcctgtctaattaataggtagacacatgtaggtgaaggagccacagaggaggaagacatcttttttattattattattattattattattatactttaagttttagggtacatgtgcacaatgtgcaggttagttacatatgtatacgtgtgccatgctgctgtgctgcacccattaactcgtcatttagctttaggtatatctcctaatgctatccctcccccttccccccaccccacaacagtcaccagagtgtgacgttccccttcctgtgtccatgggttctcattgttcaaatctcacctatgagtgagaacatgcggtgtttggatttttgtccttgcgatagtttactgagaatgatgatttccaatttcatccatgtccctataaaggacacgaacttctcattttttatggctgcatagtattccatggtgtatatgtgccacgttttcttaatccagtctatcattgttggtcgtttggattggttccaagtctttgctattgtgaatagtgcaataaacatacgtgtgcacgtgactttatagcagcatgatttatagtcctttgggtatatacccagtaatgggatggctgggtcaaatggtattcctagttctagatccctgaggaatcgccacactgacttccacaatggttgaactagtttacagtcccaccaacagtgtaaaagtgttcctatttctccacaacctctccagcacctgttgtttcccgactttttaatgattgccattctaactggtgtgagatggtatctcattgtggttttgatttgcatttctctgatggccagtgatggtgagcatttcttcatgtgttttttggctgcataaatgtcttcgtttgagaagtgtctgttcatgtccaagaagagaactttgtaaggcaaaactggaaatgtaaagtgaaaagacaagagggagcaccaaaacaggtgtcttgcacccagactcttagggatttagtaagggcagcagccgttagaggttgtaatggggattgatggagcaactgggtagaaggggaggtttgatttttatggtgtatgagaaagtacaaagtgtctacgagtaaccgttcactgctattcatggggctgggtataagcaagcaagaggaggggctaagaggagagtccaaagaacaaggggaaggtagctaaggatggagtgaaatgcagggcaaatgtcttaaaggaaatgagaggttctaagaggcgggctagtggcttgtaacttacatggaagaggttatgaaaagacgaaagaatggactgagcttgtgaggcaggaaggatgagttttccatgatctaagaaccacttgccctgagttggaaaagactggtagagcaggttttcagaagaagagtaggtgggagtgatagaggagaaaaaaaaatactggccctccggagtgggggctggaatattagcgggtgtggaggcattggttattttttttttgcaataagatcagtaggtttctggtgtcctttacaatgaatgattccagccttggctggcaggagaacaaccttaagggcctctattagggaggcattattagtggaagagctttgtgtggtaaggaagcctcttttgacccagatggcagcatggttatggaggatgtggaaagcatatatggagtcagtataaatgttaatgtgcattcctttagctagagagagcacacgagttaaagcaatcagtttggcttgttgggaagtggtggagggaggaagtgcagcagcttcaataatagaggtgtgggacatgacagcatatccagctttagctggtgaaaattgattgggtttagaagaaccgccatcaataaaccaagtgtggtccgggtttggaatgggaagattagaaatatgaggaaagggagaagatcctatgtgtgttagggaaatacagtcatgtggttcaggacttgtgttgggtgctaaatgagaagctgggttgaaatcaggcccatgggtaatagttactattggagtttcaacaaagagtgaatagagctggaggagttggggggcagacaataaatgtgaaaggtatgaggaggatattaatgcttgaaggttgtgagagctgtaaagggtaagtggagcatagcctgtgatttttgatggcctctagaagtatttaaatggcacaaacatgagggccagcccagaattgtgaagttgagttgtttggatagaaaggctatagggcacggtcccagctcttgtgtaagaattccgactgcacagtcctgtactttggttgtgtgtaatgaaaagggttgggatgagttagggagagctagtgtgggagcagcttctagggctgtttttaaggaatggaaagaggagtggggaaaggatctaggatctatggggccaggtaggtttccttttgtgagtttatgtaatggtttagtcaggatggcaaaatcaggtatccaaaggtgaaagtacttaaccatgcctaggaaggaaaggagctgtggctttgtagaaggggttggggtttgggagattagctggacatgatcagcagggaaaacacgtgtgtttttatgaagaatcatgccgagataggtaaccgatgaggaagaaatttgtgctttggaggggaatatgtgatatccctttgagaatagatgttagaggaacaggagggtgtcctgttgagaagattttggtgggggggggcagctataaagtagaaggtcgtgaaaatattgaataaggtgagaagcagatggacagaatgaaagtaaatcatgagaaagggcttgactgaagtaacgggggctgtctgtgaagccttgcggcagtacagcccaggtaatttgctgagcctgatgggtgtcaggatcagtccaagtgaaagcgaagagaggctgggatgaaggatggaaaagaatagtaaaggaagcatatttgagaaccagaacagaatgatgggttgtgaagggaggttattgaggtgtggctgtagcccaggaatagtcagggaagcaaataatttggctaaaatgtctcgacctaataaggaagctgggcaggtgggaatatctgaaaaggagtgcttaaaagagtattgtccaagttggcaccagagttggggagttttaagaggtttagaagcctggctgtcaatacccacaacagttacggaggcaagggaaaaggcccttgaaaagaaggtaatgtggagtgggtagcctccgtattgattaagaaagggacagacttaccctccactgtaagagttacccaaagcatctgtgatggtccaggaggcttccgaggcgatcgggcagcatcagtcttcagctgctgaaccaagaagatctgggaaggagtcagagagccttgggccagagttccaggggctctgggagtggctgctgggatagttggacagtccaatttccagtggggtcccgcagagatgggacgcagcttaggaggaatcccaggctgctggcattccttggcccagtggtcagatttccgtcacgtggagcaacatcctgggggaggaggtcctgaaggaacgcctgtcctctgcggtttaggcaatttgaaggtcttgtgtgctggggatacggctagggtttctctcacggcagaggcaagtaatcgcaactcagaaatatgttgccacttggctgactcttttttattattgtacaccttgaaggcgaggttaattaagtcctattgtggggtttgagggctggaatctaatttttggagctttttctagtatcaggagcagattgggtaataaaacgcatattgagaataagatggctttctggcccctctgggtctagggcggtaaagcatctaagggttgttgccaaacgggccatgaactgggctgggtttttatatttgatggaaaagagcctaaacactaactgatttgggaaaggtctgatagagaaaaaggagcattaaccttgactatgcctttagctccagccacctctttaagaggaaattgttgggcaggtaggggagggctcgtcatggaatgaaactgtaagccagactgggtgtggcaggggaggtgatagaggggttgtagggtaggggagcggaagctcaagaaaagctggagcctgattcagcctggcagggagcgacctgaggaggagcagtgtgggaagaaggggagaggtcagatgggtgggtagaaaaggaagattcaaaagacttagtgacgcttggggttgggactgaaggaacagacagaagagaaagaagaaagatgtgggacaagtcgcactgggagcagagactagggagggaccgatgtgtgaaagaatgccgggatgtcagtcacctcagaccatttgcccatttttcgacaaaattatctagatcttgtaggatggagaaatcaaaagtgtcattttctggccatttagaaccattctcgggttttggcaccaaatgtcgcgcacatccatgtgaagagaccaccaaacaggctttgtgtgagcaataaagctttttaatcacctgggtgcaggcgggctgagtccgaaaagagagtcagcaaagggtggtgggattatcattagttcttacaggtttgggataggcggtggagttaggagcaatttgttgtgggcagggggtggatctcacaaagtaccttcttaagggcgggggaatatcacaagtaccttcttaagggcgggggaatatcacaaagtaccttcttaagggcgggggaatatcacaaagtaccttcttaagggcgggggaatatcacaaagtaccttcttaagggcgggggaatatcacaaagtaccttcttaagggcgggggaatatcacaaagtaccttcttaagggcgggggaatatcacaaagtaccttcttaagggcgggggaatatcacaaagtaccttcttaagggcgggggaatatcacaaagtaccttcttaggggcgggggaatatcacacagtaccttcttaagggcgggggaatatcacaaagtaccttcttaagggcaggggaatatcacaaagtacattatcacaagggcagggagggtgtattgtcataggtcaattgatcagttagggtggggcaggaacaggtcacagtggtggaatgtcatcagctaaggcagcacctggctattttcacttcttttgtggatcttcagctgcttcaggccatctggatgtatacgtgcaggtcacaggggatatgatggcttagcttgggctcagaggcctgacaattagaacatacatatttgtgatcctacaaccatggagtttcttaagatgacatttaggattataatactggttttaatagcaagccaggaatttacagtgtcttaaaatgtggcttatttcttattcagactattcaacacacatatgcgacagttaaataaatatatcctgatatttacagggctttttatttgtttacaaaagtaagttagttttatgtagtttgtaagaatctttaacgtgttattttcttttcttgctgtgtttactacagtgagtatattaagaatgtatttattaggtaagtctcttttttacttcttgtgctattcagggtctcccagacaatgagtagtaagacagttgagagagtaaagaaaaaataagagcagagagttccagagtcatttgtggtgtgtgaatatagacacgttgctagctgtgtactctacccctcccactaccatcccaccccatcaagggcccaggaaaatgctgcatgtttacagtgtcatccaggcacaaactacctttttctgtagtagtcaaatttcaaaagacatttgtaggtcctactttatttagttagaaacattcttctatactagaagcccttaaatttggatcaaagagtaagttttatacaaaataataagtaatcactccgaaattatatgcgatacattgtgtttatatttttttttcctgtggagaccatcagttggtttttattaattgttcagcgatagtgatgacagaaaaagttgtctaaaatggttttacaaatttagaatagatgtgattaaaatgaagattttgaaagaattgtggagtttgtttgtattttattatcatgaattctccagattgtgttgactgtaaaatttgtacacttatgactcattttaatgattttttttagagaaataaaaacatttcaaaagagtttagttcctactttcccttttgtcattctctgaaacctaaaacaaatttgcatagttattcttgcaaataaaaaaaacataaaattttattcatgtttgttctgtagtcattttacaaattcctaaaataggctcttagttaacctgtggctaaatgtatattttttaaagatatctattattttacaaatattcccatgatattggctttgttatctgaatattgatctctattatctccagattattttgttttttgttttttgttttttttgcttgctttctgtcacaattataaatagaaaaaccagttctgacccaaacataatttttctttacttacctggaaattctggaaattatttgttttgtctcctacatagtatctctctccctgctaatgccaatgtatggcctcctacctctgtttatactcatgaagatacttattctttagtattacagcagcatattttatcttcatcaaactctattaacaaagattctccagcccatgtctacactaactgatcaccagttttattctctttcattagatatgctaattataaagaaatactctagatattttgacgatttctttggtgggggaaaagaggagtgtaaggatatagaagaaaataaactcagattctcctgctatactctcacaacacagaacatgtctgtgaccaaatgtgtgtggatttttttccccacacacactaagcaattctccagcaattaattctgcagtggacaccagctgggtgtcctctaattctattcagttctgactctcaacctcaagatagtttctgagcccacaagttgagggcccagtcctcttactgaccccacacactacttcagataccagtcacaagtagtagagcccatacttctgaccaactgtctgtaaatcagggttcccacgatcttctctctctttttttttttttttttgagatggagtcttgctctttcacccaggctggagtgcagtggtgcgatctcggctcactgctacctctgccttcctgtttcaagtgattcttctgcctcagcctcccaagtaactgggattacaggggtctgccaccacgcctggctaatttttttaatttttagtagagacaggatttcaccatgttggccaggctggtcgcgaactcctgacctcgtgatctgcccacctaggcctcccaaagtgctgagattacaggcatgagccaccatgcccagtcattgtttttttgtttttgtttttttttgagatggagtttcgctcttgtcacttagggtggagtacaattcgcaatctcggctcactgcaaccactgactcccaggttcaagcgattctcctgcctcagcctcccgagtagccggggctacaggcgtacaccaccactcccacctaatttttgtatttttagtagagagatgggatttcaacatgttggcctggctgatctcaaactcctgacctcaggtgatccgcctgcctcggcctcccaaagttccgagattacaggcgtgcaccaccgcgcctggctgatcttctctttgagtttgattaatttgctagagtagctcacagaagtcaaggaaacacttatgtttactggtttattataaagcatattacaaaggatacatatcagtgatcagacaaatggaagagatgcagagggcaaggcattcaagaacaggtgcaggctgggtgtggccacacctgtaatcccagctacttgggaggctgaggcacaaaaattgcttgaacctgggagtcagaggtttcagtgagccaagatcatgctactgcactccagctcggaataagactgtatctcaaaacaaaacaaaacaacaacaacaacaaaaaatacaggtgcagagcttccatgccctctttaggtgtgtcaccccacagggaacctccacttgttcagctatctggaagctctgaacccagtccttttagattttcatgtttcatggaagcctcattatatagtcacgattgattgaattatctgccattagtgatcaacttaacctccagcctttattctatcccccaaagctggaggggcaggcaaaaagtccaaaccctctaatcatgccttggtttttcctgtgaccagccctgtggtcatcttatttgcatcctagatactcttatgactctagagattccagaagttataagagctatatatcaggaaacaaggatgaagaacaaatatatatacaagtgaccatgcaaaaatgcaggggttaggggtggcacagtaaaaaatccacttagaaattttgagtccccaaaagcttaattaatagcctactgttgactggaagccttactgataacataagcagtcaattaacacgtattttattttatatgcattgtgtattgtattttcacaataaagttagctagagagaaaaatgttaggaaaactataaagaaaaaatatatctactatttattaagtggaagaggatcatcataaagctcttcatcgtcctcatcttcacattgagtaggctgaggtgggggaggaagaaaagggggtggtcctgctgtctcagttgacagaggtggaggaggtggggaaggtagaaagagaggcaagagaggcagatacacttgggttatgaaaagacatcctaactgatgtctaattgctttttaatttctctaaaaatgtttctgtatggcaacaactcttccaccattttctttaatttttccgcccctatcacaaaacagtttatgtcataaaataagtcaaaatgggtctagaataaccgaaatccccctgccaaattgtctactgtcagtttgttttctggcattacttcttctacatcttcttcctcatcacctggtactggtttggaaccacttacctccatcaaatctccttccattaattcctcctgtgtgctgtctattaactccaagattctccaagattcatatcttgaacccccctccaacacatcatttttgccatatccgctatctctttcatgatttgtttgattgtctctgttgtaagtccttaaggtcatgcacaacatctggacacaatttttccagtaggaatttattgttttaggcttgatggctttcacagctttttctgtagcaacagtggcatcttcaatggtgtaattcttccagactttcatgatgttctactggggttctcttccatagcactgacaatcctttccataaattaccatgcataatgagctttaaagattcttatgactcccttgtctagaggatgaattagagatgttatgtttgggggcaggtaggccacttctacaccatcagtgttgaactcatggggttctgggtggctggtgtcattgcccagtatcatgagaactttaaaggcactttactggcaaagtactttctgattcagggtcaaagcattgatggaaccaatccagaaagagtgaaagagttcttgttgtccaggcattcttgttgtacaaccaaaagactggcagctggtgtttatcttttaccctcaaggcttgggagttagcagctttatggacaagggcagtcctaatcataagccagactgcatttgcacaaaacagtagagttagcctatgccttcctgccttaaattgtggtgcttgcttgcttctcttccttactgaaaaaaaaatgtccattgtgactttttgggcacttttgtctgcattaaaaaccagttcaggcagaaaacctttctcctcaatgattttcttaatggtgtctgggagctcatttgctacttcttggtcagcagaagctgcttcttcttctgttattttattttatttttttattttttgagacgaagtctgtcgcctgggctggggtgcagtggcatgatcttggctcactgcaacctctgcctcccaggttcaagcgattctcctgcctcagcctcctgagtagctgggactacaggcatataccaccacgcctggctctatttttagtagagatggggtttcaccatgttggccaggctggtcttgacctcctgacctcaggtgatctgcccgcctcggcgtcccaaagtgctgggattacaggcatgagccacggcacccagccttcttctgttatcttgacaatttcaagcaacacctcattctgaaattatcaagccatcctttgctggcattaaattttctagttttacctccttcaccttccttttgctttaagttgccaaataataatttcactctttctcaaatcatattagtgtctatacatatgtctttctcacattgatcttaaaaccacataaaaggtgcacgttctatacaatataaaaaagtattttgcagaaagtactggtgtaattgcagctatagcttaatgaatttttctttttttgcaatggttgttaagctggattcatttctcttgaaacgctgggcaactgcaactgcagacctcaatctatgatatgtatcaaacaattcaactttttcttgtaatgtggtgacttctctctgtttcttgggagcactttcagtaacactaatagcacttcatatgggcccatgctgttattcaaggtttacaatattgcgctaacatgaaaaatacatgaaaactacaagagatatgtttactatgtaacatattttactggagaaagaactgatcacttgaagatgattagcttcacatggtgctttaaatgcatacttgatcctttcaacatgaattggcaacaaaagatggctataaaattattaaaatagtacagcttatatgacttaattttatgcagttatataatacagcatctttatgtttggttacatttctctggactgcaaatatctttgtaagtgtttgtgtttgtacagtttggtaaattttaacttttaattgtagatttgtatctattttatagtaataaatgataaaatagagcagtatttacatatattttatgcattttcatgacatatctaaccttttctgaattttttcaaaatttctgtgctacactgtgagttttttcaaattgtcacaaatttcacaaaaaaattcaaatgtatctattgaaaaaaatctgcataacagtgagccttcacagttcaaggctgtgttattcaagggttagttgtatatgttattaaaattcacaatctcacaaggagcttatgctgctttctgacagcccaagaatgcttcccatgctagctcatgtctttatttgatagtaaatatgttccccacctaaaagatgtctgaagcccattagctttactcatggtgccagaagtagtgtaatattttttcttctcttagtgaatttcttttccagaaaaaagagttgaaacttaataagatcaatatagaaggccaaaagttgtcctgagcaatggggttatttcttaaccagatgcttgtctcttctccccagctgcaacattcctctgtactgaatttctttagtgccaagggggataagtggaaagagatgaaaatatagctgctgttgcatggatgaccccattcactctgactccttcagcaagtttcatttttccttataattctcggaggaatgctttgcctaaccacctaccccaacatctaggatttacttttaagatggtcagttaatattgcttgaacataaacttttggccagagtaactggaaatttaagtttattaaacttttacatacttaactatggtctacagggtattttaaactctgccatttgggtttagatctgcttttttacccccacccccaaatgtgcagcagtgtgaaatgtatgagaactaattggataaagtaatttttttaagaccttggtatcttatttctgccagataatagagaacaaatataaaatattcccatgattaaacacaccagatacagcttgaatttttagaatattaaacaggagtgataatgaggaagaacttaggtccctaattacaaaaggtttacacacacacagacacacacacacatcatattaagaatgtaagtaaatcaagttacaacacaatatatgcagtaagatttcctttcttataaagccaactatatcaagcaaattaaagtcacatatatggaatataatttaatctgttttacaagtgagggctgggggtggtggctcaagcctgtaatcctagctctttgggaggctgagacagaaggatagcttgagcccaggagtctgagaccagcctgagaaatatagtgagaccattgtcttcacaaaataaataaataaataaataaatttctaaaaattaaaaatagggtaggtacggtgggccacgcctgtaaacctagcactttgtgggggccaagatgtgcagatcacttgaggtcaggagttcaagaccagcctggccaacatggtggaacgctgtctctaattacttgaacccaggaggtggaggttgcagttagccaagatcgcaccacttcactccagcctggtcgacagggcaagacccctgtctcaaaaataaattaatattacaaaaaaggtacaagtgattatgtatttttcatacaatgcatatttcctgaaaacacattcagtttagtagttacattaggggaacagaatactatcattatggaaaggaaggcatctttattttatgctttgtatgcttctgtatgactagattttttaaacctcatgaaggtattacctttccaaacagtctgctatgatatttattgaacaagtattcaaatgtttcctttgcatagtttactacttggtggtattctgcttagcaatgtctattggaaggtcccagtatatccaatataaataaatgaaataacattgtactatattattagactgtattattggattacataaaagtttttttctgataagaatgtctgttatatttttctcttcttatttcacagtgattaggctgactgactttctctttcacttgctgttaggatttctggggacattacttcccatctcccttatctagtcagttcagttcaccattttgcaaccaggactatcattcacaagcctggcaaagcctgactgtgaagtctgtacctctactctcgcctactccttagatgaaatgacctggaagtaacactacttcttattgatcctcctggctatcatatcccgttcaccttcttccaggtttatccaagataccctaataatgtttcctatgcaaggtaatcttttaacacaagtctaactcccactttctgatttcacaccttctactgagactgagcttctgatagtatcaatactcatatataagttattttaacatgcatacatatatattcttggaggagtagacagtacacattttttatagactcatgcagtggggtttaaatacaatttagctattatgtaatttttggcaagtttcttagcttctctaaatcttagtttccaaatatgttaaaagaaagtatataaaaattaccaacttacaatttcattttgaggatgaaatgaattattgtacccaaagtacttaaagcagcacctagcacagaaaaatatgaaataaagatagaccattttgattatttcatagaaagaaatgtcatggtattacttattattaatgaatatgttgaaggaataattagtaaaaatgaatatatgatatatattgcagtgctttgcattgatggcctgatgcaaatagcagtaattacttacacaggatggctaacatttctgggaaagacattctaatcaatagttgctatctgtggtaggttaagtgtttgaattaaaaaaaaaaaagcagtaattcattgtgatacttccaaatgcactgttcacattttaagttggagacagattattacaagaaataggaaagataatcctaaatcttagtcaattttttttctcattacagattttaaaaagtgactagtaagggagaattttgagagtctagaaaacctggagggaaagaaaaaagagggaaggaaggagagaaaaaaggaaggaaagaaggaagaaaggaaaaaaaggaggaagggagggaggagataaaggaaagaaaaggaaaagaaaaaaggcagaaagaaaagagaaagaaagaaaaagaaatagaaagaaagaaggaaagagaatggaagaaaaagaaaagaaaagaaaagaaagaaaggtagaaaagaaagaagtaatggaagaaatttgagtattaacagagggcactcaggtttccaattcaatacatctcctatgcatattctacaaattagattgtcaaatattcagcttctctcagaaatttaggctattagccatttacaacttactttgaattaatttaatcagattatcagattaggattttgcttagtgactgccaaaatcagccaccctgaggaaattggagttttgattgaaaagtggaactgacaggaagtttggtttgaaagcacagggctcttgctggaggaggagggattgtgggtgttcagtgagttagaagagcctgagatagccagagggaagcatgagggtactggatgcctgggcaaagattaagagaatttgccaagaggtgggacatttccaagacaaacagcatactttacactttggctaaagtccctcatggcagtactcatttttgatatgtgctctcactacatttaatcgcagtgacagttgtgagattagaggtaccgctttcttcaaaaggatcattgaaagttgtgggtttatccttgtgtttctgtttagttttttatcatactagttttatttgtaaaccaaaatgcattatattttagacctttgctccaaaaggctaatgtaataatttttttaatggacttaagattttaactctaaaacctcatcaacattccatatattatgattcacatgggacttgtaaaagacagactccacacttcagaactgcaatgggctttttgttcccactgctgagtatttccgacttcttttgaaggttataaatttacaacttagtatgttttatggtgtggtgaatattgcggagaatgatctggccagatgaaaatgggattctgttggccctcaatgttcttttcttgagagacctactctgcattttaatacatgttatactatcttcaagttttaaccaaaatgttaatttgattttttttttctttcagtcaggaactttttgatgacatatttgtattccacatttcttcacttgtcccagtgttttattgggaaagtgttgaggtgtcttgggatctcttctgactcgttaagcatggagaatgattggttgttaaacgcagtaggggaatattagtaggaaaaaactgttttggttttatgaatggagatgggtgcctgtcgacatttagaaataaggttggagcactatactggtgtatgtgctgaagatttggaggtcatcaaacaacctatatgtaagagtcaatgagatttaaaagaattgaaaagaaaatcagatataagagaagaacaaaacaggagaaacaatgtcatggaaactaagggagtagttttactactttaatgtatatttctcagaaattgctttttggacattacttccatacttgagaaaatatttctgtaacatacctattcaagtgtttagattaattatttttttctgattaaaacattttgctcatgtatcttttaatttttaattttagtacaattgtatatttacaaaattattgaaaagataatacagagagctccccacactcagtttctcaaatctatcatattagtatgatatatttatcacaattaatgaaacataattgatacctggtaacacaccaaagtctatatgttatttaaatctcctcagtgtttccccaacaccctctttctattccatgatgatgtgcaggggtaccacattccatttagtagtcgtatcaccttagtctattcttggttgtgacagtttctcagacatttcttgcttctaatgacctttataattttgtggcttacgggtcacttgttctgtgtaacattcctcaattggaatttatctgatatttatctcaggcttagactggagtcatgcattttaagaggaggaccacaaagataaattgccattctcatcacctgttatcaaagatgaatactatcaaaataacttatcattattgatgttgacattgatcagctagcttgtggaagtgttaatcagatttccccactgtaaagccaattattttctttctgtctctttcaacatcgtgcttttatatatatgtgtgtatatatatatatatatatatatatatatacacacacacatatatatatatacacacatatatatatatatacacacacacacactatatatgtatttttattacactttaagttctagggtacatgtgcacaatgtgcaggtttgttacatacgtatacatgtgccatgtatacatatgtatacatgagccacgtatacatgtatacatgatacatgtatacatgagccatgttggtgtgctgcacccattaactcgtcatttacattaggtatttctcctaatgctatccctcccccctccccccaccccacaacaggccccggtgtgtaatgtcccccttcctgtgtccaagtgttctcattgttcaattcccacctattagtgagaacatgtagtgtttggttttctgtccttggaatagtttgctgagaatgatggtttccagcttcatccatgtccctacaaaggacatgaactcatccttttttatggctgcataatattccatggtgtatatgtgccacattttcttaatccagtctatcattgttggacatttgggttggttccaagtctttgctattgtgagtagtgccacaataaacatactgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaggtgttcctatttctccacaacctctccagcacctgttgtttcctgactttttaatgatcgccattctaactggtgtgagatgatatctcattgtgattttgatttgcatttctctgattgccagtgatgacgagcattttttcatgtgtctgttggctgcataaatgtcttcttttgagaagtgtctgttcatatcctttgcccactttttgatggggttgtttgtttttttcttgtaaatttgtttgagttcattgtagattctggatattagccctttgtcagatgaataaattgcaaaaactttctcccattctgtaggttgcctctttactctgatggtagtttcttttgctgtgcagaagctcttgagtttaattagatcccatttgtcaattttggcttttgttgcttttgttgttttagacatgaagtccttgaccatgcctatgtcttgaatggtattgcctaggttatcttctagggtttttacggttttaggtctaacctttaagtctttaatccatcttgaattaatttttgtataaggtgtaaggaagggatacagtttcagctttctacgtatggctagccagttttcccagcaccattaaatagggaatcctttccccatttcttgtttttgtcaggtttgtcaaagatcagatagtttagatgtgtggtattatttctgaggcctctgttctgttccattggtctatatctctgttttggtaccagtaccatgctgttttggttactgtagccttgtagtatagtttgaagtcaggtagcgtgatgcctccagctttgttcttttggcttaggattgacttggcaatgcgggctctttcttggttccatatgaactttaaagtagttttttccaattctgtgaagaaagtcattggtagcttgatggggatggcattgaatccataaattaccttgggcagtatggccattttcacgatactgattcttcctatccatgagcatggaattttcttccctttgtttgtgtcctcttttatttcattgagcagtgttttgtaattccccttgaagaggtccttcacatccctggtaagttggattcctaggtattttattctctttgaaacaattgtgaatgggagttcactcatgatttggctctctgtttgtctgttattgatgtgtaagaatgtttgtgatttttgcacattgattttgtatcctgagactttgctgaagttgcttatcagcttaaggagattttgagctgagacgatggggttttctagatatacaatcatgtcatctgcaaacagggacaatttgacttcctcttttcctaattgaataccctttatttctttctcctgcctgaatgcctggccagaacttccaacactatgttgaataggagtggtgagagatggcatccctgtattgtgccagttttcaaagggaatgcttccagtttttgcccattcagtatgatattagctgtgggtttgtcataaatagctcttattagtttgagatacgtcccatcaatacctaatttattgagagttttttagcatgaagggctgttgaattttgtcagaggccttttctgcatctattgagataatcatgtggtttttgtctttggttctgtttatattctggattacatttattgatttgcgtatgttgaaccagccttccatcccagggatgaagcccacttgatcatggtggataagctttttgatgtgctgctggatcccgtttgccagtatttattgaggatttttgcatcggtgttcatcagagatattggtcgaaaattctctttttttgttgtgtctctgccaggctttggtatcaggatgatgctggcctcataaaatgagttagggaggattccctctttttctattgattggaatagtttcagaaggaacagtacaaactccttcttgtacctctggtataatttggctgtgaatctgtctggtcctggactttttttggttggtaggctattaattattgcctcaagttcagagcctgttattggtctactcagagattcaacttcttccttatttagtcttgggagggtgtatgtgtccaggaatttatcaatttcttctagattttctagtttatttgcatagagttgtttatagtcttttctgatggtagtttgtatttctgtgggatcggtggtgatatcccctttatcattttttattgcgtctatttgattcttccctcttttcttctttattagtcttgctagtggtctatcaattttgttgatcttttcaaaagaccagctcctggattcattgattttttgaagggctttttgtgtctctgcctccttcagttaacatcatgctttttgaaaagaggtcactacactcagccgccagttaacaaacaagtgaaaaattatgttctacctctttaagaatatatatatatatattcctaaatcctatatatcacaatcatatatatatatatatatatatatatatatatatagagagagagagagagagagagagagagagagccaggtgcggtggctcatgcctataatcccaacactttgggagagagaggtgggtggatcacttgaggtcaggagttcaagaccagccttagcaacatggtgaaacaccatctctaccgaaaatacgaaaattatcggacttgatggcaaatgcctgtaatcccagctttccagctacttgaaaggctgaggcaggagaatcagttgaacctgggaggcggaggttgcagtgagctgagattgcaccactcactaaagcctgggcaacgagagtgaaactccatctcaaaaaaaaaaaaagcaacaaaacaattttctgcatggaatatctgtttattctctgtatgtttattgtttattcatctaatcatttacttacatcagtatggattcatggatatttattttatacttgggttatcaaccaatactactttactttgttgtttaaattgtttcagcattagtaattgggacttctttcagctgtcacttatatgctttttttaaatatcccaccattgtttatttttattttattttttagcacttactttctttgtggcactatgctccaggtccaccttatatatttcttgtcaagtcctagaatcaagcatttctctaaggagtcctagtgtctttgattggagaatggtattagaaactaatatctggtttctaggtatgctcacttccacggtgctgtcattgcttctagaccttctcagctgacagaacatgaacatagatttattttgatcttctttaatttttttatcagtgttttgtagttttgcacatatacatgccatacatattctgttacatgtatatctaagtacataatgtttagattctattatgaataatatttttaaaatttcaaaagtcaagtgtttatttctggtaaaggggaaagcatttgactgttgtgtattaagcttgtgtcctaaaaccttgccaaattggcttttttttttttaatttctttgggattttctatatagacatatcatgtgtgactagacagttttatatattcctttccaatatttatgtttcatttccttgtcttgtattatttcatcagctaggactgctggtatgatgctgaataggagcagtgacagggaacatccttgtcttttctctgtcttgggggagagtatctagtttctcactgttaggtatgatgctagtagctattttgtagatgttcttcatcaatctgaagatgttctcctctatttttagtttgctaacagtttttatcctgcttgagtgttggattttgtgaaatgttgtgtcttgtgtcaattgatatgatcatattttgtgttgactttcaaaaattgaaccaacctcgcatatatgaaataaagaccacttggtcttcgggtataattatttcaatacattgctaaattatactggctaatgttttattaaggatttttatgtctacctccatgaaggataagggtgtacaaatttcctttcttgtaatatatttatctaattttggcattaggagtaatgctggcctcattcaatgcgttagaaagcgttcctctgcttttatgttttggaggggattatgggaaactgatgtgagttcttccttaaatatttggtagaactcacctgtgaaaccatttggatccagtggtttctttggggaaagattatgaattattatctcaacttattttagatatatggctgttcgtgtcatcaatttctctgtgtgtgtttagattgttcttaatctttctgaaactaaaaaatatatttgataaaatataaaagtgcctctagagattccctcaaaaaaaaaaagcagatttataggcttagaaaatggaatgaagctggtaatgtttaaaaaaaattatactgagaatgcaaaatcatttttgaaattctggtcaaattaataagatagatatcttccctccattacttcaatgtaccatatttttgtttgtttgtttgcatgtatctgtgtgcctctctgtttgctaaattaaaaaaatttctattttgacaattacatgtcatattatgttttattttaaattatttccatatgacctttgtggagaagatttacttaatcatttaagcttattttctttataatagtttgagttgtttcatgatcacattcaacttaatttaactttatttgaaattgtttctcaatgtattctggttattctcattaagaaataggtgttcaaaataccatgtcattattagcatatcttgcttaaagtgaaagccattgtagcatggtttgcaatttactttggagtaacaatggggttttgtgaagaaagattatgtctcagattttattttaaaatgttagaatttcaagagataaatagtcttcttggtctcaactagcatgagaagtagaggggaaatattttcataaaaagtaaaagagactaacaattgtagtttcacgcaaccaatattatattagttgttttaagacaatgacatcatgtagctgtaggatgacaaaaaaaatggcatttttcaaatagcacctttctccataatttgtttattataattatttgaatatgtgataattactaatattgtcataatagtctgccacatttacgaaaacactggacgtttccacctcagcattttaattgctcaccacagtgccattttctttaggactggttgttttgctttcagtttgcttcctagactatcatcatgagatcaaaagctgtgttttttataccacatgacagcccgatgccccacacagggtcagcattaaactgaatttttgataggatcaggtgagccaaaggatgaataaatgagtactcacgttcaggtggcatcaggtgggaattgtggctaggtaaaatggcatcttgttacaatggtaatttcagtcacctattccttacctcttctgggcaggcggattgatttgcaattggcttcttttcttctttctcactctactaatactagatggaaatctcattgactcttaacaacaaagcaattatcttaccatattcacaggttctaccccacctactagggaagtaaaagtatacaggtagtggaaatcttggggccatcttagaatcctgcccaccacaagcagcaaaatattcctactccattatgtttcccatagctaccttgtgtcttccaacttcgtgtgagtggtgtgtttgttgctttgcttatgggcaaagatgattttttgggggagatatttgattaaccttctaatttcttttatctttgacaccttcagtcttccttcatttacctttatacagacttttttataaggccacttttcttttcctttttcctttagggtctcttccctttgcatagattattggaactctccacttacaaagactagcttttatgcttccaactcttgatataaagtttttatctagcatcagaacttgaatgtgagttgtccatgtgtcagaactgtctttcaaaatcaaaagtttcacataccattttcaattaacccaaaggaaatgctaggcacctatttattccacaattatttttaaagtctgtatgtattaattgtgtacatactattttattatttacaaagtgagttaagcacagtattcctgttcaaaatatgaaaataagtatcatggaaaagtggcaaatgtgtcttgtgttccttcatttttagcaccttgttattccttttatataaaactctggtgtacacacagtttttcctcttttctggaaaatgtgaataaattacatttcctttgtacattccatgctgtcttagacaaaatcaaacacttgagtatagaaatgaattgtattccagtagtagataggacaatttttcactcctttcaacttaggcattgtattagttttctacaaataacaactatagactgaacgacttaaacaacaggaatttattttttcacgattctggaggcaaggagtaccagctcaaggtattggcagggtaggtttttccgagccccatcctttgctttgcaaatggatatcttctccctgtgtcttcacatggtcttctctgtgtttttgtgtcctaacctcctcttcttataaggacaccagtcactggattcaggcccatcctactgatctcctttaatttaattacctctttaaagacactaactccacctacagtcggattttgaggtactgggagtaaggacttcagcatctgaatttggggggagacaattcagcctgtaacagtcatgatatgaattaactgctattgtgcatgagatgtctaacgaaaagacagaaaagaagtgtaaagaagtgattactgagatcaacaaatgttgctataggactgccagtctatagctactgcagatatatatatatatatatatatatatatacataaaacaatgtgatagtgggtgatttgtagatggtaatagaccattcagagaaacaagctgaatattttcttacattggaaaaaaagggggacacaaaagaaatgatttcccagcattttattagattccataagaattctgagcatcaaactatacactgctatatatgaagccagatccaatgggaatcttttgattttacatatcgatcactttcaaaataaggatactagccttatttgctgtgcaatattatcatgacatatatttttaatttattgggtctttcagtttttgtgcatctataaagcctaatagttcagcctctctgtaggcatctttgctacttcctatctgaggaaataatgttttattataaaattacaattttttgtaatttagatctctagtttctaagataagaaaacagatctatcatttggggcaagaatagaaacaaaataaactctcctcttaaagcaagggaaacaactttctgaaaaaaaaaattgaagacacacctttcatgtattttaggaacatttcacttttgctcatcttctgactgcattgtgaaccatcatagctagatcaaaattagttatgttaataaacaaaaacaaaaattctgtctatttgccttacattaagagatatccttttgcctgatgcaacaacagaaactaaaatctctaacgaaaaacatgctggcttctctcaccatcgttgtccaataggaaggaatttggtcaggagtaaaaataactcagttatgatccatgttattacactcctctgagcttctttctctcttccacatgttgaatgacttactggtttatttttgccacatacataatgtttggctcctatctcatgtgcaatcaatcttaattattggatctctttcccccctacaatcagatcattttgattattactttaattgtacattccctaactaacttctctctagtttgtttttaacttcaggctacctgtgggcataacgttgtacaattcagaatgtgaattttacacttagcctaataactaaataagcttagaaatttaggtacggtaaattaggtcacttggtaccttttcgtacaaggaaagcaaacttcttgtgtgcctaggtgttgcttttggagaaactttcctgagcattgaggagtcagtgctaactcctgcaagcatgtgagtctctccgactctgtgatgccaacttaccatcttgctgtagtcgaagagctttaggttggagtgaatgggtaccatctttgttcttagaggtggactctaaggaccttgtttttgtaggaacacacaagggctattttagtgttaatttgaacacatcagaagagtttacatcagaatttcaaagaaacgtaggaatccttgttacctttaaatctcaaattttctccatgatataaaatatcagtcttcttttaaaagatcagaaattaccccaatgaccagatccaaatgctgaacaacaaacagtccagatttaccatgaggaatagggttaatatttgctccccaatgacaaatcccaacccggaacagatttcagccaggcagctagcaaagctcgcgggtgaactgcacaggccatggtgggtgcagagctcagagccggaaagcaaacagctgctgtagcctgatttgagttaaaatagtgtgagtgtttagtctggcgcacggcttcaggggagattggcagctgggtcaaacaaagtccttccattggctcccttcccaggcagcttctgctagtgtttaggtactagtgcagtgtagaacccttttctcaggcaaaacctaacatctgaccgcaccctttttgctattaaaaaaaaaaaaaagcttctatttttttcctgctgtcgataagataaattctccagtagacaacctctcccactaattgtgtattagcaacgtattttatcttgagagcttgtacactgggctctcaacgtggtgtggaaggtagcctgttacagtgctggattcataaaagggcctttatggtttgtgaaagaatatctgtgtgcttagggaggaaactttttgatctgcagaaaagccagaagacatctaggtaaggctacgatatcaaatctacttttttgggggaaagttgggcagtgagactgcttaatcgcaaccaatgtgagtttagagggtgcatgttcacttttgtagaagttcaaaatgtactgacgattgtttgcttattttttgtttgtttgtttaaatcttaaaggaatactgtcgtctgcgtttttacgattttgttttcttctattgaacccattacagtggatatagagttttattatatagcgaaatctttgtaaactgccacagaaagaaagtgttatttagaagggaaattgacaagttttaaagagtaattgtacaatcatttgaggacagaggaacactgcattatactaataagggtttaattaccaaaaaaagtttaatgttgctttggaaggaatattaagtaagttgtctttgtctcttactttttaattttagtcgctgatttagcctgttgggtcacattttttgttagtgctgaaggctgccatgaatccgtaatgaggcccctttgcacatgattttggcacttggccaaaatcaacttcccagcggcaagctttctctaaagaacctggagcaatttctttctttttttttttttttttaaatcaggaatcatgtctgaaagctgccacaaccagttgtataggcatgtcaaaatgactttatacagtcaatatgaaacaagcattaaatattttttctcatgttgttgcttttatcattatgaattccttgcttgttgccacctaagatacgatggagcaagcacagtcttaaagaagatttgctgattttttgtttttctcagcagaccagagtaggtatgatcatcttattgagaagtatacagtgcaaaaaaggtttttcaaaacactacaggataaataacaaatgaattcttaaaactgttaatctctgtaagtaatactcagtgaacagtaagtaatggagttttctagaagtttcatcgtgcgcgcaattaagcttaacatttttatagtgtttttgtctatgttaaaaggtagcatttgggatttttaaaaatgtcagcatttgctatataattttaaaaacgtattaacaccttgatattatttctaacaaatgttttaatagaaatgcttggtatataaacatggctgaataacttttaagtaattgtgtttaattgctgttttgcaataaaaggataatttttcatgaaataaattttgaagctcaaaggtacttaacatccaatttctggaactgttattaattttgatattactataactgaattttgttctgtaagccaattttatactctagtgttttaagagttaaattcacgagtggcaatgaaatactatagcaatcaaatattaacacctcaaattttctatagccattttcaataatatctttagacattaaacataggtactctacagaataattagaagtagaaaagtgtaatatcagttgctctattttgtttttttaaaagaaattttattatcactatcgtaaatactattatgccttgtgtgttaatctgtagtaatccagagtgcaactttattttactagaaacagtcatatttctctttaaaatattgatgagaatcagatacattattttttaagagtgacctaattaagagatttcttaataggcatgtttattctgtatttgtcttccctttacagtatagaatattgcaaattttggtgatagaaaaaatcatattaattttaggtaaattttaggattagaaattgcctcctgatttccttcaggtcattttttgtaaatatacaatttatatttgttttgctgtggaccaaattatgatactgtaaaaaccttgctattagtttaaccgaggaatggagtgtttggaattttcatactagtcaacattaaaagccatagaagttataaattgttattaatagaaatttacctagataaggtctctttgtatgtgagtttacagctgaattcttatttaatgtaatctttgtaatttatataaaagcagttaataaaggtaaatatttcaaaacttggattaaaaaccaaacattttcacatttattatcatgaaacaggtgcaggaaaaataagatagcttctcttgttgagcatgattctcacttaaaaattaattttgaattcaattttaattttaattttagctcttacacacatcttctgtttttattttttgattattttgaatcagttgttgtacttagcatttgaaattgatagattatttttctaatatttactaagaaatgttttaactgaaaattatagggtattctttgttaatcagagcccatagcaaagtaaatgccatcaaatatagaacttttggagtacacagaagtgttagtttgcgagttcagaagaaacttacttgtacacgattactgacaaatgttttttagttgaggtagaaacaagtaagtattaaggacaatttaaattatcttccttactgaaatagctaaaaaaattgctttcttttgctatggcaatgcgttgtaattatttccataatctaggctttttagcagaattattagctagttttccttaggaccaaaaatgcaaaacactgattacatttccttcattgagttaacattttaaaaatactatatggaaatgtaattacttttaaaaagaaaaatattttaatatttttgttgaatttcttcaatttataaagaatagctcgaacaagtttttcgttcatcttttcccccatacttatattggaaatattaaaatctatgaaattttacaatgtggaatctcttttactcttcagaaaaagttaaattcatttatagttgtcaattcaaattatggacttttaccattttaaatgtgacagggttttttgtttgtttattttaattatgcaacaggcacttaaaatactttctttccctccaattaaaagagacattaaataattaaacatcaacttttattctgtattgaaaagaaagctttaccattgcagtattttatccacaattgtttaaatgtgagaaatgtttacaacagggtattttaggtgagcatttatcatttaaatgaagtgctttgttctgaggagtctaaaattcagcaataagataaatgcattgctacattagattgaacatcattgttgaatttttggcacaacttcagtgacctcggccataaaaactagtatagtcaggatgatttggaatttgcagtaacaaaactagatatagaagcacgtgaagacaccaacctttgttgttttggagaaagtatgcactaaaataaaagatgatacctttcatataaactgctaataataatactttgttatttcattaatacaataaaagtgaaatattaaaacagtaattataatctgtaatgcatttgtaaggcttttctcataaaattaactgccatattttactcttttattagatgaacaaatgtcatatttccaagcagccaacatagaactatagcttatataaccaaataattttttaatgttactttgatttatatacaattgatattgtatagaaagaatcacgttagctgattttaagtcttgttcaaataaaagaagcattgatttgcacttgttgcaatttttttactttatattggtttaattttaaaattatcacaaagtaaatattactgtttgatatcattcttaaacattcattttacaagccacctgacctattagctgtttaaacaatgatgatttatatcttgctataaattcttctctcaaagtcaagacaaatagatcagtaaaagaacctcttttttaatgctcaaaattttttcttaaaaaacaaagaatttttttagttttcttttgtttatgtgttcatgtgtatttgccaacctgtgtttttgcctacatcctgaaatatatgtcttttgaactcgaggttggaaagtctgatagcaggctcttaagtttattcttattccatattattttttataaacaaatttattgagtttcttactgagagtaagtcgatatatgaatcaatattaatgatcacatcaaatctgaggatttgcttcctttaaagcgctgaatattcagcataaatttgtgctaatttacgtgtttatagagtgattctaaatatttgattagtattcgttttaaagatttactaattctttgaaaatctggagaactatcgtttgcttaaaaaactaatatctactaaagttgtaattgtctctgctttgctattattgaaatattacataatctcttgtttaaaaatatcatgagactaagctatcgtgcctttctttccatttctcccactaacatctgaggtcaacgtctgtaagaggaaatatctgaaaatatttcaaaaacattttctttcctgtgataatcaactgctttatcatttgcagagattttgaaaggagtaactgttttatttgaatgcttagataaatgtgaggaatatatgggctttctgtggacttcagttttaaaactaaaatagaaagtaagatggagagtaataaaatgatatattttatagcaactaattacaacttgctgttcatacataaacaacacgctggaaaggtagacagtgggctttgagagcagctttcatttactcagtctgtaagaactcgtgaaaatggtgtcaaagggatggtggtgatccattctgtatggtccatggtgctttaagcttatacagtcatttaccatatttaaatccccgagtcttgcctcagagccccaatcaccaatctgagatatttttacaaggagagaggagttacacactcattcttgttcactggaggatctgtgatagcgtttccttggcagaagcagggttcttctctgtatagtgattttttttaaatccctgtttaggtagttcagctcgttcagttggacaaatcagcattataaccaagctgactcagccttagcaaggatcactagtttttcattttgccctaaacctgggcattttcctgaagaatatggacagttgtgcatgaaaggtcaagttgctaaaaattatagaacatgcatgttctacttatgagttactaagttgtgttttgtgttcaaaatagtatatataaatacatgttttgtgtacagaatatttaaacagtgatagaaacagttgttctgaaatttaagttatgggattggctttattccaattctacttgagatgtcatccaaaattacttttcgaaagcactgctttgaaaatttcctgttacagtcttcatgaagtatagtgatctggatatgaattttctgctagtacaggagtttgggaaaaatacaagtatatgactattgcatgttctgtgggattctaatctgatcacatgctctttcctctccattccttgggcccattcataaatattctatggagagttattttttttttcctgtcaacagccaattttagtctttattttaatttatttctttttagagataggatcctactatgctgccaggcctggagtgtagtggctcttcacaggtgtgatcatggcccactatagtcttgaagtcctgggctcaagagattctcccacctcaaccaccaattgtagatgtattcagatagcatgacatttgaaaaagttgatggagagaaaattcctactgaagtgtgttatagatatctctaaaacatctttggttgtcaggaaatgaatcaatgatatagaaacaaacaatgatttgtaatcttggcagataaacagagaaataatcagttcagaatatttatggaatgataacattttcctgttgatatatttttgtgccaacaaatttaatttggaaactggtatttgttactagaaggcagtaatcaattttggtaatcagtagttttaaatgctttattcaagaccaagggctgatttattgaatgaataggtcttagataaaatgtaagctattgggccaacccatatctggaatttgtttttattttcaatacccaagtcattaagtgtaaatgtaatagtatttgcatattttcaactttcagattagtcatgtctacctttgaaatttgttttctccttagataagtaacttatgagtaatcaaatatcttgcaatttccattttccatcttaaagcccgtgcaagatcaaatttgcagttgctaaatcacataaaagtctggattaatagcaaaatgagattatgtagcccaaaatgaaattataaataaagtgcaggtgtttgctaggatttgtgtggtcagatatacaaatagaatcacaggtagagtttctcatttctcacttgagaaaagtgcaattaaaagtaatttccagatgttcaaatgcacagctgctttctcctaaactaaattttgcagaaatgagctaaattataatgggtttaaaagtcactacgttttaatggtttttaaattgaatttgaaacatcattactaggtttaccagatgaagagagttaatgcttatgagtacctggtacaattttcatttaggtggcagcagagccattaacgtattggaaattataataagaccaaaacttacattgggtttgaaaaaattgattagtatgtgtgttgatacactccatgcctttatgagatttatattatatactctatgacactatgaaagttattcagctataggtgaaagaaacgtgtgtatatgttcataaaatggtatgtgtgggggggaggtgtgggtgtgtatgtgtgaaagagatttttacattttctttgcctaatgaaaaggaaaatagcaagaataagatgcaagtacactgtttgaaatatgcaagtctattaaattgtttttacatatcaaattataagcaatgactatgaacctacatatctgtaatatcaacttaaaaaaatccatctattttactcagagttacttacatgcccaatagcaataagctactgtcataaatattatcccattaagtaaagtcctgttcttgactaagttttcttgggcttgaaataggcttttctttgcagccaggaatagccaagttttttctaaaactcttacgggaaggcgtgtggatggttaaacgaggaatgggaggtaaaaagtgggggcattgcattggaatagagaattaaagagcttttaccctacgtaagctcagaaatttatcattaaacaatccattagtatttccacaacagttttcaaagcgcactgctgaaagaatttcaaaaatttgaccttggaagtgattagaaaactgacgcattagttttgagtatgatggtagaacactttatcctatgtacgacgttctttcaagtgattgactcgtgcccttgaaagcattatccatggccagtgattgatggacttgttcaggtcctatgcagagtgcttcatatatctcatctcaatcctctaaataaccatgaaagttgatgattatctcatggtacagatgggaggctaagagtgtttaattttccccaagttccagtgctagtaagtgttgatgtctggatctgaacctgtgttaatggtgtttctagtcgatgctgttatctgttgcaccacattttgaataatcttggactttcagagtatgaaggacgattaaatataaccctttggtataaatgttctctctctcactcctctgtaacaattggagaaacagagttctaacaatattaaaatcagccatagacagagagtagtgagaaatatactttttttaatacagaaggttccctgaagtacttttagtattattctaaattaagcaataaccaatgaacaattttggtcataagcagtttctctccagaaaaaaaaaaaaaaaaaaacagataatatccatgaacaaaggttctataatgtgagtctcttttgcacatcagtggcttaaaataatgagtagtggaatagcataatagggggaaatacctctcagacaggaaattgcactagcttgttttgtcaacatatacattactatacccagagacatacaagagttagagactcacggtgagttttcactgtggccatctgtgccatcccgtgcaggactctactgtggcattccacaaaagcaaatcctcagaagccttctcaaagtgcttaactgccttgaaacaggtgtttctcactagacaacaatgtccgtttactttaaaattcagaatttccccatatcacatgcttgtgaagaaagaaatttgaactctattatagtctagttgttggcaattgttataaaaattagatttctaacctctattgatagcactatacttgaaatgagaatgtgggcataaaatacttcttataaacttgtttttaagttttatgtaatgttggctgttacaggtcaagatatgaacactgaaaattttgggccaaagtcactttttcaacactggcccatttgagttgttgattttagagctgggatcattgaatgttattttttcatacctttattttatgcaacagaaaatgaaggcttaaagagggaaaaatggcctttctgctcatggtcataatactagcgcctggagagttggctttgatcacagattttccttccagttttctattccttcatttatataaggccatttaccctctaaatcatttacatctagttataaaatatctttttcttttcctaaaactttagtagtacagaaatacaattgaaggagatttggcttcgttggtaaatgtagaaataactaataagaggtattgaatataaacttacccataagttattgtttctgtaaatgcacacgattaaaatgtctagtttgtaatttcattcttgatgtatattctagggcacgctgacattttaaagaattttgttgaaacgcccactgagcgtgctttctgaaaaatgaagattatcttttgttttttttcttttttatgagctttaaaaagttttaaataaaagtttctaagatgcatgattcttaagcatacatctggatgaatgtcttacatatgcatccatatgtagttataaacattcgtacatcttctcccagataccagaatataaaaatttcagcactccttaggactctctcatccccctctgacacctgtcaccatatatattaggtttaccagtctttgatttcatataaatagaattgcacagtatgtatatatttttgtctggcttacgttactcaatattttgtccatgtgattttcccatcttgcatatattggttggttgttcttttttgctttgcagtatttatttgtgtgattatggcacaattttaatctattgtgctgtgttagtacactcgttgggtgttttcagatgtctgtttacataattttttaaatgcagaactggtaccaaaaatatagtagtcagttgttttctttaatagatgaaatataaaactagaatcactttaattaaagtactacaggcagttattgctttacatggtcccatgctaactgaaattcatttatatttgaactctgaaaagtgataactcagtatttctgagttatctatgaaaaaaaatcctggaaaaaagaattagtatgtgttatcctaagtagatgctgaagaaccagtcctgcaatatttaaactttatcatcacccatttgctcctgttatttattacatatatacaactgtaattatagtttggaccaaatatccatgtagttaaactcagttgtcactttattttctaaaactccttctggatggcaaaaattttctggtttaaagcaaaataattaagccattgcgttttacataggatagttagggatgattcttaaatttttttttttttttttttttttttttttttttttttttgagacggagtctcgctctgtcgcccaggctggagtgcagtggcacgatctcggctcactgcaagctccgccccctgggttcacaccattctcctgcctcagcctcccgagtagctgggactacaggcgcccaccagcacgcccagctaattttttgtatatttagtaaagacggggtttcaccatgttggccaggatggtctcgatctcttgacctcatggtccacccgcctggtcctcccagagtgttgggattacaggcgtgagcccccgtgcccggccaattcttaaaaattttaaactcaacattttatgtaccatatgagtgaaatgagacccaatatttttgacaatagggataaatatttgtttgaaagtaatgggaatagttttagagatattttctaactattttctgtgatattttttaacggttccaccgttggtgttactatactcaaatttaagatcttttcctctgctaggataacacaaacattgctaatacaaaattgtaagatttttaaatttttcttttattatggaaaaaagattaagttatttagaagttcttaagtcaccaatcgaatatatttataagcttctattgagtgtatcatccaagagctaatgaatatatttattacattgactatattgataaacagtctggggttgtcatctggatatttttcacacttgctagtaagcaactgctttaataaaataaataacatgaaagtagtatattacaatgtggtttgcaaagccgtttcacatatacatatacacattaacattgagagggagaggatatcacagtcttccaccccagacagtaaaataattagtatcctgtagctaagaaagactgagctatgacctgcactgaaattatttttctactgtaaatctgtcatcttttattgcaacaaactacatctctgtaaataatggaacttcatacaacagatccgtggtgaactagtggcttaatatatctctcaaaatattttttaaacaaaatatattttttatttgtatctataatgctacaaaattctcatatgatctggaaattttcaaccatatatgataaatgatttatttatcatttaacacattttcttggaggttgtgtattaaatacattttagcccctaaaaatggtaatatcactttctaatttttttgtttgttttaaataatcagttcaaagttggccaaggtcaatgattcttaaatcctattattattttttgacaactatacaatgcctgatattgattccattcctgatatcagctggcagtaagcttccctctcagatgaagtgatagatggcctgttcataattcatacatgcagtggacactacaaaattccactgctaggcttctccttaattagacgtatttgcatctaataggaagagaagactaactttccaccatgctttgtccctgtaattgtattctaggtattaaaaacatttttaaacatgcgcagtgtctgaagacctgaattaacaaactcatgtggacatttgaaaatgtgtacctgtttgtcctactactatgctacatatgtttggttttgtaaaaatatgggtgaattcatagtattgttctttttcactctgaatgtcaccttgtatctattggtttttactgacccatgaaaatggctggagttagtctgatctcaccatgtagaaaggtcaggttcatggcttggatttgagaacagcagaatgaatcaactttgaggaagaagctgatttaaaaaaaaagaaaatgtctatttacattgagcttataagaaataggtagagatcaagaagaaaacaagtatggaattacttcaggatattttaaaagcacttccatttaggtatccttgactaaatctgtcaactttgtatccattttctcatgaagaaagtgttgaacttttcactagaagtacttttttttattcctcagttaaaacatgcctgttattctttttgtaatacttaagcaatttttttttaaagatatactacttagttcatccgtctccacttgttttttttttttttttgcaattatgtgtttgtttcctttaatacaactgctataaaagcaatcatgttcatggagaaataagtataattcataaaactagcatgccttgcagagatacaagtaaaaatatagttgtgtgtgtgtgtttatttactgagatgaatttaattcctggagattattttaagctttggaaatgatctctggagtaaagaataatatatttcacttttttattaataataatttttattttgaaacattgatatttataatctgaaaatcctatttatttgtttgtttgatatataccaagaaacagtacattgataggtgatcatttttttcactgtatttatttatttttggtaagagaaagtaaattgatatttaattatgaaataactaaatatgtttttcttttgtctagactaattgtgaagtgataaagtacatttcttaccaaatataacattttaatgcatagaacttactatctataatagctatcttacagtcatgatagttattaaggtaatttatcaataagccttcttttggacagaagggatacatctaatttttaaaaatttctctttgtcttttactaagaaagcctcatttatagaaaaccaaatgagaattctggtcatcatggaccctaagagctctcaaatccactaagaaaattgccatatgtgaaatattctcttgcccagttagaactattcattcattgtaggctctgatacccatttgataagaaataacattctgatgcatggctaatttgaatcatatttaaaaattaagtaaaatttgagccataaaggattaaagagatgtagattatctcattttgtagcaggagatttttaaaatttgattacaaagaaaaccaaatactcctataataggaaatgttacaaaattaactgagaatcgtttttaccctattttgttattctagtctctgactggcgtgaaaaagctactagttaaatgattcaggaaagaataagataaacaaagggcatacactgtccatacaccgtagtagttcctaacttctctctggaataattaaaatcaatttacagtcagagcagttaaccagctctcagtagtcttccatgtaatgaatacacttctgtacccttattaaaacacgatttgtcagtgcttctgtcctcatgaaaattatagcttggttgagaatattaaacagaaatgaaccaacatgagaaaaatggaaaataggctaaattagtttaactaagcagctagattttctttatcatgtgccaatcatgggcaaaaattgaagccagcacaaatctctctgaatggctttctagggaaaacacatttttaattaccacatgagcctgttggaaggtaaccgaattcaacaaaaccattaattgatattttatttgaaacctttcctgataatgcttctagcatctatcaccctattcctatttctcttgaagaacagaacatagcatataataggtgctcaacaaatatatgttaaatgaatacatgaatgaaaaaccctaataaagtgaatatttgtatctctaactgagtttctctttctcaatacggctcatttcctcaaatgctaaaagattcttaaagctccttctgggtcgcttatctttcaatgatttagttactttacaaagaaataacatctaattaaatcttaagcatccagagaaatcactttatcattttgtaataatatcagtcaatgaacatgacagtttctgaagatatatgtgtggtaactcgtgatcattgtgcttatatctggtccacaagggaatgaagattgttaccaaggatgtaataatttagtgtgcaatacaatttaaaaatagattaaaaactgagatgtaaaaatggcactcagcctgtttttggtttctttgtgttgtattatagtctcatattttgttttcaaaaggtaattgtctgtcaatgtgtttagtcatttctttgggcattttttgaacatggtacatatagaccatatcttcataaaaccaacaacttttatttttgccatttataaattcaagtgtactcataatgtatatatttgtattcagttattcagaaaccttagtatttaatgaagatgtacagagaaatggcataatcaataatgaattggtatagcacctatgttggagcatcttttatttagtgcagtaaaatggagcagatgatttctattcctaaaagtatttccccacttgatttaatggtaaatcctccagatcatagtattactattctagcattcatgtctgctgcctttagctttctgtgtgaaaacttctcatcaggaaatttcttaactaatcaccaggaagatttaatcaaaatcagtttagttactaactaatgtaagcttaggggaaagagagaagggaagtgtataacgattgaattatttgactacatattgttaacacagatataaaaatccatgacttctctcccttcctcctccactaaaaaaagaaattgaagatagttgggaacaaatagttgttaacagcaaaaattaaaaagaatactagcagctaccactgcctctagagagtgtactgggttctagtagacaagtagagcttttttaaaagaactgatgctggagacggtaacaccaattcaaacctcacctctaccactaaccagttatcaaatcttgacgtttttttcttacctttgttttttatctgtaaattggtaataataacaaacttgatttcatagtatttgttaaacaatcaaaaattaataatgtctcttccaattaaatgaagatgtatacaatttaatccagatttaggagtgaacatgaatgaaatgggaaaagaagcatgttcctttgagatgttacacttttttagtataacatcattgaaaaaagcatcaaagtattcaacatgttgccattatgaaggtaaaaacagaaaacagagtggcaagtttctgagagtattaaaaagtagtaaatgttgactgcttcatgtttctttaaatcatcattaactggagggtatgccagccatatcttccatgaatattttcttttgaaacatttcttcaaggaaccttaagtacattaattaaactagggcaaaacttcaaaagacctacttcacttttctttgtgcaagttcacataagaaaaagcaattaatttaaaatccaagtttcatgtattcccagctttccagttgggagaagatgaaatatacatcctcaactctcctatttctttctgaactcaatcttctcattctcttttttctttttttctggcataatgggttattttgattactattaaaaggctgaatggtgttgacaattatcttctttttacttctgatgctaattccattgttcagtaaattaagggaaaggaataccagatgaaacttggtatgatttttaaagtctggaaaagaaatcaatatttagcttaattattgtcttttatgtacaggtctgagtatttacatttggaacaatccttgagcttaattctgctgtttagacatgaaatagagttccaaaatcaagttaacctatttctcattaagatgtattagtttcagtgtatcttgccctgctaaaaacaatcttttttaatgctctatgttttgatctatttaatttttttaaaaaaaacataatagtagtttccagtatggaaaatctggttgtctctaattcagtctctttatactaagtccagtagatccattttaagagcaggatagacctttttaaggtgaatatctttcagaggggaacacagtgtctgatgtatgctgatctaaatctaagaagttttttccaatctgagatctcttgccttacagatactgaaagcatcagtgtttctcttttctaaaattttcacacaaatttcagtcctgatggtgtgatttttttttcttttgccttcaagagctaacacaagacataaatcagaaacaaattaactgaaaggaaaactcaaaaaaaaaaaagaaaagaaaaaagaggatgctttacgaagggagatgatttgatggtgggtgaaactgtagactaggttaatgcaaccaggttaaagaaactagagggttgaagtacaataaagggtgtccagaattcttaaatgcagtaaaacaaacaaacatgtagcagaggggccttgtctagggtatggatgtttttcgatttaaacaaaaaggaggaaaaataaccaaatgatctagcaattccttagaacgtctgtatactatctatccaatgtaataattaatccaaatcatctgtcactatgcactgccactccattctgataacaaccctctaaccatgtctcaccaggaaataacatttttattcatacaagttgcaggttattttcaagacagacttcctctgtgctgttcatcatgcataccttagctaaagtattgtagctagaatatagcagcaattttccaaccgatcttcgagtctttattccttcaggtatgttgtgtgtactctttccatttgcctaaattttctctcaaaaattaagatcacatctcacattttctaggaatcttttatgactttgttgctttgatgtccatgtcccaactgcacaggtaaaggttcatcatagccttacctaaaccctctttctggtcttatttctctgatggttatttccacagttagagctgcaggaagccacttctttctttaacacatcatatcaacttccatctattttagttcatgctgcttctgctataaaaactcttactgctctttgtctttacctaaaataattccacttctgatttttattaactatatcagtttgggcaacatattaaattgcttcgtgcctcactatgaaactctttggttccagatgtatttagaatagtttgaattttagaaaagttagagtggttatgctatacattatgtaacatccccagcaaggtcttgggtggccaaggacattaatatgtatgaataataacattaaagtcagtaaatagatagtataagtagtttttgctttaatgttaattgattccaaacttgaaaagtctttcatgtttagaaattattgtgatttggaatttcagaatccaaaaggagccatgtatctctagtgccaatctcacagacttgaggtaaagattaagtgaggcgacacatttaaagaacttgcaggctatgtgcagtggctcatgcctataatcccagcactttgggaggctgaggtgggtggatcacctgaggtctggagttctagaccagcctggccaacatggtgaaaccctgtctctacaaagaatacaaaaattagccaggtgtggtggtgtgggcctgtagtcctcagttacttgggaggctgaggcaagagaattgtctgaacttgggagataaaggctccagtaagccaagattttgccactgtacaccaacctgagcaatacagtgagactcggtctcaaaaaagacaaaaaaaaaaaaagaaaaagaatttgcgaatggtcaacaatcattatctgtaactgttattatcaccatcacctgtctggtgtttcatttaaaaaccttgtcgcctgcaaaaattccttctagccaatcagaatttattatacaattcttataagaacattacagatgttactttttgcctgtttgtgtgattcgttttttatatgtttgtttttacctaccccaaactttaaaatatttgatagcaatagtagtttatgttttcaaatccacatcacattccaagctgcattccatagcatctctatctcttccctctggatttgtcctccacttccagtgaaaaaaaccagtaatattttggctttgtagaaaaacttatttttattcagagaaattgtgacttcctccattttgcctcttacggacaggaacttgtcattaatgtgcagtagaggcaaacattccttcttggaacaggatctctgcttctggctgataagctaggtgctgctagaatgtaaatgccttctaacttgggtaatagttcttagtacctttcataaagtcctctcttatttcagataaaatttgaaggaactgtcacagatatttaaaattatcaaataaattataccagaaaaactgcttaaattttaataaagtttgtttttagttgagagtgtaaaatatgacattttattttcttaataagtttatgtggacttaaactatgaaggtctaagttttttgttttcctcatgtgtatagacctccaaaattctttgaaattttaatttgggagagtaaaaaatttgttcaggagagtaatttggttcagagtattaaaaaaacaaaggtaaatttagaacttttgtggttaacataaacaaaaatcccttgattcattggatttataataacgaagagaaaattgaaaattagttaggttgtttggagttaggaaggtagaatgatgagagaggaaaatggaattcaactaacttttttgaggacataacctttattttatttatttatttatttgagatggagtctcgctctgtcaccaggctggagtgcagtggcgcgatctcggctcactgtagcctccacctcctgggttcaagcaattatcttgcttcagcctcctgagtagctgggactacaggtgcccaccaccatgcccggctaatgtttgtatttttagcagagataggatttcaccatgttggccaggattgcctctatctcttgaccttgtaatccacccaccttggcttcccaaagtgctgggattacaggtgtgagccaccatgcccggcttaacctttattttattaatatttgtttcttccccaaaacttgcatgatgagtatcattaactgataatactaaattgatcttggaaggactttctgtgaggaaacattacttagtgttgcctataggtatttataagcacctataatagctcaattgaaatgttgcagaaaaattctgaaagacctttacgaggtgtatggaaatgagtgaagaataaagttgagagagaaaactgatggcattctgaaagggaaacacattgtatggaatttagtgggttgtttgttttcttaacctggcttattgaataagctgaactttcccagcctccatcctttaaaatatgaacaccacaaataacaggaaagataatagcattggtttccaagaagagctctacatgtaagccatgcattgggtctctaaggccagtaaccatagcttttgaaatttcaggaattctctttagagtcaccatcttcaaccttaaaaatatgaatttaaagactgaaaagaataagaaactctttagttaccataacacagaaattctgttgtgattttagttgtatgtttattttttaagagttcaaattaaaaaagacaaaattcccatcatttcaataacatttttctcatggttatttactctataaagaagttattgactaaagtatttcaatgctaataactgcaactctaacatgataagtatgtattatttgaactcactatgcaattgtaatccagaataatgcattttaaaatttctaaaaatcaaatgagtctgcttgtaaaatatttttgctggcagcctttatagaatattgaaaataatagatttaaagtgaatattctgattaataatagatgtcaaacttgccaagaaaagtcagtagaggatacagtttttgaaatcttatgtttacagaaagataaaatgaataaaacaggaaaacaagccttaccattctggactatcacatttgtccacattaatgtccacattaatgtcaaatttaatgtctacattaaaatgctcgatgtaggctgggtgtggtggctcatgcctgtaattcacactttgggaggccgagacagggagatggcttgagcccaggagttcaagactagcctgggcaacatggtgaaaccccacctctacaataaatttaaaaattacccaggcatggtagtgtgcgcctgtggttccatctactttggaggctgaggtgggaggatcatctaagcccggaaggtggagattgcagtgagccatgattgcaccactgtactccagcctgagcaacacagtgagagaaaaaaaaaagtgttcaatgcaatttaaataacttaaatgttattggggaaaaatagtgttcttcagatatcatatttgcttcaagcaaaaaaataacttcagttagagctagctggaataatgacagatttctagattatggtcaaaataatgccattaccttgtacctgattgctgcatgtaatttttgaaaacaatacaaattgttttacctgaccttttgggtatcaaagccttctcctatctaaatgcaatgatgatattaggtaaatgcagaataattctgaagttatgttttagacttaaaactgtatgtatttagaagcatgaccaatttcatctttagtaaagcaatacctgaaaaggggggttttagtattttaaacattgtcatttgagcttagaagtaacattttttccttctcttatttatttatgtatttatttatttatcctttataggtcttattcaataccaagaattcctcaggatgtccatttttttgttttgttttgtttcttattatctttgtttttttttttttttgagatggagtctcactgtgttgcccaggctggaatgtagtggcacaatcttggctcactgcaacctccacctccctgaggttcaagtgattctcctgcctcagcctcccaagcagctgagattacaggcacttgctgctgcacccagctgatttttgtatttttagtagagacatggtttcaccatgctgcccaggctggtcttgaactcctgacctcaagtgatctacctgccttggcctcccaaagtgctgggattacaggcatgagccaccgcacccgtccaggatgttcgtttttaaataagtcaccacagcttcatatttaaaaaaaatctttaattaaatttcaaatcttgagctgaatttagtataatattaaacatagtttagtaattacatatcatttattgttgatagttttgcatatgaatctatgtatagctcatttaaaaaatggctttagcatgaagtataaacagttgaacaaataaatgagaaaaatgcttgcttagaaggaatggaaattgggtcagcacagccttgcctttgcccaagcggtggagttgagaaagtattttgtctacacaaaagccagacagctactctaatgcccagtgaattctgacagtatgttacagtttaatgtgatgaatgatgtaaggacccgcctaaaatgctcacgcagcttcccaatgtcttaccctgacctacaaaccagctcataggtctccatgcatgtgttgtagaaagtgatgtagatggccaggcggggtggctcatgtctgtaatcccagcactttaggaggctgaggtgggtggatcaggaggtcaggagtttgagaccagcctggccaagatggtgaaaccctgtctctactaaaaataaaaaaaaattagctgggtgtggtggcaggcgcctgtaatcccagttactcgggaggctgaggcaggagaattgcttgaacccaggaggcagtggttgcagtgagccaagatcgcgccactgcactccaacctaggtgacagagtgagaatctgtctcaaaaaaaaaaaaaaaaaagaaaagaaaaagaaaaaaagtgttgtagattagttgaggatatatatagggagaagttacttcaaaaatgttattttttataaaagtctttttgactgtgtttctcacccacttaaacacctccagggtagagactgtttcttatttatatatattcagtcttgtatatagaggatcctttcctcatgaatgtttatagaataaagttagacattagaaacaagaatgagccttttgcttcttgttgcctgcagggctaaggcgaagctcatggaataagtctaggatgtttgtttttatatgaactgtggtgtaatagaaagagagcaagaaagaacagcagtaagtaggacaagaattagaagctgataagttagtccttctactttagcttagcatttaaagcccatcccactattcttcagcatatgattcagttgatgtgaaactctcactggcttttcatagctctatacatttgcacatactgttctatatgcataaaaattcttttattcctttttcacctgaaaaaaaatatctgctgatcctttaatactctgacacctcatttgaaaaagcttgctttactcctccaggcagagttgattgttcctgtctgagatgttacctatctgtatcatagtgcttttcactttgacttacaagtattcatttacatacatgtctgctctcaggctaaattttcagctcctcacagccgggactatttcttgttcatttctgtattccaaccatcttttattatgcctttcacagttggcattctatgaaaggctggttaatctttctaagcattaaaccagccttttggaaaaataatgtaatatatttacagagaaatgatatatgatggcgaacagtagtttatgctctctgttgccttgtatttctccacaaaagtaaataacaatgacaaaaacacaatatcaaatttagaaatgaaacaagatttgtttgaaagcatttatttgaataacttaaatgaaatagtcagagcagtataaatagcatactacaagaaaataaagtcataaagaaattttcaaaactctctgccagcttttcatagacaatagaaaattagaatagaaaaaaatcattataggacatcctattcaattacatcatgaatggacattgaataaataaatggatgactgaagcctagaggctagaaataacatcctaaagtcacatttgttagcatctgtgctaggattagaacccagatcccaatgccaagtcaaaagtaaaatcctcacttttaaagtgctgtgtcttttttaacttttattttcatgtaataattatagacctacagaaaaagttgtgcaaataacatagagagtttacatatgtccttcacctagtttcccctaatggtaacaatgtacataactatagcataattatcaaaaccagaaattaatataaaattcaggattccacattgcctttttttgttgggtctccatcttctcactatgttgtagtttctcagtctttggcttttatgacattgacacttttgatgagtactgatcagttattttgtagaatgtccctcaatttgggtttgtctgatgttttctcatgagtactttgttgttgttttcttttattattatactttaagttctagggtacatgtcacaacgtgcaggtttgttacatatgtatacatgtgccatgttggtgtgctgcacccattaactcatcatttagcattaggtatatctcctaatgctatccatcgcccctccccccaccccacaacaggccccagtgtgtgatgttccccttcctgtgtccaagtgttctcattgttcaattcccacctatgagtgagaacttgtggtgtttggctttttgtccttgcaatagtttgctgagaatgatggtttccagcttcatccatgtccctacaaaggacatgaactcatcattttttatggctgcatagtattccatggtgtgtatataccacattttcttaatccagtctatcattgatggacatttgtgttggttccaagtctttgctattgtgaatagtgctgcaataaacatacgtgtgcatgtgtcttgatagcagcatgatttataatcttttgggtatatacccagtaatgggatggctgggtcaaatggtatttctagttctagatccttgaggaatcgccacactgtcttccgcaatggttgaactagtttacagtcccaccaacaagtgtaaaagtgttcctatttctccacatcctctccagcacctgttgtttcctgactttttaatgatggccattctaactggtgtgagatggtatctcattgtggttttgatttgcatttctcatgagtactttgaagttatgcatttgggaaagaataactgctatgcccgactcagtgcgtcctgtcagcaggtacatgttttcaacacatctaattactgaagatgttaaccttcagcacttgagtgaggtggttcctgtcgggttttttccatgtaaggttactatttcttccttcataattaatatatttgcaggaaatagtctgtttttcttccatctttcacctactaattttaacattaatggtagatcttgtctgtaacaattattaatcttgtgtttgctttatgtgattttgttatgttcttcattccttctacatttattaattgggattcttttaaaggaggtggttcttctcccccatttgtttggttatttaattatataatttacatcagtgtggacacatagctgtttatttattttaggggttataatccctaaatagtatcattatgtattttgttgtcaaattatttcagcttctgccattgagaatgcttttcaggccggtttcaatatccattcaacatgtcccccattttttctagcactttcttactccttgccatcacaagatattccagattcattttgtatttttcctgcccagtcttctctgattttattctaatgggatagattaattctagtcttctgcctttccttgtttctaatttttttcaaacaatgaaaaattaagctctcattatctacaatatgtttacttatttgttcaatcccggtacacacatcaagtagttacaaagttgctaaaccttgtctctgtaaaaacagatcgactgatcatagtaatgtaatagagtacagtatattcaaaatatttttactaagtgctaatatatttaaagtaatagtttgttattttcttcccaccccattcagtgtggtgatgtcattcatttataatatagctagcttcattttttactatttgtattccactccatgtccacctgatatcctggtttattttgatttttttaagttttggggggatatgtgaaaatcactatggttctaagatgcaaaactattttttagaagtgacacccagaaaggtgttgttccctgtagctccttccctccgtgttcccattacacccttttccctactcatttctcttccactccctgcagcttctgggctttccttcctgtatttcttttgcacaaaggagaagatacatatttattttcttatattcctttctttcttacacgaaaggtagctacagtagatactcatttacaatttgctttcttcaattaagagattatcctggaaaccactccaaatcagttcatagagaccttcctttcttttttacaactgcagattaccctgttgtgttgatttaacataacacagtcatgcactgcataatgatgttttcgttaactatgaactgcatatatgagagtggtactataagattataatggagctgaaaaatttctatcacctggtgacattgttgccattgaaatgtcatggcacaaagcattactcaagaagttgtgttgattctggtgtaaacaaacctactgtgaggccatttgtataaatgggtagcacattcaattatgtacaatacataacccttgataataaacaactatgttactggtttatgtatttgctgtactatactctttctcattgttttagagtgtacttcttctacttatatattttaaaagaaggttaattgtaaaacagcctcaggcaagtcctccaggaggcattcctgaagaagacattgttattacaggatgagatgagagccccatgcatgatattgtcttgaagacttttctatgggacaaaatgtgaaggtggaaaacactgatattgatgattctgattctgtgagagccttggctaatgtatgtgttcacatcttcatttttaataacaaaattaaaatataaaaagcttagagagcggtgatataaggaaaaatatttttgtgtagctgtacggtgtgttagtattttaagctaggtattattacaaaagagtcataatgtttaaaaattgtttataagcaataaaagtgacagtaagctaaggttcatttattattgaagaaaaaactatttttaagtaaatttagtatagcataagtgtacagcgtttatcatgtttatagtagtgtacagtaatgcccttggcttcacattcactcaccactcacccactgactcacccacagcaactttcatcctacagctccattgatggtaagtgtcctatatatatgtgccattttttatcttttacactgtgtttttaccgtatcttttctattttcatgctctttagatgtacagataccattgtgttacagttggctacagtattgaatacagtaacattctgtacagatttgttccaatgggctatactatataatccatgtgtgtaataggctataccaataggtttaagtaggctatattaaagtaagccataccaatatgcttaagtatatatacttaagtaggctataccagtatatttaagtatgtatacttaagtaggctatagcaataggcttaagaggtctataccaataggtttaagtaggcaataccaataggtttaagtacacaagtatgatgtttgcacaatgatgaaatcacctaacaacccatttctcagaacatattcctgattacttgagtgatgcataactgtatattcaacaaaattcctttccattagcaataggttgtttccaatatttgtcaatgaaaaacaatattgcaaagtatatccttgtgtcatgtattttctaattgtttacaatatctttaagatagagtcttagaagttggactgatttctctccaaaagggttagaccagtttgtatttccaccaataatgctgggagtgtgtatgaatgagttaatgatgcttaaagacataaaagtagacttgagcaaatggaaaagacatactctgtttaaatctactggtatagctattactacagtgcctgttttcccacaatctcatgaacagaatgcaatgtcactaattttggttgatccgagaattgagaaacaatatcgcagtgttttaatttgcacttcactgattatgattgagttcacatattttaatatgttggggggctggctagactcagtggctcatgcctgtaatcccaggattttgagatgctgaggcaggcagatcacaaggtcaggagtttgagaccagcctggccaacatggtgaaaccccatctctactaaaaatacaaaaattagcccggtgtggtggcatgcacctgcaatcccagctactcgggaggctgaggcaggataattgcttgaacctgggagtgccactgcactccagcctgggcaacagagcaagactctgtttgtataccttttgtagaaattttcagtttgtttgtttttccagtttttatgtttttgatgcgttttttgcaatttttaagaattcttgataaatcgtggatattagccttttgtctgtggttgtgaatattttctcccagtttttcagatttattttaactttgcagattttatcctgcagatttttatattttgtatgtagtcaaatttatgaattttttatttcattgcttctgaattttgatttgtatttagaaagcctgtttttaatccagttcatattcattcatattttctggtacttgtgttgtttcatttttgcatttagatctctaatttgtttggagtttattttagtgtatactatcagatatgaacctaattttatctttttttcaatggctagccagtagttctagcaccgtttatgaaaaagtttatcttcaccctaagggtttgagatgccacctttaacatgtgccaagtttcagtatatacaaggactgtttctgcattctatttttttttggattatttttctatttatatgccagtacaacaggctagtatcagagacttcatagtatatttgaaagtatagtagtgtttattccttttatagtttttctttttagtgtttttctggctattttttcatgttgccttttaaaataaactttagatcaacctaacttcataaaatagcttgctggaggttttattggaatttcatcaagtttacaatttaccttagaactgagatctttataatgttgagttgtgttagacaaaaacaggatatgtcttttccatttgctcaagtctacttttatgtttttaagaagcattaaaaattccttaaattaatatattaattcctaaatattaattcctaagtacttaatcttctttattgacattatataaaggatttctctatcattacactctttattcatttattagtatattgaagctacttatttttatatgttaatgtgcatcaagctacttactgcttctttaattgagtttgctttaacattgattttataggggtttcatagtatactgtcatatcatctggaaacagatatcgtttttgcttcttctttaccgattcttgtgccactaattaatatcagttatctaattatatcggctagtatttcaagtacattgctgaatatccataaataatggccaagcttacctttgtcccaattttagtggaaatacttcttctcttttctcactaaagaagatacaggtcttggactaacatatatatgtgtgcgtgtgtgtgtatatatatatacacacatatatattgcttctggaatatgtgtgtgtgtgtgtatgtgtatatatatgtgtgtatatatatatgtatatatatatatatacacacacacacacacacacacacaaatatgtattagtccaaaagctgtatcttctttagtataggttttaaagtattcctccattcctatgttcttcaatatttttgtatcataaatggttgtttaattttgttgaagattttttcagcatctatagagatagtcataattttcacctttagttttctaatataatgtatgacagtaagaaatgtttttacattcctgagataaatcccatttagtcacagtgcattatttttaaaacatatcattgaattctgtttgttaatcttttatgtggaattatttatgagtgatagtggtattttgttttcttccttacaatgtctttatttttagatatcactattatacttgtttcatagaaggaattatgaaattttaattccttttcagggcattggaataatttttagactcttcaggctatatggttgttgaaattagttaaaaatctcctgtgaaaccatctgggcctgttgcttttttgtaaagtaattctttgatagctctctttgtttttatgcattgatctgctaagatttataatggaagttgagtcaatttggtaatatctgtttccctagggaaactatctagcttttcaattgtatttgactagagctctgagaagcagtcctccgggggcgtgtgcatgtgtatgttttaatttctttactttcaaagattatttcctttttgtcatttcttattttgaatgtttatatgttattgctgcattttcttgattaagttaactagtagtttttctctcatttgttttccttaaaaataggataatatattagatatagtttttcaattatcttattctcaaatcattttcttcttttatttttattatttccttcattatgatgctttgtttttgtttccttttttgttctttcttaaagctttttgagaagggaatttaattcattgccttttattatttctttgtgattaataaagcctgacttttcttcgtaattaattaatcttcgtaaggattttgttaaagatgcagatggatgggccccacccatgtatggagacttagtttcagtaggcctaggtgtgacctgaggaccagaagcagaatatctagaactacactggagaaccgctgatgcaatattaaaattttacaaatgttcctctcaaggaatgtttaattccttatccaatcattttgttattcagatgcattcaaacatgttatggtgttttgctggtaggtgtcctccttctagacctgtggtattttgacttaataatcgtgactcatattcgaccatttaaaacttgcttaggttgacaataggcaataccaagagtctcccttagataaaatatcacagtttcctaaatctgtcgctcttatcttctaaggcaacagaggtcagaggagctatactaaaatcttaactaacaaacattttaaaatacaactgaagaatgtaatttgtaacaaatttgttcacaataatttttaaaaatccctttgtatgtacactaagtaactgaacattttagaaagactatcagtgatgagaaaaatacaaataacatgaaaataaattatttggaaaattatgctacaaaactataaccactgaactcattcaagcatcaaaaatattagttagaagccttgctctaatgttttggaggtttcccaagactttcaaactactaatctcacttcttaatataaggtagagcaagattctgaaaagtctttgagtttttagttttgctaaagctgttgtttcaactgagcctaggttatacaattgttaggctgaggtctcatcaaataactgaacaaatggactaatgaaagcacctcatatctataattatccacagaacacaaaggaaaagaatgggtaatttcactgtctatattacattgggctggtacttttgttgtgaagctggaatattgaagatgcagtgtaataattcagaggttatttatatatcctttaagactgatactatctgtacattgcacattggcatttatttctacagatttattttggtgtagctggtatgggagccataaagtaccagtgttcatttttccagggatgaaatcagaagagtgttagagaatggtcttcttcctcaagctatcagtgtgaatctctgagataactagagtctgaaaaagaagttcaaatctgtcttaatttttcaggccaggatttctctacaaaactaatcttcaatttagatagatatatgacccttgattttctttcataatgtttataaacgtagagcctcttttgtaattttttcagaactcctcaccttatgctattggggacaaagcaaaagtcaggaaaattagactaatttggaaaatgaccacgttactattgctctggagtaggacacagttggagtttatcaccaagtcattttatgtcccctagtaatgttcccatctcccaaatcctctgctaatattcctgtatctttcagagaagagagaagcaactctatagaagaattatcagcaaaattgctctatgcaacgaaagtatcttaatccactgaaagtaaagcaaatcttgtcagtttctactttgatttagaagattaaaaaaaacaaacaaagttatacataacagatattaatgttaatgaaaggaagaattacaagctctttctgtaatttggaatgatatgaaatgtctgaccattattttgttataattctttactataaataagactaaaggaggatcaaaaaatttttcacttaagaagtaatcatacatttctataaatatttaaatatcaattaaagtacaggtgttttgctattcaacagatgccttataaggacatatacaacacaactgcattcatttcagggttttgaatgtgtcaaaaatgtcctggtaccttgctcagtagttacaactagtaaactgattttcacaaagatctgagtcaaggttgttgttaccagatccttgttcaaagacaccagatactgtagttataatatattatacacatttcagcagtcttttaatttaagaaactattttgagctgtacttagtgcaaagggcaagcgatagtgactgttacattgtttcttttagaaacaaacattgtaggcaggaacacactaaatacaattttaagcaatactggaactaaatttggtcatgtataattatttttgaaacattaggttggttagttgatgttctagatttacaataagcagtgtctattagagagagtttcagggttttttattttactgtggagggaaaagaaaatttgggggtgcctaagtcctgctatgatcataattagttgtgtgattgtaatcataattttgagaatagtaatatatcagttaccacgtattccatatttacttgtggccaggcatgttgctgtatactttagattgatgatgatgggattgaaaaaccaaaactagtattatcttagacatttttcacatgcagaaaccagtttcaaaaaattaggtaacatccaaggttaaacttctacataatttaaatttatttctaataatgacttcctttctttgttaagctaagtttttgaaaatctgctttgatcatgcaatgtaattgtgctgtaatatggcagggtagagtcaattctttggtctttctggataatagtaagaaaattactctaaacagggacatctttggactctatcactgagtccagtgtaattgggagcaacttggtaatgggctttgattgtacctcgttttctacattgctataatgaacaggactgtgtatttgatgagagtcacaatggtatgatgagattggaaaacatgatattacagatgctgtcatatgcaaaccatggcagaagtacttagtgaacaatgactgtaagcattttatgttgcctttcattgaaaatgttttataagaaaaaatttttgcattccatgaagtgatgatggaataattacattttcgatgacaaaattgcgcagcaaatacatcgcataaaagctaaagagatgactataaaattgagtaaagatgccaccttctctacatttgtatatgtatgagtaccttctccaatgttctctttttgtctaattgaactgtgggaaagtgtaaatatccactgagttgagtcaatattaatgtggttcctagtttctatttttcatttgaactcaagttattgagaggatgatgttaaagtctctaactcatagctttgactttaaaataactaaaaaaattgtatatgctctaactgtattgagtaccaactctgctatatactctgcttgagacttgaggacagaaataaatgatttcatatattggttgagatatacaagtatataattgattatccaagtttttttacatgaagtgtatggtctataaataggtttcaaggcattcacagaaccctaaaattgtatgcaaatcactttctgtctatggatgtgaacattttcataggcaaggtgttcatggatttcatcagcttttttagattctcaaaaggttcattatgttaacaaagttagaagttattaaacctctttctccttggcaatggaaataacctagtttgaggggtatatgttttcatatgtgatgaaattttggttcagaagtttcgtgacttgcctaaggtcaagtaattgtttaatgacagatctagaataagaatagtaagttgtcttgtcacctagtccaggcttgttacccaccatatagtttttatctcattgacattatctcattgtttcttcaaacgctagccatatagcctgaagcatttgttttctgcattttcctatactattaaatggaaacatcgccttttatgtgctttcatgtttaatagggaaaaattccaaattgcattagaaaaccaaatcgtaattcagtttttattttggctcattctttataagaagcaaatgacaaccagaattttccaatgtaatttcccaggggagacctagtctcagaacattgtttacccaaatcacagtatcttcgacatctaatgatcattgattatcacaatgataaatcacaaaagaaaaattccattgtatttactgtatgctctaccatctagggcaagggcataaagaaatgattttggatacttcaacagaattgggacaagatattcttgttaagcctctacataggtattattgtaaacctgaggagtccattctccatgcattcaagtcataggtgctctggttttcctttctttctttttggttttttttttttttttttttttttttttttaatcactggggtttggtatctctatggaaataattaaaaactctcaggaaaatggcacttctctgctctcagttcaaatgatagtaagtcagtgcattcttatatgacttcagaagctcacttttaacaatgcatgtgtgtatatatgtgtgtgtatgtgtgtgtgtgggtatacacttgaaggttgattaactcatttataattcatatatgaacacagtaccaaagcgtttacttatttttaattaaaaattggaaggcatgatcttctcacaaaagggaatgtatcactcctattttttcattaggagaggaaaattcatgctacactttatgtgtttatctaacattttgtaattctggggctgaaaaatagaaggaaattaggtcagggttagcctttataaaagacacttttactctgacataccactgggtggagtacattgctagcccagagactaatattactctattgaaaggtaagaatttctgtgccagaagaaactcctgatcagttttgaggttttatgtattgcttctaaaatctggacatgtttaacaatggctaagtgactagaatataataccaacattgactatgctctggcattataactttcaagtttcagtccatcatccctacacctttgggagatatgcctagaagactctgagagaattatgtggatgaaggccattttatattctagtcaaaagagcaactgcagtttggtctgaattagtgttttaactctacatggaaaggcataaagcttctttttgataatgaaatcaaactgtacccaggtattgaatttgactttttatttcatgttgctttgatatagcttattttggagctgagcctaatcttataataaaatgagcttctctacgatgccctgtgggactattattgtccatagcatttgcctgaatttggccttcaggactttatgaatgagaataatttcctagtaggcattagctctatattattttcagtttccccccattcccctctcctctctttaattttttctctctaagtgctgggaaaaggaactctactaatcaaatctaaaaatctccaaccttagaaatttattgtgctttaaattttataatctaataaaattgagtcatttttacagaactatttaggatctataattctaaatatatgtctttatatttcaagtaaagattatgttatatgaaagaaagaattctcacattgatcattcttttgccttgtttcttttattcctttaatttcattttcctgctcacagcacccctttattttttcttagcttccagctctcaaacctcgccctatagcttttatgcttctaaacttcccctcctgccccatttccattctaaatggagttctctttcatctttttttttaacaacctcatattctgcactttacttaatttttcttcccaacgctattaaagattctttatttctcccttcacccaagtatagcatctcatctatttctctatactgaagatgtggtttacccaggggaggaagtttctcatgcacactgctcagtgctgggatgatttcagtggtgccagcatattttaaccacatcattatcatgtagtcccaaagccttgctcactgaaaacaccatctttaaaaggatttagtttccattaatcaatttcagaacttgaaattcaagcacggaaagcatttattagaatgttccctacttgttcccacattcatttcattctcttgactatccaagaaaaaggaattgtgcaaaggtcttttctctctccgtgcttacctctcctttctataacccaccgagccccccaagtctattctttcatacagtagttaaatcagagcatgcggcaggaaggcattgtgtgaactggtggccacacaagtactttgtattcactagaggtttagaagtacagcagctgcatataaatatgcatagttgagagattcatgatggtgcctcctcattctagtgctggttggctgcagtgcaggcactacaaatcaatgaacattttccccatccatcagctgctcgcttgcaagcagacaaaacacttacaatgccagaaacccacagagagctccttagtgaacgaaacctcactgtcacaagattcaaaatagccttctccctcccaccctcaacctccacagctctcgacctcaaatgtcttttttttgttaatccaacgtggatcgcaagtacttaaaaaatgatgccaggaaagaaactggaaaaacaggagcaatgatagatcagagttttgagggtcctcacatcacacttgtcacaaaacaaaggcttctttgagatttaacccttttagaaaataaaacccatcataaagatgaatctgcttatgttgactgtactgctttacaattgtagggtttgagcgttgaagcatttaagtatgcaaagcattatgccaagctgtgtcagacatttgtaatttatctatagttactagatggctttgggtattgaaggaattatgattgatgatatgagaagaataaatcatagatatatttaacagtagaaatcatatttctctctttgagcaattttttgcagagaactcagatgtatttatattgtgacaattcatgtagaaactttaataaagcttaacgtcacttaataaaatttcatatgcaatatattagtgaatcaaatgtatatttcttggtgaaaagatatacattcattacatcttgagaacaagtctatttctcatttttagataaacattggtaataaaaatagtttattcttgtgtagcatgagctattaaacaatttacagtgctttatctgacaacttgccaacccatcttccaataacaataataataaatataatttttcattcatttaggttttcactactttgtaaatacacaccatagcaccatgatgctatgtgatacatactatatgataatatctgtagtccctgtttttaagatgtgaatgttctgattggggatataggaaatacagttacaaaatgaccacgtgactttcaagtgttaggaaagtctagttcagtgttcagtacgttgaagatagtaaatattttttaaatgtatgacatttatttaaaacttatctatccagttaatatgttttgttaccatgttaaagcaaggataaaaacaaatataggcaagataattataattatacttaactgtggctcagagaagctgacagacatgtccaaattttatttgcatgtgtgcagcaaaaccaaaatttgaactcctgtctgcttaacttcagagctcatccattcacttctactaagccatgtagaattacaaggcagaatgtgataattgctctagtggatcagaagaggtaaagatcgcttccagcagggaggaccaaagaagacatcattaagaaggagtagcatttgagcaagcctttgaagaatgggcacaggaacagaggaaaaactgcagacaggggttagcattggtgaaaccttatgactctggaaaatgagttgccaggcagatgaaggacaccactttgaatgaagtggatgccgtaaataacactactatttaaagaatcgccagacggacttcttagttattagaaatggaatgcaaaaatagacttatatttcaggtttcaaatgaaagtcagttaaactctctggacctcggtttctttgtttctaaagtgaggacttgaacctaaaaaccactgaagactcctcttaggaggtccattttgcaatactttcattttcattttttttcggaatataaaaatgttagtagtagtgaattcaatgtgtagtaattatataacctgtatatatgtaattcgtcttaaaacaaaaagtatacctatgtatttacatattcttttaaaacaaaaagtatacctatgtatttacatattcatatctctatatacaaacaagatatttgcatttgactggcttatataagctctcaacttcatttcaagaaggctttttttttggccgtgtatttatctctagtttgcttcttagtgtttgagtgcaaactgattcttataataatttagtcaatacataataagaaagtatacatgtactaagcaagtgataaagacaagatttggggattatgtgctctctcatgatatctgtatatttcaacctttggaggggatgtggagactgaaatattatatattaattcatcaatataatggcaaatttttgtgatgttcaaatgctcttgagtagattcacaaattccacttttctatcctgtaacccatgcagaagtcaaagtaagattttggcaatgtttatgaaatgaatgtgcgtgtgtgtgtatgtgtgtatacacttgaatgtatatatacatatacatatatgttcaagtatatcaaatacatatacatatatacattcaaatatatatgtatttgagacatatatatatcaaatcaatataatgtgtatgtgtgtacatgcttgcacatatatagacaatttgaggaaccataagaacgtaaaagattaatacaataatgcttatttttttcctgacttcaaagcatttttttccattagtactttttctctctaatttccctttccaaataagaaaagagaacccgaaaaacaggagtattttgtttgaattcatggtgagaagaaaaccaaacattgtttttttccataatttttgcaaaggtttctaagggattttagtggggacctcttccttgaatagaattgcccaggatggaattccatcctgccattgttgctgccaaacccattcaggggaacttgatgttgtgagagttccagactctttcattttccatcttacactgtctctcatgtcctaaaatagtatgttttggcaaaaactgatttggattccaatgtatttggaattgatctttggatttggattccaatatgtttggaatttattaggtttgttttaatgatttgaatgaaattgaacctcgttggtagcaaacaatgcagtgctttgatcatattaattctgaggctgatcttaagtagggatagtttaagctcattttggttaaatcagttcatggtcaaattaactaatcttcttaacaaatatttacagagcactaactatattcattagtgttgagtgttgttaagatgaacggaaatataaaaaggtttccaaccttcatggtttgtattttatgttgagaaataagattaaatctttgaaaagttaaccaatttaaggtcttacatacataaatactaaatgagtgttagagtgtacaagttctttggaaattcaaagacctggaatttgtgtgaaccctctgattttgttaactaggtagtaccagcaccgctttctaatgggagaaaagtctcaagatgaatttgccctcaggtacattctgagcagatggaagttgaaaagcaatgaaagtaaatgaaaaaattgaactattttcacttaataaagagaagataaaactggagcaatagggaaattgcggtaaattttactattacaacaagaaaatccttcccttcagaagacaccagtgcaacaatataggctgatcttaagttagaagcatttaatttcatataggcatttctgctgggaagactgggtataagtccattttcatgctgctgataaagacatacccgatactgacaatttacaaaagcatgaggtttaatagacttacaattccacatggctggggaggcctcacaatcatggcagaaggcaagaaggagcaagtcacatcttatatggatggtggcaggcaaagagagagcttgtacaggaaaactcctgtttttaaaaccatcagatctcatgagactcattcgctatcacgagaacagcacaggaaagacccaccccataattcaatcacctcccggttactcccgtaacaggtgggaattgtgggagttacaattcaagatgaaatttgggtggggacaaagccaaaccaaatcagccagaattacctttaaagaggatattgatttacttgaaataaaattaccaagtttatatcatgtaagaattaagagcaaatattcatttgtaatcctaaaaatcagtcacagaattgaatgcttatatttcaagaaaaatgaatattaataaatatcaagatagtaaaaaaatcttaagtccagaacttgaataaaatgttaacccaatgacccttaaatattccttttttttaaggtactatatataaaatataataaaaatgatctggttgagaaatattggtctggaaaattaagatagattaaaacttctttcccagcctctagttattgcaaagattcaccctgattgcctgaggaagaacattctctcacactatggctagaagagaagtgaaaggaaattaaaaataattacaaaatcaatcactaggaaagatttaattgtggacaaaataatgagaaaataacacaaattaatgattagaaggtaattggtgagttttaatgttttattgggctctggattctaaaccttttctaaaacctaagtcaattgaactggttgaagaacaaatgccttaagataaaaacaatttttatatttaaaacctaccattgatttcacaataaagtgccatatagcaggaatatgattagctaaacaaacatatattggctgaaaaaagttaattttgatcaaattttgatcattctgttgtcagtgtccatgctctgcatactcagccttcaaatgaaatgttgatcatctccaaaatttaggtaacaggacaccatctgatgtggtttgagtttgcattcccacctaaatcttatatttaattgtgatcctcagtgttggaggagggccctgctgggaggtgactgcatcgtgggggtagtttccaatggttcagcagcatccccctagtggctgctcatttagaagtgtgtggcacttccccatttactctgtctcttcctcctgcttcagtcacgtaggatgtgccagcttcttcttcatcttcctccatgattgtaagtttcctgaggcctccacagacaggcttcctgtacagcctgtggaatgctgagccaattgaacctcttttcttcataacttacccagtcttaggtagttctttatagcaatatgagcacggactaatacaccatctaacctatagaatgattcatttgtttcttcataggctacttggatctaggtgataatttggaatgctattcatctctgatttgaaaatgatttgggttgcttgtaattggtcatttcctaactcacttacttcctggttctcatgcacaaagccaagaaatatccatctatgtagtcagagtaattctttgggtcttagaatcagacttaaaaatcaatgagaatagacttatagatatttacaatcctatttgcaagtctccatcattttataggtaaaacctaaattcttccttttaaaatttcatatagttcctttttattctgttcttaatggagaatatattatatatgtttaagtaaatccgatgcttttcttttttccatcaaagaagtccaaaattcatcttttttgtctttgttgatttctgtttcccaagttctcagaatgcagcttaaatgaaaagcaccaagaaaggatgatttaacagcttagacaaatttgtatttaagagcagatgaatctgggaggggttggattccttagaacaggagttcttgtgggagtatttgtagggtgggtgaggtgctgcagcagaaataggatgaatattttcaagaagctgtccaaccctctcttcctgccctttatagccaaccaaaaagtgaaagattacttcctcaggtaatgtgctctgactccatagactaggccatgtctccccgttaaagcgctcacagctccctgtatgacatttctcaatgatgcctacattatgtttcattctcctttactgacagggaaagtattaattggtatgtgggttaaacacggtaaaaaataatgatgatagtgattacatttgtgaaaaatcttaaagcatattatggatcagcgaaacaccaatatattagaatctctctctttctctatttgtatctctagctctttaaatgattgtattataagcagttcaccctttctgtgattactagaaatacagcttccccttcaccaggaaggaaaatatgttctgctgcacagacacacacacacacacacacacacacacacacacacacacacacgcattttgccagtggattctcccacaaggacaagtgtagctgactacatttcagggaattacatggggagagtaagtgaggaagtgaaagaagggaagaggggacacgtagctgtgtgttcatctagacccacctaaagttccattttatcattcgaaaaaaaagggtgtggctaagagatgggcataattaataaactgttttagtcttttggccattttaaatgaaacaattcatgtaatatttaatattcttgttattgaaattatattactgtatgtttttatatagttcttacaattgtaatatgtttctaaatagcttgtgtaatattgactaaattcaattattttaagtccaccttttaaaaacatgctatttgttttgttttatcttggtgtaccactgatgttgtttggctctgtgttcccatccaaatctcatcttgtaactcccctaattcccacatgttgtgggaagaactcagtaggagatgactgaatcataggagtgggtctttcccgtgcttttcttgtgatagtcaatgggcttcaggacatctgatggctttaaacatgggagtttgcctgcacaagctctctttttgcttgccaccatccacataagctgtgacttgctcctctgtgccttccaccatgattgtgaggcttccccagtgatgtggagctgtgagttctccattaaacctctttcttttgtaaattgcccagtcttgggtatgtctttatcatcagcatgaaaatggactaatacagtaaactagtaccagtagagtggggagttgctgaaaagataccagaaaatgtggatgtgactttggaactaagtaacaggcaaaggttggaacagtttagagagatgagaagaagacaggaaaatgtaggaaagtttggaactcctagagacttgttgaatagctttgaccaaaatactgataatagtatggtcaatgaaatccaggctgaagtggtctcagatggagatgaggaatgtgttgggaactggaacaaaggtgacacttgttatgttgtagcgaagagactggcagcattttgcccctgccctagagatttgtggaactttgaacttgagagagatgatttagggtatctggcagaagaaatttctaagcagcaaaggattcaagaggtgactagagtgctattaaaggcaatcagttttataagggaagaagagcataaaactggaaaatttgaagcctgacaatgcgatggaaaagaaaatcccatgtttttgaggagaaattcaagttagctgcagaaatttgcataagtaatgaggacccaaatgttaatccccaagacaatggggaaaatatctccaaggcatgtcagaggtcttcatggcagcccctcccatcacaggcctggaggcctaggaggaaaaagtggtttcatgggtcttgcccagggtccctgtgctgtgtgcagcctagggactttatgccactctagctaaaatgggccaaggtacagctcaggctgttgcttcagctggtggaagccccaagccttggcagcttccatgtggttttgatcctgcgtgtgtggagaagtcaagaattgaggtttgggaacttccaccttgatttcagaagatgtatggaaatgcctggatgcccaggaagtttgctgcaagggcagggccctcatggagaatctctgctagggcagtgaggaagggaaatgtggggttggagcccccacacagagtccctactggggcactgcctaatggagctgtgagaagagggccaccatcctccagaccccagaatcgtagatccactgacagcttgcactgtgtgcctggaaaagccacagacactcaacaccagcttgtgaaagcagccaggagggaggctgtaccctgcaaagccacaggggcagagctctccaagactatgggaacctaggtcttgcatcagtgtgacatggatgtgagtcatggagtcaagggagatcattttggagctttaagatttgactaccatgctagattttggactcacatgggacccgtagcccctttattttggccaatttctcccatttggaacagctgtatttacccaaagcctgtacccccattgtatctaggaggtaaataacttccttttgattttacaggctcataggtggaagggacttgccttgtctcagatgagactttggactgtggacttttcagttaatgctgaatgagtagagagtttgggagactgtttggaaggcatgattggttttgaaatgtgaagatatgagatttgggaagggccaggggcagaatgatatagtttggttctgtgttcccacccaaatcttattttgtaactcccataattcccatgtgttacgggagggacctggtgggagatgattgaatcatggaggcaggtctttccaatgctgttcttgtgataatgaatgggtctcatgagatctaatggctttaaaaacaggagtttgcccgcacaacctctctttgcctgccaccatccatgtaagatatgacttgctccttgccttccaccatgagtgtgaggcttcccagtcacatggaactgtgagttctccattaaacctctttcctttgtaaattgcccagtcttgggcatgtctttatcagcagcatgaaaatggactaatacagccacccatttgacttttgcttaactgggaaacctggaaggttacaaactgaaattttagaaacagtagctgaaacctcgcagaggtgctcctaggatctctttcagtttcctaccagaaaagtgggaaattcataccaatctgttgcccaacttgtagctcttctagtccagatgaagaaaagtttcattcgtctgtggatgaagaaacttgaggaataattctatctacatcaagactttttttataataaattaagaatgggagctgtgattctgtgggtaagcaatccttgctcccatgcaggacactaatttttacctacatttgcacatcagagctgcctagagagcctttgtgaaatgcatgtgccctggacctaatcctggatgcttctgtaggcctggagaggggctgtgccatgtgcatttttacaggacttggaggtcatgctgatgtattttctggatcagtaacaacaaaccagggctttcttctcacagtcatgctgtaagacccactaatatttgaaggattcattgttggacaaaatgtccagagaccccattctctagaaaagtgacctgcttccctgtgagctttggatgtagattgacttagcttggcctgcctgtcttcatatttttacctatgattcagatgttaaaaaaaattaaagccctaaatttcttgcccatgtttaaataatatttcaaaggtaatttttataacataaaatatctccaacttctagttcaaaatattttgaaagattattgtttaagtaatacatattaacataccctgtatgcttctttgagaaataatttagagagtattttctaaaggcaataataagaaaaccaatagtcataaataaataaatagtaaacacataataatcataggcatacagcattttcatatctggtgtctaacccacttgactataggtaccttgaagctcataaatattttcattaacatatgatgtatcggctgcgtatttaaaatggcatagaaatgaactattttcaaattaatattttattcatacaaggaacagaccatagcctttcttttatttattccataaacatgagaaaaatgtttttcttcttgcttatatagacactgtattagaatacattctaatatatattatgtgtatatgtgtgtatgtatgtatgtaagatgctattgaaatgactcccatatctatgttcacctgaaaagctcttaattgtgaaacccaaggggcatatgtagtctttactttattggacttcttcgacgtgtttgacttggtctgccaccctgtttgaaattcccatggcttctgtgagtctctccactcttttccttctaatctttcatcattgctcctctctgtcttcttcaagggctgctttctcctatgaacgatttattatttatcattctgggattccttatcccctcattctgaatacaggttttagctgagcaaatcaattccgtcatttcaactcttgctagtatgctgctatttctcccaatttttgtctccaacaaaatgacttcgtacctgagccacatggccatttcctctaggtagctctactagtatatcttaaatctcaaagccatacctcagcattttcttcttcaagtttatggttactcttatgctggctctcctaggtgatgacttcagaatgagccaatttaccaagctgatatttaggagtcatctatgactcctccttaagcctcattacccatatctgactttttccaatatagcttcctaaatatttcttgaaaatttccctcctctccctgtgtatttccactgccttgtttaggactctcatcatctgccttctgagctactacaaaggcctcttatttttttctccattccaactcttgccttttctataatctatattaaagaaaaatcttggcatagtaattcaaacatacactgaaagtccaccatccctgtatggcaaaaatagcacatatagcatcaatgtcatgactccctatttttgtatctatgaaaaatattactaattaattaaaatattctattttgttgttttaatatttatttagaaagattctaaggaattctcaaaacagaagccacccaatcacatcatgtaagatttggcaaataagagtaaatgcatttgccatattgattaggataaaccccatagtgcagcactgtgtcatccatgatcttaccttggtccgattttcctgctttgtctccagccattccctgcatcatattctgtgaaacactttggtgacagcagtttcttgcttacaccatgctgtttcttctttccgggcttttacttatattgctccctttgtttggaggctttctccttacactcctacctttttgccaatgccaattccaattaatttttacctgtgtcgaaaagagtcagcccagttctcacccttttcttgagtccagccaaagattatgactctagtccatattcctgtaataatctatgcatatctctatcaattcctgttattgttcttagtatatctatacttagtcatttttccacttatgtgtttgtttagcctactgatagacactgagaaacacaattttattagtctagcaattttcagacaacttatatagtaactagcacatcagcaagcactgtataagatgagtcaattaactttgaaagtattgctgcacatgtaaaatatcagatttatttaggagaggtatttatttgtcttttcctaaagcacagttcacaaacttctatcatgcactcttcaggcaatccagtcttcccttaatccacataattaatttacattgctaggctgctgtgggaatttaagttttaaactcctgtgtaaagcatagaaatactaaatacattttctgatgaaaatgatgtgttttaaaaaataagaatagttaaagactgtagagaaaaccagctttttttgggaaattgttcccaaacacctaaattctgttttcttttgtcatgaattattactatatattatatattaaagccatgtatactttatatttattttccttcccaatgtttaaaaaacacatattcactgtatatactattgattcaccacagagatatgctttggttttatatggttgagaaatatctaataaaagtgtttcaaaattgtttatactgtaattcatactacttttctggtcttcttagtcataaaccaaagacatgattcgcagatttaaaagtagatataatatctctatatgggtcgagcatggtggctcatgcctttaatctcagcattttgagaggcagagttggtagatcacttgaacccaggagttcaagaccagcctgggcaacatggtaaaaacccatctctacaaaagaatacaaaaaaagtagccaggcatggtgccatgtgcctatagtcccagctacttgggaggctgaggtgggaggattgcttgaacccgtgaggttgaggttacagttagccgcaattgcaccactgcactccagtctgggtgcttgtgtggcagagcaagacaccattccaaaaaagaaaaggcagaaaaaaacaaaacaactctatatgtcctggagaaatttgctgttaaaatttattcttatatatcaatatgttttagagtccttaggttctaaaacttttttctcagttttcttgaattttactcatttggtttttataaacctaaacagaaataattatatgctggtaaaaggatttccgtattgtccgagtctcaattatcaatcaaggtgtgtatatgtgcatgttgtgtatgtgtgagtacacattgtttgaaagaaatgtaagaagaaagaagccaaaagaaaaagggctcagtgtcaaaatataaatgctctgtaatgtgatccaataatatgaaaatttgagcaggaacttatatgagcaggatcccatatttttcatgaaattttttgagaatcatgagacagcaatttgaaatatttgtacttgattccctgaaacatcagtaaatagcacaaagtagtcttctcttaggtgcctgaatataatttggtgactactagatttagaaggtgttgaaataaatttttttgccttaaaatacgaaatactgtgtgaactggtctactcatagagatgaatggaaagctccccagaagtataataaaaaattatgcggaaaagtagtcatgtggtaaacagaaatagtaccttgttatccttgtttcaggttagccagacacatgaatttcatctgtaggaaaatggagaaaaaatatctggccatgggtttgactgattcctgttcttattaagtatgtatcttcatgtgagagagaagagacaggaatcatttcttatatattacagcttaattcactcatccactagtgtttcctgagcactttacacatgccaggaataataaacacagaattgaccacttttgtagagcttatagtctagtggcagaagaggcagattattcagtacccacacaaacaaaagtaaaatttttactgtcacaattgctgagaagtgcacagtaaacagtgaataatcagggtggtggggaaggcctgtctaaggaggaaacactttggttgaaatctggaggatgggtggacgttaaccaggcaacaaaaggaaagacagctgtgcagtaactttattacggatacacactttcttagaaagttaaaagctacatatacaaagcacatatgctgacttcagaccgttgttggtatttgcgtgggatagaggggaaagggaatgcattgggtgaaactttggttgtagtaagacatttattcagcttgcagcttacattctggaaagtcagccagataaacattttatcatttagcaaatacgtaacatagacagcaataaacgatacaaaaaatagtaaagcagaataagaaaatgaaaggttaggagtgatgtcgttttagattgactgttaaaggaagtcctttctgagaagttacctgaatgaagtgagatagtaaataatgagctaggttcttttagctttttttaagagatagagaaaaagataatgaaagcgagcatggcaaaatggtaatacctattctagatttcatacttacagcctatttttttttattatttttgactcttctgagcttttgcattttgaagtatttaaaaagtaattttataatgcatatgtttgtgaccacttggggccacattcagcctagatgagcgattgaggagtaggctaggactttgtgtagttgtgtttggttgagtccgcctcagccgcctattaggatggataatattgctatagacagagggaagctggtgtctgttaggtcctgaaagaatccagttcggcattgacaggtaagagttacatgtgagaggaaactaaagaattgggtaggcagtaagccagcaggtccttgtagattgttaagaagttcagtctcttttctaggagcaatgggaagatgttgaatggtttttcttgcaggggtaaaagtgatatgattggttttgcattgaagaatttaacattttccattcattcaagaaattttaagcttgcagctaccatttgtcaggttctgttccaaatatgtggacatatatttgtaaaaaaccagataggcctttacactcagaaaactcgaagtgcaaaggtaggtgaagtttttgctgtcatctatggatgaacttactagctaaatattttgagatctccttataagctgctttgcaccttcaacaacccatataattatcacctttgacaaagattgggcaaccatcttcattctaatgactgagaattttgataactcactagtttgttcattgtgagaaaaatctttttgtgtgtgtgtaaagtggtttcttatattgttttgtctgtttcctattgtatctgcaatggttatgtgattcttttccaagtttaaggattctaatattttaaggtcaagaaggcctgggccaaggacagaagagccacatgagttgcatgttcattactaaagccgagccaaaaaacacagtccttcagagtgtcattcgagaactggaattttcagcacttgccaaaaagagcatttaaaattcaagtattagtgataggtatccttttaatattttggaggtagtctgtatcttctgtacaagaaacgtgttctaagtgattagttattattggggacttggaagaagtgataaagatccattctcaatgaggaaacatgagcatagttaatgccatccagtttaaaagattggcttagtaatttcctttgagcagttccctccgatatttcccattcatttgacttcattctcctggagttttgtcattttccacaaaacttaattgatctatctttagagacaaatgaggtccattgtttgccgtggagacaatgtggatggtagtcaaatttgattattgactctttctctttagttacatagaaaatgggactaccaggttactctagtatctcagtggtttatcggacctaagttggtagcaactaaaattttatgtaagtacttcaaattgctccctatatttattgtaaaacaaaagcagttatcttaatatacggctcttctaacattcagtttatcatataatgaaaaaagatgttagtgctcagaccgtagtatctatcaatgaattctgaaaaagaagaaaaaagccagtaagtatttatgcttttcttaattaccagtttgataactgcaggcagataaatcttcttcgtttttatagccaagtaattaaatgtttttacaacaaatctggcgtgccaaataaagacaaaattgtttttaaaatttaaaagaaatgttagttttcaagggataatatataaatttaggagtcaatttagagcttaatattcctttgagtttatctttcattttacattactaaatttctttttagttataaatattagtatttatattttaaaattatatatttatacaataatatagatgtttgcttttaagataaccatgggtgatagaaacaacaaatcatatatatctttgcaaatgccagaacattagcagaattgtaccaagttgaattatatcaagtctagcactggtagaattacattgaggacaactttatgtgttcccaaattagaattgattaagttggtttgtttgatttttttgtgtaaagtggtttcttatattgtaaaggaagagttaaatgagcttatgagagataaagagtgaaaatgctaattttagaaaatgcaagaacttgattttcaattcttttatttgttattacaaaggttcaaccccaagggaaaaacaggattgagtgtctcattcggagaggctttgcctcacttttctgtttgaaaatggcggagctggggaactgggcttgagagtgacagggacccaggtcaaaactctgctgttctcctttacaatctttgtcatgttaggaagttacttaattctcttaagtatctgtttccttatctataaaatggaaataatacttacaagttttaactagtatatgtaagtgtcgttaagtgtccaaaactcagtgaagcttattatgctatgaaacttttccagtcctttctctaatcactgtgtttattttactttttaaattttttattcttaattttatgactatatagtagctatacatatttatggggtacataagatactttgataaaggaatataatgcataataatcacattagggtaaatgaggtgtctatcgcctcaagaatttatcatttgtgttacaaacattccaattatattattttagttatttttaaaggtacaataaatctgtgttaactataatcacacaattatgctatcaactactagatcttattcattctaactatatttttgtacccatgaaccagccccatattccccatcactgtgggtttgtttttagatatttacctatagtatttgatcagatatttaatttaatattttaaatagagatgggatctcactatgctgcccaaactcatctcaaactcctgggctcaaacaatcttcccactgtggccttccaaagtgctgagattacaggtgtgagccaccgtgctcccccatcagatattttgcaatcaagcatgtgttaaaaattttgcaaagtgtctgttgttatccatttcacagaaagatcagatggtgacataaaggagaatctcaggtccaaatgtccaaaatagcagaagcaaggtgataattgatagcctttaggaagcattatgacctcgtattttgttcttttccttcgtaatcttcctagttcttctaaaaatgtgatcccaacccctcacttccatatttgcctgtattatttcttttcatagcacttcaccaccattgatggtacatatttatttatcaatttattacttttggtagtatataacgtctgtaaagcaagagtttgttattttgtatgtagtcttctcttaataaaaattattaattattttgtattttccatgatataatttgggataatttttagaaatgaaatatcatacattccattaattgcggtcaaaagaaaatgcatttaaagaggatatatgcatgtgtgtttttcaacaagtaaggttaaacttactttgtaacgtataaaataaacatagctaaaaactatactaaaagtgtgattttaaaactgtgatttaaaaatacagcacattttacttaaatggagatttttgttctagaaagatattgaacatgacaatctgacaatctgtccttgggacactgtcactgctattctcagatcagctgacgagacctcagctgggcctctgcaagttgcttaagaacacttctagaaccatcctaatgggcatgttccaactgtcacttggaaaaaaatgatcacttgagatcaatctgtacagcaggtcttctggcagaaaaccagtcatatcattctctccaaaagaggctttgtggggaaaaggccttatcacattccttggacatgaagttactgttggaaccatgctcgtctcaaaccattctatcaccatgccaaaaagctgcagcttctgaaaggtcagaaatggccttataatgacttagaccatcttatgattgttaggaagtgaagatagttataatactataaaagctttgggtcttttaccctttcatgagcagaaactgtgtgttattaactaaaccacaacttcctgatataaatatcagagagaccaaagctaggagactaatattaactctaatcctatcctggacttggattcagagtgtagaattgggttattcaaattgtagaatattaaagagaaaatggagtgcacaaaaggctaagaggaaaaaatatatatttcttatgaacaaaaattcacaattgttgcatatgcattgttaataatgtggggaaatttatattttttaattaagctttattttttaacctggtgtttattcttctgcattaattaaatagaagaatatatgttttgaattttaaaatatactgctagtaggcattacttgatttgaatcatgaagaggagctgggaggtgaatctcaaaactgaaaaattggagcatttcaataatcctcatttttaaagtggcaatgccaagctttgcagaaaatcaaaagaaagcatgtgctgtgataataaaattagactttactcataaatattatagtgcacatcttaattcctttatgcatctgtaaaataagtggacttatctagacaatcaaaaagtttttaactcagttaacctacgaatgataatatatttaaaaatactgttttaataaacatgttaactataatttcctatgtattcattataaagagtatgtttgttttgtgtcaaaggtgcatagtatagacattgtaatattgtttatttgctcctatgcacttttgtaaaaatgctaaggtctattttgtccctattcttcaactgtgagcaacttgctttccttgtagaatatcaacttcttatgaccgcttatcctgatgaaaaagctaaagctttttgtaatgaaagatagaatacagttgcacgatattttaaattcttttgattgttcaaacgttgattttctaaactaggagattgttaattttttaaataggacattgttttgaagatacttttggttgcatcttcataaacaattctctcttcagtgaaagagaaagggagcagagaacaagaagagagtttctaagtaatttatataacaaactagtaatttgatttatctctttgtccttcaactgtctgcaaaatcttgccttccacattctgctaatcttgtcttaaattggtagtcacttacaccatgtatgtcactttgaaacttgcaggtgtgtttattttccatcatctttattttggagatagtgaaaaagccaaaaatctcacctccaattaagaaaaatattcttctaatgcattctaatgcattatgtgttttatgttctcaagtactcttttttttttttttttttaatttttaagacagagtctctctctgttgcccaggctggagtgcagtggcgcgatctcggctcactgcaagctccgcctcctgggttcacgccattctcctgcctcagcctcccgagtagctgggactacaggcgcccgccaccacgcccttctcaagtattcttagcttgagatgatggattagaagaatagatttcagtgtttaagcacatttgcttgtgcaaagcataattgtgtccacctgcagtagtgtgtgtatgtgcataaatttatatatctataaaataagaatgctgaactatactcacatgactgttcatagaaaaatgtagacacactttgtgctttaccaattactgctatttcaaaaaacacatttctttataattcattctgtgactttattcctcttaaatatggttgggtcaagttacttaaactttggcacaaaaaatgtttgtctcagcattcttttttaatgatttaggcagaattgaaaaactcgagtcataagatccagtgaatacacctcattattaaataatgctgtttcttgttacagctactagctgctctagctgggtaccctggctcgaactctcaaatcatttaaagcctacattttaaaaacagttttaaatctaatctcttttttatatctgatatgacttttaagcttactacattcatcctctgacattctgcaagggaaacatgaattaatcattgagtttgtccaacaaggaaagatgcatcttactgatactgtgagcttccagtgtggtacacacaagctgtttctgagattatagcacaagcaaacattcccacagctattgtgttgctgtttgctcagttcccagtctcttagaattccaggttgtgatagtacagcagtggaatctatgcttatgtagtgttgattctgttattgtactcactgcaaacctagaggttactatctgttaatagcaaaacaaacttggccaagggttattatgatgtatcttctgaaagcatttaccagaaacagtttgttaattgttacaaaaattgtattttatttcatagtcacaaatgtttatatatttttaaaaatatgaaatgtagccagagagaaaataataattccgttattgcttataatttgacagatcaatttagaatgaggaagcatattttaaagagcaaatggtacattttctttgtctgaagtctgcctagaaaacagattttatgtgacggactactgggtggcttctttcatatccagctagtagtgttattgactgattttgccagctctgcagctcatgtgctttttaacttaatttttgttcccgctttctctcattgatttgtaagcagcttaagatcagaatgctgtcatctaattcattggtatctccctccaaggaatggagttttattttatgttaaaatttttttctgggtacagagtaggtgtgtatatttatgtggtacatgagatgttttgatataagcatgcaatgtgaaataagcacatcatcaagaatggagtatctatcaccttcattgagctgcaaacaatccaattacactattattttaaaatgttattcttcaatatagtcaccatgttgtgttatcaaatagtagctcttattcattctttctattttttaaaaaatgtttttacccattcaccatccccgcctctacccacaatcccccactaccacttcccagcttctggtacctatcctttctactctctctgtccatgacttcagtctttttgatttttagatccccaaaacaactgagaacatgggtgtttgtctttctgtgcctggattatttcacttaacgatctccagtaccatccatgttgttgcaaatgacaggatatcattcttttttatagctgaataatactccattgtgtatatgtatatgtaccacattatctttatccattcatctgttgatagacacttatgtcgttttcaactcttagctattgtaaatagtgctgcaacaaacataggtgtgcagatagctcttcaatattctcatttcctttcttttaggtatataaccagcaatgaaattgctggatcatgtagtagctcaatttttgttttttgaggaaactccaaactgttctccatagtggttgtacaaatttacattccacccaacagtgtacaaggattctcttttgtccacatcctcgcaagcatttgttactgcctgtattttggacataagccattttaactgaggtgagatgatatctcattatagttttgatttgcatttctctgatgatgagtaatgttgagcaccttttcgtatgctgctttgccatttgtatgtcttcttttgagaaatgtctcttcaaaacttgcccatcttttgactggattattattttttttcctagagttgtgtgagttccttatatattccagttattaattccttatcacatgggtagtttgaaaatattttctcccattctctgtggattgtctcttcactttgttgattgtattctttactgggcagaatcttttaaacttggtgtgatcccatttgtccatgtttgctttggttgcctgtgcttgtggagtattgctcaagaagtctttgcctagacccatgttgtagagctttcccccatgttttcttgtagtactttcacagtttgaggtcttagacttaagtcttcaatccattttgatttgatttgagagagacaggggtctagttttgtttttgcatatggatatccagttttcacagcactatttattgaagagactgtctttttcccagtgtatgttcttggcacctttgtaaaaaaaaaaaaaaaaaaatgagttcactgtaggtgcgtggatttgtgcctgagttttctattctgttccactgttctatgtgtctgtttttatgccagtaccatgctgcttttgttaccatagctctgtagtataatttgaggtcaggtaatgtgattcctccagttttattctttttgcttaggatagctttggctattctcggtcttttgtggttccatattagtatgaggattgatttttttctatttctttgaagaatgtcatgggaattttgatagggattacactgaatctatagatttctttgggtagaatggacattttaacaatattgattttccaatccttgaacatggatttgttttttcattttttttttgatgtactcttcaacttctttcatcaatttatagttttcgttatagagatcttttacttgtttggttaagttagttcctgcatatttaattttatatatgattatcataaatgggattttttaaatatttccttttcagattgttcactgttggtatatagaaatgctactggtttttatatggtgattttgtatcctgcaactttactgaatttatcagttctaatagttttggggggagtctttagatttttccagatataagatcttatcatctgcaaacaaggataattttacttatcctccttttcaatttggatgagctttatatctttctcttgtttgattgctgtagcgaggatttacagtgcaatgttgaataacagtgatggcaatggtcattcttatatattcccaatcttagaggaaaaattttcagtatttcctcattcagtatgatactagttatgggtctgtcatatgtggcttttgttatgttgaggtatatttcttctatgcccagtttttttagggtttttattatgaagggatgctgaattttatcaaatgctttttcagcatcaattgaaataatcacatggtttttatccttcatactcttgataggatgtatcacattgattggtttgcatatgttgaaccatccttgcatcccagggattaatgagtgatttttgtaatatattgttataatgattgatttttgtaatgtgttgttgaattctgtttgttagtattttattgagaattttttcatcaatattcatcagcaatattggcttgtggttttctatttttgatgtgtctttgtctggttttcatatcaggataataccaccctcatacaatgtgtttggaagtattttctttgcttttattttttaaaatagtttgagtaagattggtataagttcttttttttaatttcaataggtttttggggaacagatagtgtttggttacattattaagttctttagtggtgattttttgatgcatccaacacccaagcagtgtaccatgtacccagtgtgtagtcttttatccttcatccttctcctaccattttccccaagttgccaaagtccattgtatcattcttatgcctttgcatccttatagctttgcatcccacttatgagtgagaacatacaatgtttggatttccattcctgaaatatttcgcttagaataatggtctccaattccctgtgaatgccattatttcattcttttttaatggctgagtagtattcaatggtgtgtgtatatatatatataaattgtggtatatatatacacaccacaattttttaatccattggtcgattaatgggcatttgtgctggttccaatttttgcaactgcaatttgtgctacgataaacttgtgtgtgcaaatatctttttcctgtaatcactacttttctgctgagtagatacccaatatgggattactgaatcaaatggtagttctactttagttctttaaggaatctccacactgttttccatagtggttgtactagttttcattttcatcagcagtgtaaaagtgctccctttccaccacattcatgccaacatctatttttttttattttttgattctgtgaagaatgatggtgttattttgaaggaaattgcgttaaatttgtagactgcttttgattctggccattcttgcaggagtgagatggtatcgcattgtgatttggatttgcatttccctgatcattagtgatgttgagcattttttcatatgtttgttggccatttgtatatcttctattgagaattgtctatttatgtccttagttcactttttaatgagattgtttgttttcttcttgctgatttgtttgagttccttgtagattctggatattagtcctgtgctggatgtatagcttgcaaagatgttctcgcactctgtggtttgtctgtttactctgccggatgtttctttgctatgcagaagcattttagtttaattaagttccatctatttttctttgtttttgctgcatttgcttttgggttcttggtcatgaagtgtttgcttaaaccaatatctagaagggtttttccaatgttaacttatagaatctttatggtttcagttcttagatttaagtccttgatctatcttgtgtttattgttgtacgaagtgagaaatgaggattcagtttcattcttctacaagtggcttgctaataattatcacagcatcatttctcaaatagagtgtcttttccatactttgtgtttttgtttgctttgtgaaaaatcagttggctgcaagtatttggctttatttctgggttctcttttctgttacattggtctatgtgcctatttttataccagtagcatgctgttttggtgactatggccttatagtatagtttgaagtcaggtaatgtgctatgccttcagatttgttatttttgcttagtcttgctttggctatgtgggctctattttggttccatatgaattttaagatttgtttttatagttctgtaaagaatgttggtgttattttgatgggaattgcattgaatttgtagagctttgggcagtgttgccattttcacaatattgattctaccaatgcatgagcatgggatgtgtttccctttatttgtgttgtctgtgaattcatccagcagtgttttgtagttttccttgtagaggtctttcacctctttggttaggtatactactaagtattttattttattttattttattttattttattttattttattttattttattttattttatttcatttcatttcattttatttgcagctatggtaaaaggtgttatttcttatttatttatttatttatttatttttttgagacagagtctcgctctgtcacccaggctggagtgcagtggtgcgatctcggctcactgcaagctccgcctcccgggttcacgccattctcttgcctcagcgtcccgagtagctgcgactacaggtgcccaccaccatgcctggctaattttttgtatttttagtagagatggggtttcaccatgttagccaggatggtcttatctcctgacctcatgatccacccaccttggcctcccaaggtgctgggattacaggcgtgagccactgcgcctggccaggggttgagttattgatttgattctcagcttggtcgattttggtgtatagaagagctactgatttgtgtacattaattttgtatctggagactttgctgaattctttcatcagttctaggaactttctggaggagtctttagggttttataggtaaacaattatatgatcagcaaacagtgacagtttgacttcctctttactgatttggatgccctttatttctttctcttgtctgattgctctggctaggactttcagtacgatgttgaagaggagtggtgagagtgggcatctttgtcttgtttcaattctcagagggaattctttcaactttcccccatgcagtattatgttggctgtgggtttgttacacatggcttttattacattatatgccagttttgctgagagtcttaatcataaaggatgttgggttttgtcaagtgctttttctgcatctattgagatgatcatgtgatttttgtttttaattctgtttatgtggtgtatcacatttactgacttgtgtatgttaaatcattcctgcattcctgatttgaaactcacttaattgtggtggattatctttttgaaatgttgttggatttggttagctagtattgtgttaatgattttaacatctatgttcatcagggacattgttctgtagttttcttttttggttatgtcctttcctggttttcgtatttgggtgatataggcttcatatgaatagaataatttagagaggattccctctttctgtatcttgtggaatagtgtcaatagatagtaccagttcttctttgaaagtctgatgtaattcagctgtgaatccaacaggtcctagacttttcttttgttgtcggcaatttttttttttttagcaccatttcaatcttgctgcttgttattggtctgttcagagtttctatttcttcctggtttaatcttggagggttgtatatttccaggaatgtacccatctcctttaggttttctagtttatgcatttaaaggtgttcatggtagccttgcatgatcttttgtatttctgtggtattggttgtaatatctcctgtttcatttctaattgagcttattttggatcttccctcttcttttcttggttaatctcactaatggtctatcaattttatttatatttttaaataaccagctttttgtttcatttattttttgtgattttttttgtttcagttttatttagttctgctctgatttttgctatttcttttcttctgctgggtttggttttggtttgttcttgtttctctagtttttcaaggtataaccttagattgtctatttgtgctctttcagacttattgatgtaggtatttaaagctgtgaactttcctcttagcactgcctttgccatatctcagaggttttgatatgttgtgtcactattattcaattcaaagaatttttaaatttaaatttccatcttgattttattgttgacccagtgatcattcaggagcaggttatttaatctccatgtatttccatggttttaaggtttccttctggagttgatttccaattttattccactgtggtctgagagcacctgatataatttcagttttcttaaatgtattgagacttgttttgtctcaattattatatggtctatcttggcgaatgttccatgcactgataaatagagtgtacattctgcagttgttgggtagaatgttctgtaaatttctgttaagtccgtttgttgtagagtatagttcaaatccattgtgtcttttttgactttctgtcttgatggcctgtctagtactgtcagtggagtattgaagtccctcactattgttgtgttgctgcctatctcatttcttaggtctagtagtagttttataaatttgggagccccagtgttaggtgcgtgtatatgtatatgctaggtgtgtgtgtgtgtatatatatgttatatatatgttatatatgttatatattatatatatgttatatatatgttatatatatgttttatatatatatgttaggtgcatatatgtatatatatgtgtatatatacaggattgtgatattttcctgttgcactagttctcttatcattatataatgtccctctttttctttttaattgctgttgctttaaagtttgttttgtctgatataagttttataaatttgggagccccaatgttaggtgcgtgcatatatatatatatatatatatatatatatatatatatatatatgttaggtgcacatatatatatatgtaatatatatatgttttatatatatatgttatatatgttatatatatgttttatatatatgttatatatatgttttatatatgtgttatatatatgttttatatatgtgttatatatatgttttatatatatatgttaggtgtgtatatgtatacgtatatatgtatacatatacgtatatatacatatatatacacatatatataggattgtgatattttcctgttacactagtcctcttatcattatataatgtccttctttgtctttttaattgctattgctttaaagtttgttttgtctgatgtaagaatagctattcctgcttgtttttggtgtccacttgcatagaataactttttccacccctctacctaaagtttatgtgagtccttatgcattaggtgagtctcttgaagacagcacatacttagttggtgaattcttatccattctgtgattttgtgtcttttaagtggagcatttatgtcatttacactcaatgttagtattgagatgtgaggtacttttctttccatcatgctaattcttgcctgaatcctttgttttttcaactgtgtttttgtttcataggtcctgtgagatttatgttttaaggaggttctattttggtgtatttcaaggattcgtttcaagatttagagctccttttaacagttcttgtagtgctggctggcttggtactgtcaaattctctcagcaattgtttgaaaaagactattttttcttcctttatgaagcttagttttgctagatacaaaattcttggctgataattgttttgttttaggaggctgaagatggggctccaatcccttctagcttgtagggtttcttctcagaaaccctcttagatattggtcttaaagccttgcccttgtgagggtattttccagattctgtatgcatgctttattgttttctattcttttatcttttgtctcctctgactgtatttttaagtagcctgttcttcacactcacaaatttgttcttcttcttgatctattctgctattaatggactcatgcattcttcattatgccaaatgcatttttcagctcaagaatttatgcttctttttggttattttgatctctttgttaaatttttctgatataattttgaattgcttctctgtgttatcgtgaatttctttgagtttactcaacacagctattttgaattctctgtctgaaaggtcacatatgtctgtttctccaggattggtccctggtgccttatttagttcacctggtgacatcatgttttcctggatggtactgaagctagtagatgttcttcagtgcctgggcgttgaagagtcaggtatttattgtagtcttcagtgtctaggcttatttgtagctgtccagaattcttggggaggcttaccagatatttgaaagaacttgggtgttatgacctaaggcgtttctggtatagggagcatcccaagcccagtaactctgtggtgcttgcagactcacagaggtaccaacttgatggtcttggacaagatccgggagaattttctggattaccaggcaaaaactcttgttctctttccgtgctttctcccaaacatacagtctctctctctgttctgagccacctaaaactgggaatggagtgacacaagcacccctgtggccaccaccactgtgactgcactgagtcagatgtgaagacagcacaccgctaggtcttgcacgggcctgctgtaaccattccctggctactgcctatgttcactcaaggccccacaatcagcgggtggcaaaggcagccaagaatggtcaaggaaaggagttttaaatgaggtggatacagtaaatgttgatgacatagattattcaggcagaaatatgatgtttcatcaagcggatggaacttatcaagaagaaaatacataattctacttcctttacttctttccaatcttggaaattatgaagggttaaaaaacttaatgttgtgaaatgggtatgaggaagagagatggaaattttacccttagttctgccgtgaactagtgatgtgacgttgctttgcttctctgtaaagtgaggaagttgaaccagttgatttttaaattaccttctagttataagactaatgctgttttaatgaagggcatcataatttttaataataattctctacaccagataatagtctgttacatttctagaatgtaaaacttgggccacttaagctgaaaccttatgatcatgtccacataatggatttcaatctcagcacctatttttttaataatttaaaaagatgttattaaatctaaaagtcttagttttgtcattttgttattttttagctgttattttgttttattgtagcaatatggagtgatttttcttttttctttttacctttaccaactgtcaatttaaacattactaaattgactaatcgttttgaataacaatgagtcttttttttttttttttaaattttgagatggagtcttgctctgtcacccatgctggagtgcagtggcatgatctcaactcactgccacctctgcctcctgggctcaagtgatcctcccacttcagtctcctgagtagctgaggtgccaccaccatgcctggctaatttttgtatttttgatagagatggggtttcaccatgttgcccaggctggccttgagctccggagctcaagcaatcaacctgcctcagcctctcaacatgctgggattacaagcatgagccaccacgccccaccaagagttttaatcattacattcatgctctacagagcacaaacatgctcatgcttttattctaatgctcatgtgccctttgtcactatcagtgttgccagtctcatgtatgtatgagaaggaacagagaatgccttgccacagtgtatcgttaccaaatacaccactaacactcactgtgtataataatgttaaagcagttagctatttttttaaattctctatttcatctattttctgtttcttttccaggacatccataaaaattcatcagagagcattttactactgagctgcaaaggtaggaaaaataaattttttttggttagaaaatatacttctttcatctgcgtttcaataatttattccccttgttagatatacatggaattgatattgcttattctgactaagtgaaaagtgttatttctacttactgctcaattagaaacatgtagtgtttaattgtcagtttgaatttttctttcatactattacagtttatattttactataggcagaatttcctctttatcctaaattttgatattctccataatttcatcgtgccttgacattgctgtatataatttctatacatcaggaaggcaattctgtgtgcatgtgtgtgtgtatatatatagttagaagttagaaactgaaactcttttttgtctaccatcatttcatatttttcttgctatttcaaacctataatttttaaagaaacgactaacgtaatcattcatagaatatgctgtcagtaacttaacaatataaatgttaacatggaggcatttagttcagcatttgctttacttaatagagtgcagaaaatgtggcccttttctcagttagggtgtatgtgaagataaatttagaatttctagactagtaaatacttctctgataataacttaattatagctatttcaaaccaaattgtttaattgtggtgaatcatatgtaaattgttcagatgtaggtcaacacccacgcccacattctagcacctctttcctaattcaagacaactttgcagtgcctaaaagagctgaacagtgcagattagagacataagacaaaaaaaaaaaaaaaacacaaaacaatggtaacataaaaaccaaccgtgtcagaatggtaacacaaaaaccaaccaggagtcagaaagtctctgtaataatgaataggcaggttgtatttatttagactttgcttgattatttcttaggctttatatgtttgtagataacagtttcctcactgctcacgagatttgtggcaagcaaactcatggtgcttctaggatattaaattttctcatctgtaaagtacatgcaatagcatcattattgtctactcattgaactgaaataaggattaaacaaatcaaggactgtaaaatgaacgtgtgactcctcaaatcccatacgggaagaacatgctgtttttcttgatctggttgagtcaaagatcactgatggcaagaatgccttctgtagctgcaggtgaggacaactgagatacggtgcaattgcagaaagtaaataaactttttattttttgagctgttacattatagttctaatctatggatgcctttgtgatgcagcattgtatcattttctgatgaatggctaaggttttatgattctattttatctttatatattgtctgctgtattttcaaatattttatttccatttatagatgcattgaaaaatcataaagcacattgcataaatgtgttacatttgtttttgcttatttgtttatttgagacggagtcttgctctgtcactcaagctggattgcagtggcgcaatctcagctcactgcaacctccgtctcccaggttcgagcaattctcctgcctcagcctcccgagtagctgggattacaggcacccgccaccatgtctgactaattgttgtatttttagtagagacagggtttcaccatgttggccaagctggtctcgaactccttaccttgtgatttgggaggcctacctcagcctcccaagtactgggattacaggcgtgagccagcatgcccagcctgttgttgcttatctttaggtgattattgctgatgtttttggtatattgacagaaaatagtcttgctgcttgttgatgtatactactttttggctttaatgataataaaattataattttgccttaatataaacttaatttttattgtcacttatcacgagaatttgttcaaggatttgaacttatatctgcatataatttatgatttttgacattttctaaaaattaattatcgaaaaaagtggcaattgtttattttaattcttagaggggtaaaataaatggtgtatcctttgcgcttctttcaatatgagtatctttgttgttttaattatttaagataaaaaaataagaattacactaaacataaaatgatatatccctcaaagttagctactacaaaagttttcgtatttattctttcagattctttctttatatacagaaacatcaatatcaatatgagcatataatgtttccatatcatatatatgatcctctggatttttttttggtgtttaccattttaattatgggcattcttctaagtctatgtatgttctctatttcatcgtttgtaatggctgcacattagtcaatattttggatgtatcatgatttatttaataggtcctctaagcttttgtttaaaaaatagaactttaaaatagaataaaaagaggcctctcttaattacaggtttggcaggcatacaaaagaataattctcacttgtatactgaatcaagaaattaaggagtaaagaaaaagtgttacagtaaagagtcattgaaaatagtattgagtaagtgtgtattagtgggctgggtaaaggaaagctaataatatagatattcatgcaagtgtgttgtaggtgtgtaaaatggaacagctacccatttcttcagagtttatctcaaatggcacctccttccataagcactcagagacttttcccttcattcccactctcaccagttgtcttacatcgctataaaaattcagggaaaaatagaccttttcatgttatgtcccatgtacaaattcattttgtatgcatctttttttttcctcactaggctgttaacccctagagggtaatgactgtgtgttattcatctttgaacctaatagatgcagaaaaaaatattcattcaattaaattggaacaaagtgtaagaaaagaaagtaatcggcagggcacagtggctcacacctgtaatcctagtactttggaaatccaaagtgggtggatcacctgaggtcaggagtgtgagaccagcctggccaacatggtgaaaccctgtctctactgaaaatacaaaaaattagccaggagtggcagctcacacctgtaatcccagctacttgggaggctgaggcaggagaatcgcttgaacccgggaggtggaggttacagtgagccaagatcgcaccactgcactccagcccgggcatcagagcaagactctgtttcaaaaaaaaagaaaagtaatcaagtagaactgttaaatcttacacagattttataagatgccactatatgccttgctattatgcctggagtaaattataatcaattctcctgatggatgagacacaaataatataaacacatgggtttgatatataatggaaattattttaaattgaattttagtgattttttgtggtatttatgttcaaaaagcataccgacaagtcaagcatttcagaaaaatgtttataaatgtatgaaaaagttgtttgtgtggtgctgaacttggatatatattactgcatatcaatgtgaaaacattgtgtcagcttcaaagcattgtgcatatggaagacattattgctattgttaatactgtaatagaattgcctctgcggattaaaaatgtagatgtttatgtacaaaatagcagcaataagtaaaagaagaaattatttatatggattctattaaataaaaagggagtactgttttcagtactttgtgtaatgcagattgctactcatgccatttaaatctctgacattgtcttaccatttgaatcatgcttgaaagaacctgtgtccacttagtctgatttcactggtaaaataaattaggaaaaaaaacaaaaacaaaaacgaaacagtgaacagatgtaacgattgcaatttaatttaaagaaaaattagaaaatagtggaagtaaaatatccctttgaaacagaatgtaatgcctagtgagttctttttcttatctcacttgcaaaagtcactagctccaactctgatttcacatgcctattactgagcaggtcaataagtcattgggaagaaggcgagtatcttggtcagtcttttctaatttatttattttttttaggctgttgctgagctttgtaaacccagaggctgaaacttagtgtttcaaatgcatatcttagcaatgcttttttgttttgtttttttaaaacaacaacaacaacaacaaaagctctgatctcctcattgttttctattttgctagggatacaaatataagtacctctagcccctatggcatgcaaaaaaatgagtgtaacaacaaatatcagataatagaaaatggtgggtactgaggaacaggtgatcgtatggttaacatctgtgctataagggctacttctagaatactataatgaacattctagtcaaatgttctgacaaattgtgtgttccagtggctaccacttctgaagatttaggaagttgagtatcggaatttttatgtaaaatttcatgattttgaatgttggctcaaagatagaaaggaaaaaagaaagaaaaggaaggaaggaaggaaggaagaaaggaaagaaggtaggtcggtcaaggactagggactaaattatgccccctgccttgcaattcatatgttaaagccctaacccccaatgtgatagcatttggaggtggggcctacgtgagataattaggtttagataaaattatgagggatgttcatgattagattatggtccttataaaaagagatacaagagggcttgtttcctttctcttgtttcccacgtgagggtggagcaagaaagccattgttagcaggccgggagaatgctcgctggggtatctcattggccaatatcttgatcttggactttccaacttccaaaactgaaagaaaaaaaaaatactgttgcttaagccacctaagctatggcattgtgttatggaagtccagcctgcctggaaatagcaatgactaccatctaatccttagattccattcgagttttatgggctgtccaagtgaattccgatgactgtcctttaaggtgtaagaacttgtttctgagtgatgtgcgctgtttagtagtcatgttttattagtttctgtcagtgtaggaaagtgccacagacttttcttgagtttcttgaccctgacacttttgaagattacatgccagctgttctgcagaatgaatttaatttgggtttaattcagggatcaggttttatgccaatttggatcctagtgtctgggacagtgtctggcatagagattgtgtttcataactaattgaggaatggattatgattgaaaatatctattgtgcacctctgaatcaccaggctaatgctaagtatttcaaaactttctaaataaaaaaaatgtcaaaaatagaaaacacacaagtctaaaatcagaaaagaaaccctcaaaaacacagactctggtgtcttctcctagcagcactgggatctgttctttaatgtatatagtgagcaggcaggtgctagccactgtgtaagtgaatactagtttctttagagcagggcttctgaaagtgtggtttgtggtctgcttccaggtcacaagttgtttcagattcatgatgacataagaagagaaattggaaatgagaatttagaaatctttgagcattttgacaaaataattttgtttttgctatctaataattccaaaaccatctcacattttatctgtatttttattacactaagctgattattaatttacattgtatttttccattgtattgatccataattgagtggaaattttaaaatgtaattatttaccacagttggtggccattcttcattgctttagggggattaaagtagagtggtgtaaatgtgatctagaccatggtgggatttgacatagaccccaaagaatggataaaatccacctagaacataaagtatagagctcgacaatttatgcacaataaaatgttagaatatatgtgtatgcatatatgtgtgcatgtgtgtacttgtatgcctgtttgtatgtgtgaactttcttttatgcactgttatctgtgcacatgtactcttgtgtatgtgcacatatatcatacatgtgggtgcacatgggtgcgcatatatatgtttgcatgggcatgtgtgtgtatttgggaatgtgcatgatatgttcatagaactgggtaatcatgatcttgactagttttttagctgtccagttttggacattaaatttgaggtgcctgtagaagaagagagagggggccgggcacagtggttcacacctgtaaagccagcactttgggaggccaaggtgggtggatcacgaggtcaggagtttgtgaccagcctgaccaacatggtgaaaccccatctctactaaaaatacaaaaattagcctggcgtggtggcacatgcctgtagtcctggctactccggaggctgaggcgggacaatcgcttgaaccctggaggcgaaggttgcagtgaaccaagatcacgccattgcacttgcactccagcctgggcaacagagcaagactccatcaaaaaaaaaaaaaaaaggagtgagagaaggtcaaactggagaaatgtatgtatgtacttttgtatgtatgcatacgtaatatacagcttatgcatatatctcaagagctctgtgtgccagttctgcctgtgcagaatcatatggaggctttactttctcatttgttgctgtcacattaatttattgcgtgaacatatcatttgaaactccagtaatttgtcccatatttcaaaatgtagtatggacagagaagaatgacatagcttaaaactggttccagacgtgtaaaaacatcttgtgtctctactaccaaagcaaggaggaaaattgtgccgattaaatgcctgaacctgttttggtttcaattacctggattattgaggcagaaacaatctttgtgcctgatatatgcttataattgccttagtcttcagctttgacttgctttgggaacatgcgcatgttctattaataccattgttagaaaggagaatttatttccttttttgatggttccataaaagctttaaaatatattttacaattcagagaactaacattttataaagcctccataatggagaatagtatacggagcaaagggaaaagagttaactagtattcacttcacagtcatcatgtgatagttgagttacctcttactcctttttcacaacaaacgttagtgattcaatcttatctgtagtgacctttgagcaccttctgatttaagacatccacggaaaccaaacacactcttgaattctccatatattagggtcagtattgtgaagatcaagcctccattcaattcaagcactttcgagtgaagctcaaaatgaattagaatccataggaagagaagactcacctctctatcccccaaccacaacctcagcttttctatttagcacccaaaacctaaggacttcaactaaatggagatttttcagcacagacattattatacacttcatccataatacctacttagtatttttatttcaactcagttaatgaaaaagccagaatagtaaggtagtgcatgagtaaataatgaccatctcaaaatacctttttggaccttttttctatgaaagaagtagacaaaatttatgtaatgacactccttttccctgcacagtcagtaaaatagatgtcaagttttagtggtcagcatcacttaaatatctaaaatgtatagaatccaacatatataaacctaaattgagcaccttaaaaatcaaaaatatttaacattcctatttcataaaacatgtaggtagtctccaccatttattttgatctactaaagtgtctattaatttatgagttaaatcaaaaagcattgagcatagactacatattaggcactttagcaggctctgaagactcagtaggtataagttatattatctgtcctagagggaagtgcattattcctaacctggagtgaaagcttcaggtgtagcctctcagagaagggaatgtaaaggaaaagatttcaaaagtcaggcatttggtccaaatggataagggagctccgagcatcataacaaataataatggcacttgagaaatagcaatacgatgtgtttgaaatgtagagggcaggaggaggagggacaagataagtaggaacatgccagatcacaagagctttacatgcaataacaactttgaactaaaatttaaagacagcaaggaacaaatgaatacatttaagaatgagcatgaattgatcaaatttacattttagactgatatctggaagtgtgtgcaattgtgatagctgtgtaagttgatcaagcaagaaagataaaggaagaagagcatggtcaaagaagagaagagtgagaagatagagttgagtaggttagccaagaaatgtattttaaatatcaaattgacagtactttaccattcatgtgtggtaggttagcacagctgtaaatcttaaaactcccaaaggtttgcaagaaaaactgggtagatgaaggtgccaataaattactacaaagaacagatttgggggatagatgattagttcaattatgaacatattgagaggttggtgtgtctagggtatattcaattagttatttaagtagattgttctgaatagacaaatctggtttctttcttagagaaacttagactgtaatcattataatgatatagatggaagttaattcattgatgtaagtggattaattcagcagtatgtatatggcaggaaatgaacagagcttgaaacctggtaagccagtaaattacataaaattacaaattcaggaccaatgtgacaaaagtctcaaccataatcttaatgtcttcgaatgttaatgtgggatgatttctttaatagatgccttgtatttttaaagacaaaaatgcaacatctaggaaaaatattttttaaataaatggacgagtacccaaatcttgatctttgtcgtatttctgcaaatcttatttttcttaaatccacttttattttgacttgcaaattttcaaatcagtactgttcaaatatgagtttaaacatgaaaacatgattaaaattttctcagcactcaggatatcactccttcctaccagatttttttgtttttttataattttatagcactcaacttgcttgaagaacagccttctcaaagtgtgcagttttcagtgatctaacccggatacagcaatgttttcctgcattagctcatcggaaagaatgccaatgatataaaaataaattggagcaaaaataagttaaatatttgaccttaataacatattgctcaactcttattatgtttatgtcaccttcatatgaattatcataattgacaaataagaatgattttattttctatgctgtaaaacaaagttacagtaaggttaaataaccacagaaagaaatgcactctgagaaggtatttttttctttgagaattctacaggttttaggcagttattacatcatagaaaatatactttaggccaatattttatttaagctattgttagacttttgattagatctgtaagcattagtgaggtctctttggggtcaatattagtaaaggaaaatggagttgagtgtaacaaagatgaatcaatttcattgtctagaagtcttttaggattcattatcacttggattttattatagttcatcatcattgccatattatgcaagcaaatcaatgaacttttaacaaaaccggagataaaaacctaattacttaatttgataatagttattttctaatttatactgccaaaaaatttatatcatattttattacagaattgtcattttaaaatacatatgttgagtcatgtccaagtcataaagaaacatataaagcctctgtcttttataagtcatttttatagtcacattcaaaaactgaatttttaaaaattttacaatacaaacaaaataatatattttgagataatttgaagatcagtcataactcatgagcacatgggattggtagatcttttattaacctaaatccttacctcattccccttcaagtcctatcccccttctccctttaaggaagtattttcttgaccaaacagaacaatagctctgacgtgtgtatggccaacaaatatcaagagcatttgaacgctttcaaaagacaattaaatatgtttgttggccatttgtatatcttttgtgaattgcctattcatgtccttggcccactttttgatgggattgtttggtatttttcttgctaatttgtttgagttccatgtagattctggatattagtcctttgtcggatgtgtagattgtgaagattttctcccactctgtaagtctgtaggttatctgtttactctgctgactgttccttttgctgtgcagaagctctttagtttaattaagtcccacctatttatctttgtttttgttacatttgtatttgggttcttggtcatgaggtgtttgcctaagccaatgtctagaagggttttctgatgttatcttctagaatttttatagtttcaggtcttagatttaagtctttgatccatcttgagttgatttttgtttgaggtgagagatgatgatccagtttcattctcctacatgtgactagccaattatcccagaaccatttgttgaatagggtgtcccttccccactttatgtttttgcttgctttctcaaagatcagttggctataagtatacaaatgccaataaacatatgaaaaaaatgctcaacgtcactaatgagcagggaaatgcaaatcaaaaccacaatgcaataccaccttactcttccaagattgccagaatcaagaagtaatggatgttggcatggatgtggtgaaaaggaaacactgctacactgctagtgggaatgtaaactagtacaaccactatggaaaacagtgtggagattccttaaagagctaaaagtagaactaccatttgatccggtaatcccactactgggtatctacccagaggaaaagaagtcattatacgaaaaagatacttgcacaaacatgtttctagcagcacaacttgcaattccaaaaatatgaaaccagactaaattcccattaatcaatgaatagataaagaaattgtgatatatgtatggaatactactcagccataaaatggaacaaatcaatggcattcatagcaacctggatggaactggagactattattctaagtgaagtaactcagaaatgaaaaccaaacatcttatgttctcactctgaagtaggagctaagctatgagaatgcacaggcatgagaacgatacaatggactttggggactaagtagaaaagggtgggagggggacaagggataaaagactacaaattgagttcagtgtctattgcccaggtgatgggtgcaccaaaatctcagaaatcgccacttactcatgtaatcaagaagttactcatgtaaccaaatacaaactgttccccaaaaacctatgggaaaaaaaatttttaaaagtaacacaattaaagaaaaaacttttctaaaggaggaaattctcttctgcaagaaatttgactttatttttattaaatctcaacataatttttatttcaggttcccgtttgtcctcaaggtagtaaaaaccagccacagtcaattcaggctttctccttattttgcctgatgtctagtctaagttctggtaggggacctcaggtccattcagtcatctgtctactcagttattcaccaaggattccatgattccatcatctggttcttagtcactaattcatgattgtcatttctgagaggcttctttctcccattcctatggccgtcccaggcctacaactctcttcatgtcagtgcaagactccgtctcaaaaaaccaatcaaccaaccaaccaaacaaacaaaaactctctgatgctgttttgggctttacatacacatgcaacatgcccatatttaagttaaaggaggagattaaacaaaaattatctccctcctcttcttctaaactatcagatgttgttttcaggaggacagggcaggggtcaagagaaggtggaacagtatagttgtttgaatgaatacttaacaattatgtcatttaagacgtatttttcacgagtttcttgatgcaatatataattaagataagtgtttgcttgttttaatattgctttgatctacttttagcaagagacttttatcatatttttatggaatatgtctttaatttagtatcgaaacataaatcactccttaaattcaattactaacatataattccagctaagaatttcaggagcaaaaaaaaagtttgtatttttaatgtcaagaacacattaaaatataaatgcttttgatatcttagatttaaaataaggaatttgtgtattcatgaaaaagataaaaatttccgagaagactttgacaataagttacatgaagaaaagtaaatgttctctttaaaaattagatctttccttacatccaaatgaatcagctatctaatgtttttggttttttgtttttctatttgtgtactctacttatattattatgagaaatttgtgagatttccaaatttacctctctccaatattggaaattctcataatgtttaatgtctgctaattagatgagtatttaaagtgtgtaatttgtcattttaaactaggtttctgtcatttatgctaattaatggtaaattttaaacatgttttacaccattttctgtgatggttttctagcctcccgtctttccacttactgcctctaatccactacttccacaaagctctccttacagcacactctgactgcattgtgcagagaatatcaatgattcccagttattcacaaaacaaattcgaaatgcatggtccagatgacctgttctttacagcccagtcccaatgtcctttcttgtcacttaatttctcaactcttcctcccatgccttataactgtgtcaagctggtataattttcagtccctttccctataactttatttttcccattttactaattgaaatcctacctatggtttaatatttggcaaatatgccccaacatttatgtaaaattttgtcttagtctgttctgtgctactataacagaataccataggctgggtaatttataatgaacagaaattaattttttcacaattctggaaattctagaaagtccgagattagtgtgccagcatctggtgatgatctttttgctcatcacggtggaaggtggaaagaagagagagagagaaggagagagacaggcattttaaaaggccattgaaagcatgttcaactgttgttaagatttaatttacaaaccattagatttctttaatattttgtgttttaaaataacctcaggtctacatgtccagagcttttcagaaatgtttataaaatttggttgctgcgtcaccaaaaaatagcttaaaggtatataactttaagcatttgaacaaattaagattatttaaaataatgtatgtatggttgttctacatatatctacatttaagtttattttaaaaattatgcaaactaactttgcataaccgtaaccaaatagaagtcattaaaccctatttatttttgtagtattcttggaatacaagtgttttattcttgatgctatgctttctgttcagccaaacatatgtttgttcccaaagaaaaaaattgagaacatgataattaagatatgcactcaatttataagtaaataactgatgaaaaaatagaccaattgctttgataatcagttctgttagcttatgtttagggctgtcacttcaaaactggaaaatgaatcaaaaggtttttcttttccatctgttaatatcatctatgacatttggatacatatctatatttacatttgcatttttacatatacttatgtcttacttaatatagtatttacatttgttaatcagcaaattgtggtagtccttcttttaataaacagtggtagagtttgaatttttgaagtgtttattaatttataatagtggactaaaagaaagtatagttatttatttagattatcagaccatatgatgagttatgaggatccatatttattaatggttttgccttgtcaaatgtaagtcttgattactcttagctggaaagaagtgatgtttttattatttagcttaattcatctaaaataaagaaaatggctttctggcaagacatgacttcgcctttttgattacagcatttatttcccgagtcttcaaacacctcaatcacgcaaggttcaattccaattgagtgttcagaccacacaaatagtacaatgtttaatacttggtttaacaaaataagggcattagcactcacaattttgattctttacatattgcctaggctcgttaaggcaaaagatcaaagactcttttttaaaaaagggaaaaaagaaaacctccatgctagaaaatggggaaaagctgagtctgaaattaaatcctaagcctcataggttggcttttcaacagttcaaacctcaatttttcttcgctgtaactcccatttgaaacaaaatgaaattttccaaacctaagtactgtgttttgcaaatctttttggttttcttcataacagcatttctctttttaaacagtctatcgcctgcttttattagttttttatctctactctcttaattttactccttttctatttagtctcttttttccatcaccctttttcttcagcttctcctatgtcttcctgcttgaatctaatgattagacctccttgcgttctagtacttttgtctgcttggaatatgcatacacaaacaaaactgttcaactttctcagttccgtttctactattttcgtaatttatgaaaccacagtagatgtaatttgcgtaaacattctcaacatacaaatttcgtttcctgtaattctcggtatcaatttggagtattgtttatctatatcctcaaatttgacaaatgttgattattagaatcttttcctacttctcaaagaagcaacagtttccatctttaaattacagatttctggcgctttatctcatatcactatgaattacttttgctttatttaaaaaatttaaaaaagatattatgtagaaaatacattctggactcagggaatatagagaggtctgagagcttaagaagaatagaaactcatctggctagatggcaccaaactgcatcacttcaggccacacaatgttcattaacacttaaaggactttttttttttgtatataaattatatagccaaaaacaaagtaaaacataacccaccaaaaatattttgttttacctcttggttggcaattttggcatcaagcacacatactttaatcatagtaatacttttcttacagagacatggaggttgctcgctaaatagagcaaagcaaaacaaaacaaaacaaaacaaaacaaaaacacacctttcagaatgaacagggcattcatacagaaactgtggaggtgaagttggcacttactcatctcaaaggacattgtcttttggccaaggctgccatcctgtctgctttgacacttggaaatggcaactgagttcgtaacacaaaactgaatgttgcccttcttaatgtgaggagagaatgaaatagaacacaaaaaaaatggcattcaagaatataatcgccatggtggctcatgcctgtaatcctagtactttgggaggctgagatgggtggatcacctgaggtcaggagttcgagaccagcctggccaacatgaggaaaccctgtctctactaaaaatacaaaaattagccgggcgtggtggcatgtgcctataatcccagctactcaggagactcaggcaggagaatcacttgaacccaggaggggcggagcttgcagtgagccgagatcacaccacttcactccagcctgggagaaagagtgaaactctgtcaaaaaaaaaaaaagaaagaaagaaagaaaaaaggatataattataagaaatattgctgggagcaaaacagactcatcagactcattgctacactaagtcaatgatctgagtttcagaataaaaagagaattttaaatttagcacccagagtaatttgaaaaagtatgaagaagacatattttaaataggtgattgtagattgatgggattttcttgatttatttctgtacttgagctttttctctgcagtaaagtttataaaagataaacagtacccctgtattctatgaagaaacagataatacccccacttgaggttgtttttgaaaattattaattgaaatttaaagtgagaaaaatattaggtttctgggaataatcctacaacattgaaatgaatacataaagaaataaattggttaccacagctcacctctttattttgcacttttgtataacatacatcaaaaaccatattccattagtttccctagaccatcctatgacttctaccttttccttacatttcatattttcatatcagatctcatatttctcaacccccacttctatgtgttttgaccaatttttaagctgcatttctttacagagtactaggcatctcactattttattaatattaggcatattaataaaatgtctatcatcaatattatcaattattaatattgttaatattaactatgttaataccaatattcattatgtgcaactcttaaacatgctatatatgcataagtatttggatagacagattcgattgtaaaggaagaatggacaggataaagccatgtgtacagagtgcaatagtgaggtccagaaaagctggatatttgtctaggagagtttctaatgcatgacatattcggttggttgggataatttggcagtaatccctgtgcttttaaagtagtaactacaaaatagaagtgttgtaccttttgaatttagtatgtcacttctttaaaagtctgtaaaaattttacaagaatttcaatataagttcttttctggaaatgtaagtaacatttaaagaaatgtacagacaaaataatacactaagaattttacacacacaaaaaaaagttctaaatgtttaactctatccagtacctattattgcagtttaacaaaaattgatcacccttgaggtttgtggtactgttactcatcacagaggttgaaaaaccttaattgctagcttatttggttcaaaagaataaaaagaatcagaaagaaaataaatatttttcagaaatccaaaaataattctttagtgcagaattattaaatgttaatttattgccaagttccttgtatttattgaaatagttgtgctactttggggaaaatagcaaacattgttaagtgatgtgtagtgtttggttgccagtttctacatttttaaacaagggacaaatgtatctcttggggttagcagaaattaagctgtttacatatcttctcattgctcagaaattttgagccacacatatgtatggaaattcaaatgtttttatatataagagttttaactcctatagtaccttgtaacaaatattaacttccatagcaaaaaatattttgttatattttgcaaaccacttttattactggaaaagcaagatgaattcagaaataggtagaaatatcatgttctgttttttattgcttgtgacaatgcactataagtgatgaataatttttgagtgcttgctgtatttccacaccatttttgtcatcataaaagtgactgataattaacatagttctcttcaaatgtgttttgatataattatggaaatgtctctaaaagacataaaaggatcttgcatattaaaaagtcattcaccaggaagtgatattagagttacaggaattgacaggaggtggagccgaatgatagtggcaataatgagcgagtgcctcatggaagcatcagggttacagtattgaagattatgtagaactttattagagagacgagggtaaaagtggagggcactttgtatgaaggcaagctcatgaatgaaagaatgcagttttcaatgatacagcagtgagaaggtaaccctgaagtatttcttggtatgttccagtaaaaataaataaataaataaatcagatgagtattatggaaacagcttatgtatggctttgacatctagatagaatagttttatgtttgatgttgtctgaaatagggcaccataatcgatttttaagcagagttacaatataatgaaagcagcatttaatatggattattccagaagtgacaggcaatatataggtgacagttggagggtggagagagaatctggaggcagctcaagctttgaaagtccacaggaaacatttccaggaatgcaggtgtgaagtgaatgataagcttttagcttttggtggtggcaattagaacactgaaaaggagaggatacctgaggcatttaatttataataacactgtatatctatattttaatcttataactacccttatatgtttggtgttacagttgtcagttttgttccatgggcaaaataggttaccattaatgcattccttatctttctgttaaaggcattatttaaaaatccacattgtcctgcttatgcaaagatagtactacatagtactatccactattataatccactgagagcatgtactttgaattattttccaacagttgcagaaaaatttgctgaaacagacacatgctctctcagtccatcctcattataaacaatagctggtacttttgagattcttagtaagaattggtgaaccatttgatggcttgggactgaaagctctgtatccatcatatagaagaaggcagctgatacataatggttgccatcttccaatagtgttattaatgccatctactaagcaactgaaccaatctactatgtatagtatggaaggtaagctagctgccagaagatggcagaaaggtaaactaacagaatttgtctttgagttctgtgttgatgaacacttttgaacttctcactaattctgtagattgtcagaatacgaggtccaaattaaacttatagcaaatttgatgaagacatagagttgattctgatatgaatcttacgaatgataaaggagtacattttatatatttagagtattgattcatactaattaattggaatgccatttaggggtcatttatgatgttatggggttcagcaatacaagcatgagaattccttctattaaatagaaaatttatttcctgctctttggaagggtgaggcccattttgtaattggagtgtgaatgttgtaaacaatatttgctattgtttgattgcttttagagctgtatcaaagagccttaaccattgtgtgttattttttgctttatagcctctaacctaagcgtcaatatatattgttttcacgtattgtattgattgtatcaatgtcacgtaattttgtcagcaacagcctagtcaattccatctgtcctgttttgatgactgatttccttatgtcaataaattgacaactaagttatccaaatgagcaatctaaaaaagattgcttttaatatgctttcttccccttggacatttagacaactttataccaagtctctgtgcatccattattagtatattctggccagctaagcctctctgaaaagcatgatttttacataatacatctttatttgttatattgctgtaatcaaattatctctatgttgttgatcagggaggaattctagacatataagtaaaatattgtgtgaattttattgaatgaagcaattagggctctttgaccttctggttgcaacttctattttagaaagacattagaaacccacatttgaaaatgtctaggaattttctcttggcaatatagtgctttcatttttaaaggcggagaagaaaacttcactttctgggttgtacttgtctacagaaaaattgtactggagctttagtatgatcctgacaagtagtttaatcatccctggctgtaaaatacctaacaaagcttgagggggaagataagacttaaattttatagagagttcattgttttgggtacaatttgtctattattttcctgcagatatgatgataattataacatagtcattaaagcggaggttacttacctaaagaacaaaacaatacttctttgttaatgatgaagagaaagttgtaagtaatttagaggtgaacataaagatggaagaagtgaagctgtgccgggatcctggggatgagggagaagacatcacaggcttctgtaacactcaaaataacaaatgatgcataaatagtacagcaatatttaataagcattttgatatctttgatgaccacttcagaaaatgaacattattgaacaaagtataaagcatatttaaaatattgaatcaaatgacaaggaccaagaattgacagtaccagattatacatactaaaaagaaaacaaaaaattaagtaattatttgagagaaaaagtctcaaaatggatgtatctttaaaaaactacactgaattaatagaagttggtatagattcaaaccaggaactggaaattctttttaatttatttttttgttttatatttttttgagacagagtcccactctgtcactcaggctggagtacagtggcacaatctctgctcattgtgacctttgcctcctgggttcaagcgattctcatgcctcagcctcctgagtaactgggactacaggcgtacgccaccacgcccagctaatttttgtgtctttagtagagagaggatttcaccatgttgcccaggctagtctcgaactcctggcctcaagtggtctgcctgcctcagcctcctaaagtgctgggattacaggcatgagccactacacctgggggaaattctcaccctaaacatgagcacaaagtttatctgataattgctcatataaataatctacttccatgcaaaaagtttagatcagtgtgagaaactatatttaaatttcacaagttagaaattttaaatacaatttattatattttaattataatgtacttatttataatttaattttcattcagagaatatcataaaaaaacttgtatgtgtttcttaagctcaaagggcacaaaatcttattattttgtaatcaaagaacaaaataggaaaaacaaaacaatgtatatgagtacaaggcatttttcaccttcaatttaatgcttataatgtagtccaggtcttcaaagtagcctaagcaccatggtgcaaccacttaatatattttgatttatgtttatttgtttctacaaatcacacgatgtgtagatgagtattctcaggacactgtgtcagtagtaatttgtattggaaaaattattttgctagatttattaacatttactacatttttttcaagaaattgttcattttgtcataaaagaatttttccatcagtctataatatcaagaagaaagaatgcaaaaacagaaataaaaaggtgcatggtgagtgaatgaacaaactgtagagtgtaagatttttaggaagaaattaaggaactgattcataaataaaagaaaatggtaatgaaaacaaagtgaattgattgcaaacatgctgttgatataaccatagaatactggatatccatgggagagcttataaatgctactggacatttgtacacaactgtgtgtatatgtgtctgtgtgtgtgtctgtgtgtgtgtgtgatgaggagtggggggagaaaggatgcatcattgtattttttattctaggtttgttttttatttgtatgtagttaccacaatgatattcaaattttaggggaaaatgagaatttttttacttctgcaaatatatttaatacaacccatccaaatttattctaaatacattttgatacaatttgtcaacctataattcttcaagaagtggaatcagcagttggtaataattgcacatctgtggttaattagctcagttggttgaatcatggagctaatgaggccaaagcctgggtttgatctctgcgtgggctggtgagttttgctctattcctgggtcgtagactgcagttcaaacccaggccaagtatctcatggatgcatgccactgaccataagaaactgggcaagagaaagtaacttcaacaggtccggaacacatcttcaaactatatacagcatctgcttgttaatgtatgaagagaagcattagttatgaactcagtactctcacaaaaagacacacaggaaactttctgtggcctcaaatgaaacattgaggaataagtaatattaggaattacctaacgagcacatgggaaatagctaattcataaccacaaatagaatctatttcaaatggcaagggaagcaaaatccctgtcattcccacacattgatttttccttggtagattgtaaaggtctttaaggtgttggatgaagagttctgaatcagctgtgaaataagacaaaagagggaggagagaaagcagatggaaagccaaaatgtcacattcgttttagataaagactagaggatgtagtttagacccacaggtaagtgggctccttaacactaacctcagaattagagacatttcccaccaacatagagtaagaaaacacaggtctccccagtgcgaccagcctcactttgtggcctgataacgctttttgtaggaaggtcatccccaaggagaaaaagggaagagaaagggagtgttgtcatatatggacagatcgtttttcttacaaacatataaatcagattgggccactggttaacactgagtgagagaaggagagaggcctggattgttccatatgaaaaaaaaaatcaagagtggaaaataattcctgccacctccatcttcaactatatattttatttttaaattggataaatggccagtgtaagatgaaaaccaagaaaaatgccagaaactgagacttagactgtatgtccattgtggtagatagaaacttgtgaacttactaagaatcaatgtatctctgttgcagtgtgatggtctttcctcatggtctcccaaatttctaagggtagttggttcccagtatgtctgccacattgtgatcacaaatatcatgatcatgaagaaatgctttgtttggaaatgcctacaaataatgatggaagggcccaattgaaagtaaatattttgctgaaattatccatttaccaattcattatcattaacaatgaactcaacataacattagtctaatgagatagctcatttttttttttaaaagttatgtgtcgaatatatcctttaaacatgtcagatatattccctttagggattcacaatgcacttcgtctctttaatgtttgactttatcacaatgtttttcatactttggtaagtaatcccatctaactgctgtttgataatttaagtttgggaaacactaatcaaaaccataatgtgagcaagttctttgtagtaatattttatgatgtttagtttactaataattatgaatagataatttatctttcaatgatgtttgcttttaaaaaagctataaattcatggcatagtaagttgaaataacattttagttgtagaaatgataattaacagctttttgtagatgctgttttgtattttttttactctgttatggtctatagagaaagactcttggagtgcatttgcattgctgccattgtgattttctttttttattattatgctttaaggtctagggtacatgtgcacaacgtgcaggtttgttacataggcatacatgtgccatgttggtttgctgcacccatcaacttgtcatttacattaggtatttctcctaatgctatccctcccccagcaccccctgcaacaggccacagtgtgtgatgttgcctgccccgtgtccaagtgttctcattgttcacttcccacctatgagtgagaacatgcggtgtttggttttctgtccttgtgatagtttgctgagaatgatggtttccagcttcatctatgtccttgcaaaggacatgaactcatccttttttatggctgcatagtattccatggtgtatatgtgccacattttctttatctggtctatcattgatgaacattgggctggttccaagactttgctgtgaatagtaccacagtaaacctacgtgtgcatgtgtctttatagtagaatgatttataatcttttgggtatatactcagtaatgggattgctgggtcaaatggtatttctagttctagatccttgaggaatcaccacactgtcttccacaatggttgaactagtttacactcccaccaagtgtaaaagggttcatttttctccacatcctctccatcatctgttgtttcctgactttttaatgattgccattctaaatggcatgagatggtatcttattttggttttgatttgcatttctctgatgaccagtgatgatgagcattttttcatgtgtattttggctgcacaaatgtctttttttgagaagtgtgtgttcatatcctttggctactttttgatggggttgtttgtttttatcttgtaaatttctttaagttcttagtagattctttaagaatcctacatgttatttgtggcttacaaaaaactttaaccttagcttatatagagatattgattgagtttagatctcaacctcaagattccattgaaagtggttatacagacatctaagttcatttattcctctttaataatacatacagtcctattattatttatacagttaatttatcttcggggaagtcgtcaacaaaatgacatcacaaaaattaatcaattacattcaaatggaataaaatgtaatcatggagattccaaattatattaaaaacatctgtatacaaaatactgtttaaaattaggccttttgttgcaaaaaaagaatttttaatttgtcgcccaggctggagtgcagtggcaggatcttgactcactgcaacctccacctccctggctcaggcaatccttctaacctaggcctcctgagtagctgggactacaggtgtgtgtcaccatgcccaaccaacatttttggatttttggtagagacagggttttaccatgttgcccaggctgggaaaataattccttttttaaaaaagccatcttttggtatgtttgtttattatgattctacttaaattctcactgaattcttttccagaagttattgcaaaacagaactctgaacattcttcctgttcttttctgcacaagcaaacagtccatccagataatccggatttcgccaaactcaaactttacttttacttattgtcagtgaattttactcccctcttaaaaatctagtgatctaaaccagactaaaaaaaaagtgttctataaaattatacagggaaaatcattttatattgtatgcctcctcttatcttcatcaccctcataggggcaggcaggctggagcgagagagaaatagaggaagagataaaggaagaaaaatgcaatagaatgtatgttttccctgaaaagcacactcagtgaacaaaattagcccttgggttgcacggaccctgggttttacatcatggctattgtttattacttggaagtaagtattatttcagtttattgatttgtaaaagagaataatagcatctaccctgctaaactttcaaagatattaactgacataatatatgtagcatcatataaatgtacagtcatgtaatatgtgcatatagatgtacaataatgtacatgatataaatgtataatggtagcatcatcgccctttttaagaaatgatgctgagaaatttttctagatagctttctgtttataaatattttcaatgtaggtataaagtcctgaggtgtaaaaaaatgactgtgatggctaatatttaatttttagtatgtgctagacatgttctgactcttttagatgaatatatttttatttaattatttcaatgacccaattaggtaattatttccttttattcttattgcaaaggagaggaaagtgaacacacgttgactaaatggcttaccccaggttacaatgcaaaaaggggttcaggttatctcgtctacccttagttttgacaggcaatctcttctatagaatcctttcacacaatgttccagcctcttgtgaaatttattccggtaaatgaggcagggcatgctagtatgctcatttttctgtgcagactcccttccacagtaactccatagatttaaaacaaacttttgtccttttttttttttcaacttttattttagatccaggggtaacatgtacaggtttgttacctggctgtattgcataatgctgaggtttggggccaaatgatcccatcactcaggtactgagcctcgtacccaatagctagttttacagccattgacctcctcccttcctcccacctttagagtcccaagtgtctatcattgccatctttatgtccatgcgtaccgaatatttagctcccacttataagtgaaaacatgtgatatttggttttctatttggcaaaaaattaacttgggacagtgtcctccagctgcatccatgttgctgcaaaggataggatctcattgttttttacggctgcatagtagtccatgtaccacattttctttatgcagtcctctgttgttgggcccgtaggtagattccatgtctttgctattgtgaatagtgctctgatgaacatgccagtgcatgtgtctttttcatagaatgctttgttttcttttggctatatagccagtaatgggatcgctgggtagaatgatagtccaggttctttgagaaattaccagactgctttccacagtggctgaactcatttacattcccatgaccagtgtgtaagtgttcccttttcccgcagtcttagcagcatctgttgtttcttacttttagacaatagccattctgactggcctgagacagtacctcattgtggttttaatttgcatttctgtgatgattagtgatgtggaacattttttcatatatttcttggccacttgtatgtctttcaagatgtgtctgttcatgttttttgcctactttttaatagcttttttaattattcaattgtataagttccatatagatcctggatatcaggcctttgtttgatgcataatttgtaaatgttttctcccattctgtaggttgtctgtttcctctgttgatagtttcttttgctgtgcagaagctctttaggtcccactttgtcaatttttgtttatgttgtgattgcttctgagaacttagtcataaatttttttcccaaggccaatgtccaaatggtgtcgcctaggttttcttctagcattcttatagtttgaagtcttaacatttacatttttatttcatcttgagttaaatttttgtatatggtgaaaagtaaaggtccagttttattctgctgcatatggctagccagcatcaagaataggaagtcctttctcccttgcttacttttcaaatcaattttgttgaatatcagataggctgtaggtgtgccactttatttttggggtcttgattctgttccattgatctttgtgtctatttttctactaggaccatgttgtttggttactatagccttatagtataaagtcaggtcattgtgatgcctccagatttgttcattttgcttaggattgctttgcctatttaggctcttttatggttccatgtgaattttagaatagttttttcaaatcctgtgaaaaatgacattggtagtttaataggaatatctctgaatctgtagattgctttgggcagtctggccattttaacgatactgatgctttcaatccatgagcctggagtgtttttccatttctttgtcttttagtagtgttttgtagttctccttgtagagatctttcacactctgggttagatgtattcggaaatattttattttttgtgtgactattgtaaatgggattgcatttttaatttggctctcagcttgagctttattgatgtatagaaattctactggtttttatacatttattttttatcttgaaactctatttaagttatttatcagttccaggagtcttttggtggcctctatggttttctactagttataatggaaataactatgattattaaaataatcactactataataattatgattctaataaagaatcatatcatatatgaagagagatagcttgacttattttcctatttggctgccttttatttctttctcttgtttgattgctttggctagcacttccagttgtatgttgaataggagtggtgagagcgggcatcattgttttgttctacttctcaaagggaatgcttccagtttttgcccattcagtatgatgttggttgtgagtttgtcataggtagcttctattattttgaggtatgttctttcagtgtctagcttcttgagggtttttatcatgaaaggattttggattttatcaaaagctttgaagaagcattttgttgaattaagttgatacttattttttacttattactaacaagcataaatacctgaaactgtagaataaaacacttctacaatatatcacttctattgaaaaaaggaatttcagtaataatttggacaaatgatagtgaagggagtaggaggggatatttctaaaaaaaattctgatacatcacaacaagactttataagtgtaaaattagatgctgcttattatgtacatggagaaaggcattttgtagtgtagtctgagcaataaccttttgaaatgaaacatattaatcatgcttgctcaacatatgtaagaaatctttgtaaacacatatgcacgtgttatcatttcagaagctcaggctaaatagttaaatagatccattctccacatcctagataaatttctgggtaaataaactatcatctagatttatctagttacatttttagataaatttatctggatacatttttagataaatttatctagatacatttttagataaatttatctggatacatttttaggtaaatttatctagatacatttttaggtaaatttatctagataagtttctggataaactatcatctttatcaaattcacatatctgtagttaaacactatgatcacagatccattgtctgtaaagtaaataatgcaaatgaaattcagaagtcaattctgaccccagctctactatagacaaagttgtttccaaaaacaagtttgatttcaagttgttggattgaaaaaaacaaaaaacaaaaaagtatatactctgcatatctagatattacttttagctttgctaatctagttctcttttctatcttaaaataacaaatagaaagatagtcttctttttaaattgaaaacataatataaaaagttgtaattgtttaactgtatacatacacacatatatacatatagacatgcacaaatacatttatgtacacacattcttcccttttcatatcactttccatttttatttttctttaaaagcattttttgagacatggctatcactgtatcacccagtctttaatcaaactcatgggttcaagtgatcctcccacctcagcctcccaagtagctggaactgcaaggatgtaccactatgcctggctccattttcaagtaataaggaaacacagatttgaccaagtagtgctgggatttgttcattagaaatccatttcaaaaatattttgaaaacatggtcaagacacataatgcacctgatagcgtacttgaattattctatcaaaaatatgcaaataataaatttattgatgtatatacattacacctagctttgtgttttctcctttctatcttctgcccaaagtgggatatgttactgcctatgagccaccatagagcaaacactagagtgactgcttactttttttgtagccttctagatattacatcattggaatgtcagacaaagccttgaaattcatactccatcaagtatgtgatttttgtaatactttaggaacagaataaattttaaaatatttcacaggattgtgaaatttttacccaccagtgtctaggtgtacatgaaactcttcagattttgttttcaccccttctcacccaacctcctttttacaactgctctcagttatgaccagcactttacacttttaaaagtacacatgacttaactgtcataagccatcagaggaaaaacatttggccttatgttaaagaactttttcacatgttttatcatttctacaagattttaagctttttgaagacatggaactatttctcgtgtagcactttacacatatgcagtactcattttttattaaatattaaaggagtgaaagccatcttcacactattctatgattggattatctgtatgttttttctgggccactgaagattaagttgaataaacgaggagctggcacaaaccctgacagatagtagaaagttgacatcctaacagagacaaagaaagaagtataaatgaagataatgaaactcaaaatataaataaaaaataaatataacataatataataaagaatataaaatataaagacgatgtagattaggggtaaataaattctattttttaaaaactgtatggaccttctactttgggcagtaggctacatagacattgaatattacagcaatttaaaggatcatattcttttttgtgaaagactatcttgttccattaaggagatgggacactctgttcaatcaaagtgcaaaatcaaagcctataatcatgacacctagaaaactaaatttacctagaaagctaaaattatgataatgttttctgttttgtaactccaaatatgcaatagtttctaaatatatataatatatatatttagatacatatatttagataaaataatatataatatatttaaaaacatattttttattttaaaaattattttaaatagtctttggttaagttaatttctaggtatttctttggttagtttctacatactgaattttatgtgtggcttttgtaaatggaattttttaaatttcattttcaggttgtttactgttcgcgtatagaaatgctactggtttttgtgtattgattttgtatcctgcgattttactgaatcagtttatgtacaaatcacatacattcttttttttctttttagttacacaggtattttgtaaaatgaagttattcttcacaaacataatatgaatgaaattatccttgcattactctaaaaatgaatgttatagataaacaaaaatcaatgttttcacccatattagtatggtaatctagaaaagtttgtatgcagaacatggacagtaaactccttctatagtccatgagatgattgcaagtataaatcttacgagatttccatttggttctcctggagataagggatgcttaaaaactgacgtattcagtccagtggccattaatatggggataatctggaatattccattgtggatctggaacaaatttaacacaattcactacagacggcagtgtatgaataatccatgtgttttgctaattctgcctgctcttggttcagtgacatgctttttaaggagaatctgtcattacacatgcagaagacattcaggcctgggggatatcactactccagcataacctcaagttagtggggagattaaagtctgaagtcaaaattatttcatctgaagtcaaaattgttataaaattgaaaacacatacttgagggtaaagtgaggtcatagagtgacttttcaaaagcagaatatactctctataactgagaaaagacagaggaagagtgcctggtgggctgtggtaaacagaaaaccgaggtgcagctccttttgtgcactcagacaccatactgggttgttcactggattcactctacctttctaggatggcattaattaattattattcatttttcattcttcaaaacacccacatttgcacctagatattgcttgagcatattcatttgactgtggagaaacatacttatcaaataatccagttgcaataagggaataatgaacaggtattttcagttctgggggtcatgccctacccagcagtactcccaattaatggttcaaatatgggattggctcttcactgggcagctctggctcaagcttcacttctttccaaaggcttttccacttacttgaggtgatgcaattgatgatgtcatatgtacatttgatattgaatcaagaaagccctgatgatgcctcccattaaatagaaagaaatgtcttgaatatttatgattttgttatttaagtctgaataaaacctttcatttgctaaatggttgttcttatagcccatcctttcctttaaatctgaaattagttaatacataaaatataactcctaagtggtcaagaaagatgccagacttcctagactgctatacttaacatgcaaacctcacttggcatgtaaaccagaaaatgaaatattgtgaatggttaccgtaaatgtcttcttaaacgaagtccaattaataaaacaactaatagttttactggtctgcaacatctttgactacccaaatttattcattttaaacttgacgtgatttatcatttttaactcaatacagcactaggacctctttaaaatttcatagaaagaaaggatttatgacatatatttaaaatttattggctaattttttttaaaaatttcaaatcaatttatttcaggccattgtaatctggtttatatggtcccagagggatgactgtggaaacccaaattcttagaccagtcaaaaccccactgaatctgccagacaaagattgaatgaagacctgaaggccaaatctctagatctgagaagacaaaatatctaaaagcagcagaagaggcattatacaaaattacttagaaaaagcccttatattaaaaattacatattattcagtttctctgttttggaaaattaaaaattaaatgtacaatttttatatttattacaaaagtaagggttaaaaccctaaaccacttaaaacaccagttttaccacacacttaaacacagaactcttccccaatgcgtgatgggtagcattatactagcaaagataaccgtactttatgaacttcatacttgtgtaagttgattagggaaactatttttagagttatcaatcgaatcaattcacataaattgcttggcacaatatctgtactttagaggtgcttaaaactattattatttttctatttgtgtgtgtgtgtgtgtgtgtgtgtgtgtgtgtgtgtgtgttttttgagatggagtcttgctctgtcgcccaggctgaagtgcagtggcatgatctccgctcactgcaagctccgcctcctgggttcacgccattctcctgcctcagcctcccaggtagctgggactacaggtgcccgccaccacgcccagctaattttttgtatttttagtagagacggggtttcaccgtgttagccaggatggtctcgatctcctgacctcgtgatccgcctgtctcggcctcccaaggtgctgggattacaggtgtgagccaccacgcctggccctatttgtgtttattaactaaaatgttttaactataacttttaagtgtgttaatacatattgactcatgtcagtaatgataaaacctcatttcactttttggttggtgttttaagaacttatgtttatttaaaattcatcattccactatgcagccatcaaaaggaatgagatcatgtcctttgcaggggcatggatgaagccattatcctcagcatatatacattattacctcaaaatatacattattacctactatcattacctgcatttaggccttgcttttaaatttctctttgtgatcgacatggttttctttctttctgacaaattaatttcaatatccttattattgtcatcaactactttaccctcctgctttgcatgccatctctgcccctccatccatccctgtcaagtgccacctacaaccacagcacaccataccacagtgtttcttataggcttttttatttttttctgttgcctaggctggagtgcagtggcaccgtctcaggtcacttcaacctccgcctcctgggctcaagcgagtctcccgcctcagcctcctgagtacctggaattgcaggtgcccatcaccatgctcagctaatttttgtatttttagtagagacgaggtttcaccatgtaggccaggctggtctcgaactcccaacctcaagtgatctacctgcctcagcctcccaaagtactgggattacaggtgtgagccactatgccctgcttcttatagccttttttattaatctattttttcccaacttcttggtctaaataaatctgaatttttcaactagtttgcctcatgcaattttctcctctattgattctcaaggcatgaatcatcaaagcggtcttgtcaaaaggaaacattatttttttactaaaattatgaagaaattgaagcaaatgtgatttcaaagacctaactttatccaattttctacttttttccaagctctacattttcacagtaaaacttctgttttatcttttaacaacatgataaagaaaaacacagatggaagaacattgagggggaattcctaaatgggagcagttagcagctatgaaaatgtagatattcaagaagaaaagaaaaagtaagcaaaactgaatcatgagaccatagaagagtcaaaaaaatgtcaatttatctcagctttctgcaaactacaacccatgggccaaattcaaggtctgtttttgtacaatctacacattaagaatggtttttacaatgatacgtgttagaaaaatgtttagaaagtcatattttatgatgtgaaaattgataaaatgttgttgtccataaataaagttttattggaacaccatcacactttcatttatgtattttctatgactgtttttatgctgtaacagcagaattaagcagttgcgacagagatcatatgacatgcagcatgtaaaacatgtattatctagcccttcatagagaagtttgctgtctccagatttagaacattcccctaagttaattttcccagctgattacatcactgtttattgagtatcagctctggaatttcaagttcaaataaaccaaggagtaccttcagattttttcattagagtttttctttacagtaacacaaggtgggagcaaataaccagtaagagcagttaccttcgtgtatctgtcattttacaaaaaattaactgttcattttgggataactgtagacttatgcagttgtaagaaataaaacagagttaggttaatctttatccagtttctccagtgctaaaatcttgaaaactgtagtacaattggaaaacaacgaaacagttgtacaaaacagtacaactgaaaacaatattatagcccagatgttaacattgatatagacaagatacagaatgtttccattactattagaatcccttgtgttgcccttctatagatacacctgcttctctctcaatcccatctctgccttcactccttagcaacttacctgttttccatttctataattttaacatttcaggagtatgaaaatgtaatcacagaatgtgatctttggggattggcctttttcactcagcataattctcttgaaatcaaccacattgctgagtttatcaatagtttgcttcttattgagtagtattccagggtatgaatatactacattttaaccactcatcagctgaaatacatcaaggtggtttccagtttggggctattgtgaataaagcttcatgtatagatttttcatgtaaatagaaatttttattttgggggaatacattcccatgagtcaaattgctggaccatatgttaagtgtttgtttcatttttaaaataatttggcaaacaatccccagagtggctgtatcattttacgcttttgttagtaatatatgaatgatccaatatactcacctacatttggtgttgccactactgttttgtttgtttatgttagaccttctaacaggtatgtggtgatatctcattgtggttttaatttgcatttccctaatgtgcttgtttgtcatccatatagcctcttgggtagaatgtgtcttatatgttttgcccatttgccatttagactgtttgattttttgactgttgagttgtgagaagtctttatgttttctagatactggtcctttttcagatagatggtttgaaaagatattcttccaatctgtggcttgtcttttcattctcttaatggaattgttgggtaggaagtgtaatttctcctcgacgctcataaattcatagttcaaacagacttcagtagcaaaagacaaacaagagaaaaacaatcaagtttattaatatgcacagtgcctatcactcgggagaaacttcaatgaaaggtaacacaagggagtggcttagaaatctggtttatatagaatcttcgacaaacaacaatgtattttagagaaatgacatgacaaagaaaagcagttttaggcttccagaggcaggaagctgtgggaagttaaatatatagaaaaaaactaatggagtaagatttgtttgtagattcctctggtgccatctctcagctgataagagttgtttccagaaaggatttataccttctccttacatggaaaagggtgaggatagacagagctcttcctttgttggctgtttcgtgattgcctttagctcaacaatatttgtgtcacagaggcacattttggggtgacatctctggtttccttcagagtattttatggagcaaaagtgtttaattttgatgaatcaacttaccaatttttctttatgtatagtgattttgttatgaattccagtaactctttgcctagttccaggtcctaaagatcttgttttgttattttctaaaagttttatagttcaatgttttacatttaggcctgtgatccattttgagttaatttgtatgtaagatgtgttatgtagatcaaaattctccctctcttccccttcactcccctcctctctttatttgtctctctctcttcctctctctctctctgtctctcctgtggctgtccaattgctgtgacaccatttgctgaaatgactatcttttttctattgaattggttttgggtcagtcatggctgtaatcccagtactttgggaggccgaggcgggtggatcatttgaggccaggagttcgagaccagccaggccaacatggcaaaaccccgtctctactaaaaatacaaaaagttagccaggcatggtggcacacgcctgtaatctcagctactcgggaggctgaggcaggagaatagcttgaacttgggaagtggaggttgcagtgaaccaagatcgtgccattgcactccagcctgggtgacagagcaagactccgtatcaaaaaaaaaaaaaatggttttgtatctttgtcaaaaatcagttgtttcttgggcatgtatatacgagcctcgttctaggttccctgttctattccgttgattggtgtgtctgtctctctgccaatactgccacacagtcttgattagagtcacacagtaacctactactatttttattattactaatttattttacatatattattaggtctaatgttagtatattatactagttaaaaatcagtctttacatcaaatagactaattcctgctgctatatattttttcccaaaattgtttcagttattctagttccattacatttccaaatacatttggaatacttttatctatatctataataaatcttgctggggttttggtcagaattgaattaaacgtgtatatcaatttggagagaactaacatctttgttgagacttgcaatccatgaacataacaatatctctctccagatctcttaggtttcttatcagcattttgcagttttcatcacacaagtcctgtacatgttcttttatctacacctaaccagttcatttttttagcaattctagataatattgtgtttttatcttcttggcttattgctgatcttagggagaaagcatttagttttttaccattaagtataatgttaattataggattttttttgtaaaagatctttatcgagttgagaaagttcacctgtgttcctagtggtctgagaatttttagtcatgaatgggtgctgaattttgtcaagcgcttttttttaatttttgctttgattgatattattatgtgatgtttcttttttagcctgttgatgtggtgaattgtactgattgatatttgaatattaaactggctttgcatccctagaatatacctcaccaggtcactgtgtactaggttggtgcaaaagtgcttgccattttggaccatgaattttgaatcattaaaactaggctcaaacacatctgtattaatcaaagtaagaaccattacaatcaacacaattttgccaacaagaaataagtttgtttactcctgtagcataaaaatccgtgctttgagattcgaggaacttttggaaagcactttctgcatcctgctggttgtggaagcgttttccctgcaaaaagttgtcaagatgcttgaagaagtggtagtcggttggtgagaggtcaggtgaatatggtggataaggcaaaacttcatagcccaattagttcaacttttgaagcgttggttgtgcaacatgcagtcaggcattattgtggagaataactcggccctttctgttgactaatgccagctgcagggattacagttttcagtgcatcctatcgatttgctgagcaaacttctcagctataatggtttcaccaggaatcagaaagctgtagtggatcagaccggcagcagaccaccaaacagtgaccatgacctattttgggtgcaagtttggcttggggaattgctttggagcttcttctcagtccaaccctgagctggtcatcacaggttgttgtataaaatccacttttcgtcacacgtcacaatctgatcaagaaatggctcattgatgttgtgtaaaataagtgaagatgacactccaaaacgacgatttctttgattttcactcagctcatgagacacccacttatcgagattttcacctttccaatttgcttcaaatgccaaaagaccatagaatggtcgacgtcgagttctttggcaacttctcatatagttgtaagaggatcagcttctcaattggtcattgttaactcccaatggccagccaatatgctcctcatcttcaaggctcttgtctcctgtgcaaaacttcttgaacatgactgtactgtaggcttattagcagttcctgggccaaatgtattgttgtcgttgatgtattacccattttgaactcaaataagaaaattgcttgaatttgcttgttgattaatgttatttccatagtctaaaataaatgtaaaataaacagcaagtaataagtcattagtaaaaaacataaagtgagaaatgcccattaaaatgatgtataacataaccacatttatttaagaatgtatttcttttttttttttttctttttttttgagacagagtcttgctctgtcgcccagggtggagtgcggtggcgcgatctcggctcactgcaaactccgcctcctaggttcacgccattctcctgcctcagcctcccaagtagctgggactacaggtgcccaccaccacgcccagctaattttttgtatttttttttttttagtagagacggggtttcaccatgttggccaggatggtctcgatctccagacctcgtgatctgcccacctcggccagccaaagtactgggattacaggcgtgagccaccaagcccggccaagaatgtatttcaatacaaatggcaaattccaaccatgtactcacctaatataattcttttttatatattgatgaattttatttgctaatattttgttaagaaattttgtgtccatatagattcctcctcttacactgtcttgtctgatttaagtatcgcaataatgtcaacttcataaaataaattgtgaaacgttccctcttccctattttctcaaaaagtttatgtagaattggtgataaaactttcaataatggccagatgcagtggctcatgcctgtaatcccagcactttgggatgccgaggcaggtggatcacctgaagtcaggagttcgagaccagcctcgcccacatagtgaaaccccatcgatactaaaaatacaaaaattagctgggtgtggtggcgggcgcctataatcccagctactaggcaggttgaggcagaagtattgcttgaacctaggaggcagagtttgcagtgagccaagattgcaccattgcactccagcctgggcaacaagagcgaaactccatctcaaaaaaaaaaaaaaaaaaaaaaaacctttcaatatttgttacaattatccagctaaattatctaggcctggagatttctttttgagagagttgttaaattacatattcaatctctttctttctttctttttttaaaatagagacagggtcttgctttgtcacccaggctggagtgtagtggcatggtcatagcccactgcagcctcaaactctggggccaaagccatcctcccacctcagcctcctaattaggtaggattacaggtgtgcatcaccacaactagctaatttttaaattttttcgtagagatggtgtctcactatgttgcccagcctggtctcaaactcctggcctcaagtgatcctcctgccttagcctcccaaagcactgggatcacagacatgagccaccatgcctggccttcagttttcttaatagttataggactcatttcattatagggatcagtcaagtgatctaattcatgttgagtgagttgtggtaatatgtgtttttaaataattggttcatttcatctaagatattcaatttatgtgtttagtgtagtttgcagtgttcccttattatgttttgctgtgtgatatgccctgtttcatttctgatattgataatttgtatattcttatttctcagtcttgctgaggggatgccgattttattaatcttttcaaatacgcatgttgttcatcgatttctccctgttgtgctgttttcatttttgcgtacttgtgctcttattttctttctcttctgctttaggctgattttgctcttcttactcttgttttttgatattagacctttgattatagatttgagacttttcctcttttctagtttatacatttattgctattacttttgctgtgagcactgctgtagctgtgtcccacaaattttgatatgtggtattttcattttcattcactccaatttctttttctttcacttgagacttcctctttgactcattaattatttaggagtgtgttaattagtttccaagtgtttggagattttcctgttatctttctgttattgattgctattttgatcatattgtggtctgaaaacactttctgtatgatttcagttatttttaatttgttgagatgtgctttacgtgctatataatgtgacctatcttggaatatgtttgtttgtgggcacttgaaaataatgtgtatacttctgtggttgggtggtatggttaataaatgtcaactagattctgttgatgaatgatttgttggattctatatccttgataattatctgtttaattgttctgcccattattgggagatgtgtgtcaaagtatacaactataaatgtgaacttgtcggccgggagcggtggctcacccctgtaatcccagcactttgggaggccaaggcggggggatcacgaggtcaggagttggagaccagcctgaccaacatggtgaaaccccgtctctactaaaaatacaaaaattagccaggtgtagtggcatgcacctgtaatcccagctactcaggaggctgaggcaggagtattgcttgaacctgggaggcagaggttgcagtgagccgagattgcaccactgcgctccagcctgggtgacagtgagactccatctcaaaaataaaaataaaaataaaaataaaaaaataaaaataaatgaaggtgaacttgtctgtttctcttttctgtttcatactctacatattgagcagctttgttttggtgcatacacattcagggatgctatgtcttcttgctggattgtttcttttatcattgtgtgatgtctacctgtgtctctggtaattttctgtccttggaagtctattttatttgatattattaaagacacttctgttttctaatgtttgactaatatgcttactttaatcattttactttcaacctgtttatattgttatatttaaattttcattgtagacagcatataattgggccatggtttttaaatccactgtgcaaatctctgccatttcattggtatattcaaacaattcacatttacttcaataatttatttatatgatttaagcctgccatttgaatagttcttttttgtttgttctttctgttttttatttctctgagttttttctcctgcctttttgtggtttacttaaacaaattttaacatttttagaattttgacatatctagaatttttttttactaaatttcgttatgtaattttttagtggctgctttatgtattatgttacatatacataacttatcacagtctactagtatcctcattttaccatttcaagcagttaaaaaatcttacctacttttgtaccttcactcttacccatttataatataattaattgtcttagatatttcctccacatgcgtttagcactataccagacagtgctctatttatgtttccacaatcaaacataatttagaaaactccagaaaaggaaagtctgttctatttatccatatttgtatgtactgaattctttcttcctttctaaacttccaagattccctcttttgtcttttccattctgtgtggacaacttccttagccattctgtcaggttaggcctgctagttgaaaattattctagttttctttatctaacaatgttttcctttccccttcatttctaaaggatattttctatggatataaaactctaggttgatagttctttgctttcagcaagtgaaacggtcatgtcctttccttttggctcccatggtttctgatgggaaacccactgtctgaatcatttttcctctatagataagactgtgttttttcctgctcttttcagattttttctttaagtttttgtaagtttgactatgatatgctttggtataaatttctttggttttattctgtttgcggtttgctcagcttcttgaatctgtgtcctttttgctatattttggaagtttccagccactatagccactatttctttgaggatattttaagcattgccctttttctcctctctttctgggattctagtgacacagatacaaatgttttattttttgttatagtttcacagttgcctaagtctctgtttttaagtatagtttatttctgttgttcagattaagttatttccattattctttcttccagttcactgattctttcttctgccttctccactctgctgtcaagtacatcctcttagtttttgataatttcaattattttatttttctgttctaaaattttatctgattattctttgtatcttctatttctttgtcaaaacttttacctttttcgtttgtttccactatgcttataattgcctcttggagcattttcatgacagctgctttaaaatctttgtcagataattctaacatctctgtcatctcaatgttcacatgtatcaatagccttgtaaaaattcagtttgagatcttctttctgttttgggtgacaaatgattttcggttgaaacctggacatcttaggtattaggtatgaggttctaattcttatttaaaccttctgttttatctggcttcttcttacaccacgccggccgggaaaagggagcatgccgccttgttactgccagatatggatagaagtagctcctgctcttcaatgaacctccgttggtttctgctaccaaactgacctccactgatatcttcctggcaagaaaaaatggagtagtttgttgctgctcttattgtggtcttcaccagtgctttagaagttgagggatagcatggtagcctcattacagctggacagtttcaaatgttctcaatctccaccaaacctcctctcatactacctcagtggagagggagatggatacctcattattgttgagtttggggtggaagtctagactgcccatttagtcaacatagacactgcatgtagggtaagagaagaatcttgctaacccccggcagggatgaaactcctagattcctgctcagacttcttttacactactctgggtgctggaaggagagggtgttggaataccctggcaaggatcagcgtctgggcttgccactttgcctttgcaggtgtacatggggatgggaccataattctttttgtggtgttcaacgagagcaaaatgatattgctttctgtctttctaggctgcccctttcttgttcctttgactagagagaacagcctttcgttggaacttggtttttttgtctgaaccagttggcatttctgggttgcaggcttcttcagctctgaggttttgatgtataaggtaaaaattttaaatccatgtcattccttgagtccttcagtctctagctagtttttcatcttctctcagcttttcagagtctctttaaatttctttgatatgtaatgtggagagattttagttgtacctagaaggggaattagaaaaaactacgtctactccatctttctacaagtgaaagtctcccattactttgcttctttttaaaaattgtttttaattgggaagacagcatacaattttcacatcagattctttcaggaagttcaacagaattatacaaaactaaccatgaatttagtattaaaaaggaaaccttcagacagagaaaacatctctaatttattttttaatatccattttacttccactttgcaatttccatcggtttgtttcttgacaagtttgtctcttttaggacctgcaacatctctgtttagtagtgagcttttctcatttaaaagtacttactgaaagactcccacatgggagtcacatcagtttctttcactgatgttctcctatgcctatcagaaggcctggcacatactaggacttaataaataatctgctgaataagtgaatgagaactggaaatttaaatttttatgtcaatgaatgtgtcatctgctttcttgttttgctgaatcatggggcttaagtttctgccaagcactctttaaatatgtgcttaggacactagcagatttgtccagaattttgcaatctagaaaaaaagcaattttaattttagcccgtgtgtaaatttttagtttatggtttagaattgcattattttgaattacaaatggggaggacgacatgatggttctcacgtgtgtgtatgtgtgtgtacacattcactcctatcgttgctaaagaaagtcacctgaaggacatggcacaaaaacaaccacaaaccatttttagttatgtttcctagatgcctgaatcatttttcagatttttttctattagacaagtcacagtttgattatctttgaaagtcattgttatgtattgtgcagtgtatgtgtttacacatggaaaaggggcaacattaatccatcatttggggaagacactgaatataatgttaaattttttgcaaacaatcatactttagataaagattctccaattattgcaacatttttaaaaaataaagttaaaggacatggttctttttagtgccgctcagtatgtttggtttctgtactaataatgcttgctttcctgtttggctttaaattctgcttaaggaaattgtgaaaaatttaattcactctacttttgttagaaagtatagaaatgttcgtgcatgggattcattgcctgctagaatggaaattcattggggaggggaaccatttcattttactacctaagagctgttgacacagtccctgcatctttcaaaggcatctttcatgccacgcgggcaaactgtagccagcgaagaaacagaaagagcccttctcacatatgtcagtctcagaaaacttgcatagcagctgtgctaggtaccgatgaggattactatagacccagttgcagggttttatgtggataaagagacaactggctttctcaggggagcactttgttggagattgcagcaatagtgcatccctgctgttgctagaagacattgtgaccatgtagtacaaaatcagtgccagataaaatcagaaagtaacaaaaagcaagaagaaaactcggagtttttttaaatcttaaagtgagagacgaaaacaaatgttctgggcttgtttcattcacttgtaaggaaaaggagacagatgaagggatgcctttaactcagaaaacttgaagggctttcagtcttttcatttgagaaccatttgggtgtgttgagaaaaaaagttgccagagtaggcatgttcagacctttatttgctacatttggtaggaaagattttttttttcccctcttaactacaagaagccagagttttctgtgcaaacgaaacaggcgttgcaagaatcagattcactttggacgactcttcacattccaagtcatcattgcgttaggcagcacaattccatctctggttgatgggcagaaaaagtgggcagcttgccaggtagacgtttccatgactcccagcccccaaaggtgatgcgtttttcagctaattcaatgaagagtgggctgaactttgggtctaaacgagacaatagctgccttcgcagtatcagcagaatggttgatgggagtgcactctacatttggcagagaatcatgtgaccttacgactgagattttgtgatggtgccaacggagacttggaaagcagcaaccgtcctgacttttttcttcttttctaacatggctcagaaaatggtggatcttaatacttgactttagccagactcagcaagcgactgagctttgaagcacaacttcgcctttattctgggtttttggcaggccaccaggaggctgtccctttcacgcctgataaattctgctgcttatctctaaatagaaaaaaaaaaaaaggaaaataataatagaatattgaggcataacaagtgaattctaaaattgtatgtgctttttgttttttttttttgttttttttgccttttctgactggtgatttgtatttttgttttatttatttatttattttttaggttactacctttctgcttgtagaagaatccaagtagttgggtctttttttttttggtttataatgaacaggcatttgaactgggcaaacaggacgacagcagcagtgagcatgagatcattgcattgcagcactgtagcaaactggcaccctgcctttgcacccctttggttcaggagacaaacgtgtgtaatcctcatttctaaagtcagcacagcctggaaggattcctggtctctcccaccttctaccattctgctgccagtgacggcaaggattggtgtagcttctgcgcagtgctttgtgcctggaataccgagaaggaagaaaaagaagacaagcaccctggtccttttctaagaaattacaggcgcccttgaagaaaaaatctgagtgtgtcctactacatgcaagagtgctggaaaaaaaaaaaaaaaaaaaaaaaaaaagagacgctcctgctcaaaaacaaaaacaaaagcaaacaaacaaaaatccaaaccaaaacaaaccaaaaaaagcaaacattggctgtataactacagagacatcgggctttgtaaatcagctttttaaggcaacataaccaaatgagccttctttatttttattatttcaaaccatatggcataattagcaatatattgcacttggtgaaatcgcacctttcatatcaggtataactttttttgttgtttttcttttaaaggctactgttatataaaagggaatccttgaacttttaatttacttttatttaactcattgcccactttactcttattaactttttccttttcctctcttgctctaatcttgattaaaatagaaacttaaggaaagatagaaaaatctctatgaaaaagacaatacatgtttttatgtggggtatacacagaagttttggaaagatattaatatatctgtgctttttgtgtccagtattagtttttgctatctaagaaaagtgaatgtttagacctagtgggtaaaaaaagtaaatctttcatgtgacttataatttgaaatgtgaaagaagaaactttttaaacttgtagaaaagggttatattagaatatgcgttgaatgactgataaataagattgcttttggggaagttatattcaaattatttacaaagatttcagtagaacaaaaataggaatgagaagagcatgttctcagttgctaggtagaaaagaagcttctttcataataatatgctcttttaaaatacattttaaaagaagtacttgtcctagagcagttgcaaaaagcattggaaatatcaagtgtattagaaaaagtacatgcaaacttgttttaagttcagagcaatgtattggctcagcagataactgcattgcattataattattttgtctgtttgtagaagtaaattgctaagcaatttaagcattttattaaaaaaacagttttgcctggttcagtgtgaaaggattagcagatgcattccagctattttagttttgataaaaaatgtttctaaacaagtgtaaaaataatttttaaaagagaatgcttttgaaaaattcagcaagtatcaatgaaaactataatttgcatactaagaattgacgttataatatttcggtaaaaatatactttggtaatctgttatgcttttaaaatcatattttcttatattacaaatatgtagggtaaacaatgaaaaatgtagaactgattaattctgcctttgtgtttgctattctatgaacaattacaggaaattgcaaaatccctatatactgataacattcaaataaaacgttctgttggttattgttcactaattatttacaaaatagctcttgtacctccatgctgcctcagctaatggtacaccaactttcactggcttaattaatattgataaacctgtttccatgtttcaagatccgtttaaaaacattattttaaatgttatttttagcagccattaatctctacactcttaattatcttattaagctccatgccaaatccaaatctcttttcagctttcgctacttcattgtgcaaaacctagtcgcttctttaacagccatcgtcctttcactttcaaaactgttactgtgaaaacaacacgaaccaaaatgaacgcataaatgcaaactatgaaaccactttatatgtcatatgagtagcctgggtggggccctgtgagtcttccaaggctttaaaaaaaaaatactttaaaaggttttgcccattttgatatcgtgttttcttctcgatcgtctaccctcattcccacgatccactcagatgctcctcctagacagcagttgtctgatatttctccttttgtggttgttttagggaaaaacttaaaatggatatgaaaagtgaagaaagtgatcataggagaaaaccatttcaggtaaaaataaaaaacaaagagcaaataagatttactgtttttaaagaaaaacaacattcttttgactgtgttttgttataagaattaatttcatattctttatgagtgtaactgttgaaattttattgatggttttcatttgaaaatgtgtgctatgacctacctttgtgaaaaatttcttgtggtcaattgggcagtttgtgtcccattgaatatatgtctgtgtatccatacgcttaagataggtgcaatacggtttactagaaagctttataggaaaagaaaaaaattatattttcttatttgttgtaccatataaaaggaagtgaaatcaggaggaggggaataaggtcatgctttttcatcttttttacatgacctgataagacaatgaaaccaaaacatgctttcttatagttatggtaaaactaaacccaatgctgcctcttatttcacatttgcatttataaatatatgttgaaatatttttactacaactgaatgtatgattgttgattatttactatagtttttaataattatgaggacaatttaagaataaataatggtttaaaattatgtagaacacatgatctatataaaggctataaaacgtatttatttcaaaatatgcaaaatcactaagcaattagtatgtagtattattttacacaataaagatataattaggaaatgctaagtgattatagatgtgaaatgattaatgattgtacaacttatcattttgttgcagttgagtttacaatcttaaaaaaacgtgtatgtggctggctttatgtttactcgtttgtgtgtttgcttgttgtctggtggtttaaaacattttttagtaatattttatttttgcccaacctgttgaccagatgagagttgtatgtagccatgcattttaagtgtatcttttttgaacaataagtttaaatatattttatttaggaaagaagatatcctatgtcatgtaatacatctggagtataaatgttagtgtggagtattagtaatcatgccattatcgtgccatttagtttagttttatattaactcatccaaatattgtaaattttagcaccattccgactatagacacagatgtatatatttaaggctgataataacttcctgtattctctagctagtgaacaagatcttactgttttatgagaaagttataatgttaccaattccttgaaaccagtaactaaactagttttataaaaattaaaataagcacggtctaactcatacacaattaacttaatagttaatttggttttaattataggctcgtaatactacattcatgcctcacaattatataattcatacatgcatgtatggattcttttttcttttaaaactcaattagaatagtttaattccaaaatatttactattgaaacaaaagcagttcgtgaaaaatttttcaataaactactttttaaattctcatgcatataaatttgtatttagttttgaatatttatgaaggcctttaatggagaatatgcatccttagaactcagcatttaaaacatttatactaaaggatcaatattatttttgactcttaattgcatcagatatttacaacaaattctatattaatagggggcccatgcaagatgttgcccattggcataaacccgtagatccgatcttgtggtgaagtggaccgcacaagctcgcttctatgggtctgtgtcagtgtggtaatctgacaaaatgctatacacagtgccgttcaacaatagttcagtaaaatcctgttaaactccagttgattatatacttttgaagtcattatattttcctttgtttttaatgtttattttaatcattgtctgtcttacaaggcaggcttcaattctcaacaacttggaagcgtttatatcacacccattcaagttcgattccatgtacagtaaattgcataagaaagttgaacctttatagcagggtttggaccaggatctgaatagattctgttcagaaacttcagtgcatactgtagtgcttagtgtacctcttcaacttcagtaagaaaattaaagactaccattggatttatatgtttttattgagcctatttctcctgaaaaaatgaggctgaatgcaattgacttttactattaattgcgactagaactatggcaggttagatggtcagaagacattttacgtgacctatgctggaaacccaagtgtttaggttagtcctatgagaaacagttagcagcaaagtttactggtaaaatgttagaatattatatctatatccttgccaagcccttaggtgtatggctgccatatttggaggagctgactgaagatatgataaggagtttgaagcaacattggaagctgtgtgcatccgggttgaggtagtaggttgtatggtttagagttacaccctgggagttaactgtacaaccttctagctttccttggagcacacttgagccgtcgaggaattcttcatcactttaacctgattgagccaatttgtgtgcaagaaggtaatgtgtcatgagtatcttggatcattgatttgggcctttattacattaaaatgatcatttcagccctattagattattccatttgtatctgcttatgaacaatgtcaaaatggtatttctaatgggttgtcactccatgttcaaacattttaagaaaattgtaggtagtgacttaaattgcattaatattaaagctttttatcatctatagattaacaaaattcagaccttaattttcaaatggatcattggtctatttatattggctgcttagacactataataaaaaatgtctgctagagttaatagctcccatagcacattatttgcgttttccttatgacacatcactttctaccttatgttatggctatttatgtgcttgctgattttttccgcactagactgtaagccccttgagggcaaagtccatgttttatttttcactgtatcccctccaatgccttactcataatgagcactaactatttattggattagtgaatggagtgtaagacctcactctgtgatgagtttctattgaatatttgaatgagttatggcagtggtcaaacatctgagttttatttattgctcctaaaactgtttaaatttaattcctggactgctccgcatcagtaatacatgtgtcgatttttgactgtgttgaatgtgttcattcattctaaacagataagttaaaatttagaagtactttttatctagaataaaaataatagagtaaattcatttttactaattagttcatgacagtttatgatcctacacttagataattcatatttctgttgaatttaaatacctttctttccagatgaatcgtttttcttttagcatcaatttcaactaaatattctattttaagtctcatttaacaatatgatttttaaaaattagatttgtgtcttttgtgtatttccctcgtctcctgccctttatttttgtacagctatatctgttgaataaaccagaagcaactaaaccagaaacatgtcaataaattaataataaatatgtatataaagtataatttgagaatgtgaacacatttttgtttaaaggaaaggcactttataatattctttgtgttacaaagcaaatgggactctttggaaccttagtttgctgtcaactttagcagctgttagtggtgtaatttgtgtagtgaggctatcttacatagatcatctttcagacacaggattaagtagttgttgatgttagaactttaatttaagactccaaatatgaaacatggaattcattaaagagacgtttagatgcaaatatatattaaggacctcaagatactggctatgtggtgctgacctttctagaatgctcaggcatccaaaatatcttaatacctagaacttgctaacaatgtagtgaagaaggaatggctacccccaacacgtagaacatgtgagccttagaaagtgaataccagtcacttcaagcaaaataatttgattggtctacagtagtaaagactctttctctctgtgaaagaaaaatatttgcaaggactaatcaagaagcaatgaataagaggcagtagacatagacctaaaacaaacaaacaaaaagacatgaagagatgaaaaggaaagtgactcatagcaaataggaacaccattgtgtctaatgatggcagttcaacccacggatgaaagaaagggacaactaaatgggtaaacaattgtatctttataaatagttttttccttgagagcctaggatccctttcctatgtgtttctatgtatgtatctcccaatactaggtgtatttatttagaagccaaatctattgatgggccaaatagaatatgattgccaataaatgtctatttccttacagtgtaatggagttaagtgcctcacagaggtcaagtaagatgtgcagtttaaggataatcttacaaaagtactataatgaattgttagaattacagcctcttttatatactatcacctaaagtgaatgagtataatagaagaataattgaagaatggtgaagatgtctctatgattcattatgttagttatgtagaaatcataagaaaaaatctgaccaggtgtggtggctcatgcctgtaatcccagcactttgggagtctgaggcaggtggatcacttgaggtcaggagttcgagatcagcctgaccaaaatggtgaaaccccatctctactaaaaatacaaaattaactgggcatggtggcacacacctgtaatcgcagctacttgggaggctggggcaggagaataacttgaactcgggaagcggaggttgcagtgagcctagatcatgccattgcactgcagcctgggcgacagaatgagactccgttctcaacaacacaaaacaaacaaaacaataagacagaaaaaaacctgcaaggtggaggatatagttagtaccaatgaagaaaatttttaaaacttctctgtaggacaagaacactacgtggaagaattgtatgtttgcctttgattcataataaattttgctactccaggtatgagggctatgtaacttgctacaggtttataaataaatggcaaatgtcagatatagaaattgataggattttttgagaaaccaagatataggaccactgctgatgtcagtaattaaaaatagttaaattatgtctaagaaatcaaagcgaaagattgttcatatagagggcttatgttcagctatggggaaacaactaaccagactgaataatttccttaagaattttaagtggtcaagtttaactgtagactggggttttcacatctggtaacagagtatgacaattcaggaaattattaaatatcagtgaatcatacttcgtttaaccaatatttcttttgatattttggggcacaaagttggatatgtctttatgttcatactggttgatttacctcaaatgctttgtgggatgaggcaggaaggagttttagagtgggaagggagggagggagagaagaagggaaggagggaagaaaagtaaaatcaagtgcaaagcaatcgattgagcctcaccagaaaagtccattattagattataagaactaatgagagaaagtaactatgagagaatcagataaattacttggcaattggactgggtctttttgaaaaacatccaatagtccatgaactatgttattagaataaatgaatgatttctgtaaataataatttagattctcttattccctattatcaaatgctgactaatgagcacaggtgattcctcaagattacccaaatgatctgatacaggattccgtcttcctgagcattatttcacacccatggctagtttctctgctacaggatagaggaataactcctgaggtaacttatcttaactctacctatacttgacctctaaaaccctttgggaatgcttgtgaaagatataccagaagaatactttattcttactttaatgcctactgcccaagcaaaactaatacctgttattattatgtcatttaacatgataatatcatgttcacctacaaatcctttactgattctctaagatagaatttctcagttttgaatcctcaaggcccttgccactttcattcccacagggatttctctgacttctattagtagtatttacaagtgtccaaagggactgtgacttgcctttgtacctcttgtaatgtacatgctttacttttttaactatggatatattgaatcaatgcctgtcgtcttgagttgaactttagatcatttatgggcaatgatgagaactgctacacaccttacgataaacttggtttcagcagtaaagtcatgggttacccaagacatctctagactctccagaatgtattgtcatggtattaggagtattctaacggtgcctaggtctgcagcccactcttgattaagcatgtgatataccagtggaaatgatttaggcaaccagccaatcactataatttgtagtaaatctaagcccctttatgtaagaaatccatgtctgtttcaaactgacagctcctaccataatgtttagcttataggatccattcaccactccattttggtgaatgagcaaaaattttttaaacaaaataaaaaagtgttatatattggagcaattctatatttaagtagacttcttcaaacttttaaagtttagaatttaaaataaattagaaatatcacttttggggggaattctgtttgatgataattcttttttttttttttataagccataattaatatagatttaatgcatttttccatgtattacatgatttaagtacagtcttcaaaagtgaaggagtctttacttgaaagatgttaaagtgtatatgtttgtgactctagaattttctttttttgttgtttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgcctcaataaacatacgtgtgcatgtgtctttatagcagcatgatttatagtcctttgggtatatacccagtaatgggatggctgggataattcttgatctcttaaaattggcattgtcttgtgtgtcccttaatttttaaccttattctatgctatgtgaaggcgtgaattaaatcatatttctctcctacatccaatatctcttaaatcccaattttgtttctcttcatctgaactcttagagtacttatttgacaacaatcatagtcagtctgtgtttctaattactttttatatgtttatatagtatataagaagattagatcatatgctgtataatttgtgtaaatttgtacacaataggcacttaataaattgtgctttattgaaattaaaaataaaattgacacttattaatgataagaaccttagagatcaaatggcccattttccagatgaccaaactgaggcccagtttctttaatgattctgccaaggtcaatctactagttacggacataactcagatttcaaaccatttcagtgacctatccaagaagaaatattttagaattgctgtcattagatttttagttagtactccattttaatgtgtcattaaacaaattttaataaagttgattgaaattagagaatagacttttgtttccgaaaggctataaatcacatagtaatttagcttcaagctcaaatatgatagacatataattaaaatgatttaaaataaactcatcccttcaattatttctttccaagtaccattgcaccctcattcttctaggcaaagagaggaagttatctacctcagttacattctgatatttctcctccttctagaacacttctccaagagaggagagtatggcctagcagttggtggtgtatcttaagcaaaaaggaaaaaaacaaactatatattgttcaatctgttagcactgtgttgctcagaaaaatgaaagttaatattaaatggtaaccgtaactaaatccaacttcaagtttcaattgttcatgccctccatgagataggcaagatattatgtaaggtgctttcacagggatcataaacttaagtaacttctgggtccaggtagtataagccagacttttaagacaaggggaagtaatggggactgtggtagaccaaagaaggcatatttacctttaagatatttcaaaataggccaacgccgtggctcacgcctgtaattccagcattttggggggccgaggtgggcggatcacctgaggtgaagagttcaagatcagcctggcccacatggtaaaaccccctcgctactgaaaacacaaaaattaactgggcgcgatggtgggcactcgtaatcccaactactcaggaggctgaggcaggagagtcgcttgaactgggaggcagaggttgcagtgagttgagatcacgccactgcactccaggctgggccacagagcgagactgtctcaaaaaaaaaaaaaaaaaaaaaaagatattttaaaataactcttgttagtatgaatttggatcccaagggcagccagttttccatttctgatatgaaggtatcagatagtaaagcaaaatttcaaaaaacttattattttgatgaagctaacagcatcttttcataaagttaaactagataatttgggatcgttttactactctcaagtcattataaagttcatataaaagacaacttctatgctgacattgttatttcaaatagatatgtatgttgcatgacagtcgacatggtttcttgaatttaactgactaatgaaaaatattcattcatcaagcaataattagcaaccacaatattattttgatgtcattttaataaaagaagtgtagtagtagtagtaattgtaatattcttggtaggaatatataattttcagtttgtatttgcatataaaccgcaatgtacaaaaaatgaaattcttataattcttatgctcaggtaattgatgctatagatggataaatatatagcattttcaagttagaaaaaacaaaatgttaaatagaatgaagactaagttcaagtattctcatctccatataaagtcgggcaactgagtagagttcaaaagtaaagaaacattggtattgttaattatattttattgtgttataattaaaagaccaattatacataaatctggaattagatcaggttcctgtccataaattttcgatataatttaatccagtgaatctaaatgtgtaaaagagaaatgacaaaaccacttatgaaaacacagagtttctagtagtaaaaaaacatgtattgtcaattttgttgtctgttgtagaagccctcttatttaatataattgggatcaatagtcaatgagttaatgcactcagatattaaaataaattgatcttaaaaacaaatacatacacacaacctacattttatttaaattttaaacacttgattatatatttatttgccaataattttatgtaaaccaagaacttttttttttggtttacgttgttggttacagattatagtcatccttcctttcaataaatcctataatgcatcatatatgatttctaatttttcatcgcgtcatgaatgtctttaagtaagttcaaatccaatgcaaagaaatctaagagcagaattctactttctccaatttttttctaagcttctgaaattgtctttcccacatgttattctatagcattgtgggtttttttaagtgactgaattttattaaatcttccctaaatattcaacttagaggtatagaacaacaattctcattttctttacaattatatttcaatttgtttatgtgatatttaattaaattgtgcaattcggtatatgcaaaactggcataaactggtttgggagcaaacgtaatggactccagggaggcatgtaaaccacttggtgggagcagacatgttcaactgggtgttccagaaatcttgatggcgacggaactgttctctctgcactgtccaaaacaatagccactggccacatgaagctattgagcacttgaagtacgtctagtgtgactgaaaaatgaattttaaattttagttaattttagttgactcaaatttaaatagctacatgtggtttgcagttaaggcagtaggctgtgcagttctagagagtagctcacttgcatttagcatttagcagccaggatatctgttaagaatatcagataatctgcaaagtggctaatggttaagaatactactgtagttgaattaagatacacttaggaaatgcagattgatttggaatgtgtttgttttgctttttttgtttcattttatcatcttttacatttgtctttttttatatttgagtctaaatttagttttgaggaattttttaaactttattcgaaataaggaagccaatgagtaaaacgttaaacactacagagatttacagctctttatgtagcattcaattcaaccgaaaactaatcagaaagtaatgacattccttctcatattggcaaaaaaaaagttcttaattcagcataatagatccataggaaccataggatgaatttgttgagtctttagaacctttgaaatatttatattaatagtttaaatgtatgcgaatgtgcttgtgtttgttttgtttgtttgtttgtttttgagttggagtctcactctgttgcccaggctggagtgcaatgacacaatctccgctcactgtaacctctgcctcccgggttcaggtgattctcctgcctcagcctcctgagtagctgggattacaggtgtgtaccaccacacccggctaatttctgtatttttagtggagatggggtttcaccatgttggttaggctggtcttgaactcctgaccttgtgatccacctgcctcagcctcccaaagtgctgggattacaggcgtgagccaccacaccctgcccaacgtgctggtatttctaaggaaaacccaggctctgtcagattttcaagagagtgcataatttcctcaaaaagttaataataactccatgaggttactgtttaatactttttgaggtgcctgaatttaattcagtgtaaactgtgatagaatcgaaagccttcatttacaaatattgtaaatctatcaatccacatatatgttaaattataaaatgtatacatgttattaaatatgtaaaaattttatgtattgcacaatatataatttatatgtaattaataatacatttataatttaattacttagataaacctgtggaacaaagttgacataagaaaaaaggtagcttaattctttggaaggactaaattaaattggataggtaaaattggtattatattaagtttgaacatttaactctaaattactggacatatcataaaaatgtagactgaagccacacatggtggcatgcgcctgtagtctcagctattcaggagacagaggtaacaggattgtttgcgtccaggagtttgagggtgttgtgagctgtcatctccaacctgggtgatggagggagatcccatctctaaaaaaaataaaataaaatagattgagccatctctcagttttacaatataagtacatttactttttattaatgaataactgggcttattaaagtggtgctttacgagtgaggtttatgaaacataaaaagatagtcatcagtttcatgctaaatgagagaacttgcctcatgtgaaaacatcgggaaaattagaaaactgtacttttatatgtttttaaaataaaatatttgttttaatgtatttgtatgtttccctttttaatcacagttggtccttgaacatcacaggggttaggggtcctcacccccggatgtagttgaaaatttgggtataacttttgactcctcaaaagcttaagtactaatagcctacttactgataacataaacagtcttactgataacataaacagttaattaacatatattttgtatgttatatgcattatatactatattcttactctaaagtatacttgaggctggacacagtggctcatgcctgtaatcctagcactttgggaggccaaggtgggaggatcacctgaaggcgggagtttgggagttcgagaccagcctgacaaacatggagataccccatctctactaaaaatacaaaattagctgggcgtggtagctcatgcctgtaatcccaactacttgggaggctgaggcaggagtattgcttgaacccgggaggtggaagttgtggtgagccaagatcgctccattgcactccagcctgggcaacaagagcgaaactctgtctcaaaaaaaaaaaaagtattcttgagaagagaaaatgttattaagaaaattgtatgagaaaatattccactgctcattaagttaaagtggataatcataaaagcctttatcttaattgtcttcaagttgagtaagccaaagaggaggagggagaggaggaattggccttgtcgcctcaggggtgggagaggcgagggcagaggcaggagaggcaggcacactcgttgtaagttttattgaataaaattcacatataagggaacctgtacaattccaacctgtgttgttcaagagtcaactgtgacatttttaatctatcaactaccaattccaaagacatcaagtaggatggcttccactgcaatagtattagtcttcttataaaagtgagaaaaccagggtcagggagttacacatataaattccttacagccacataaaaggtaaatcccagactgaagcagatatatcttactccaaaggatttgattttaatcatcttgttataatgtctcctgtgacagagaattagaaacttgaaagcattaggtatccacagtaaaaatttgcaagtaaggtttttctctgttttatttagaatgaatgtgcagcctccccagtccaactgaccagcttcctgtgctttcagagaccttttctagaccagtattacaatttggagatccacacaataaaagttcaaggagctgtcttctctttctgagtttttaaaatatagactagcatatggttactaaacctaacctatctaaaaacagcaaatatatttgcttctaactggggatttatcaggttaatgtggtaatatgtttatttgaggattaaaaaaaaattgtgcattatcactcagtcttttaacttcagattatttccatttaaaaattctaagtatttcaaaacatgggagaacaataaactttacgtcacagactacttgagattaactgactaatatttgggaagcatctagataacacagtttcttacataatataggggcccagagaagactccgtttttccttcccccgcttaagaattaagaatcttaagaattaagaatgattaagaatcacttgaccctcacttactgttttccttcctgctctgggttttaagaccttttagaacaatgaccctcagctgggcatgaatgggaggggaatgtgaggcgggaggtgggtgtggttggaaaagtcttcaatactattcagattttacctctgcatgggcacccatttcggtaagaatccattctgtgatattatttcagaggcgaaggaaaggctacccctccttcaaaatagcttggtcttacattgcacatttaacttagagcacaatgactatcccttgttctccagtaatatagtggttgaactccaccctggagtcaggatccctgagtttatagtgagtgtgagtcaacaccaactataaaagctgaccttttcatcagtgctttgtggtctttatctgtaatgtgaaaattataacaccaatgttgcaagattttcgagagaattaaaagattatatgcacatgacctttagcaaccatgatgcctagtaggtaataggagttgaataaaaggtaattactatcattaggcatattaactgaggcagtgtattgtttgcttataaaggttccgcatgctcagtgctgcagaatttatataggcagagccgtcgcaagaaatgttgggaggtggttttttttgtttttgtttttgttttttctgacggtcctcttatcttcaaaacatcatggcactgctgcctggatttgctggtttgaataggccacatttcagctattcttctcattgtcaggtcatggcaaataataagtctcaccttttctttctgaaattgcattcccgcttcattcatctgaagttaattcttttcttttttgtatcatgcttattttgcaaacatgaacaatcttgtcactaccgtgtatatgcaaataaagtgaaatgataaattgcttaagtgtctccgtttttctatctgtagaataggggtcataatcccttcctgttgcacttttccagacagttgagaaaataaaaacacgtaatgtagagaaaagagcatcagtattctcataaatagaaaattaagccatttagactatgtacaggaagtttgataagtagacttccagaaaagaagtggcaaagtattctttaattgttcattccctaagaaaaagctgtctctctcaatcttttgatacctctgtctttctttccctctctgtctacccgcctctgttctgtgtgcctagatcctgttaatattttctctcctctactattttcatgtctgcatgtaattttttttcatatctagccaagtgccaaaataacattatgtttgatatatcaattaattttttaattaaatcaattaatgagaacagctagagaaatgtagattttagttcacatgaaactggagggtactggctacgttgtaattaatatattaatagtttgtcagtcttggtcattgtcttggtcagaggatgccataggaagctagatcagtcctgtaatttcttcctattttttttttttaaataaagccaattatttccatataagctaggtatgcactccatacctgtttgataagattgattacattaaacatttctcacaggaaaatgagtctatattttatgtttaattttaattttcactttgtagaaactaagttcagtgtgccgtgctgatccagtgaaagcatgtgcagtaatttcattgtaaccagttttcactttagatagtggccaggagatgtttgaaccgggttatgagtttgtgaggttttgagcatggttcttccttctttccctaggctggatagagtactatagcagggtattggatggtttcccaaagcaggataacttccagggaggaagcatcacagatgtctgaagttcagtggtataatgcacttttattactcctctgttcctggcctacaaatctgcagaaaagacatatgagggcatcaatactctccaagaaatagcatcttttttttacacccccttttttttttttcttttttgagatggagtctcactctgtcacccaggctggagtgcagtggtatgatctcggctcactgcaacctccgtctcctgggttcaagcgattctcctgcctcagcctcccgagtagctgggattacaggtgtgtgccaccacacccggttaatttgttatttttaggagagatggggttttgccatgttgaccaggcttgtctcaaactgctgacctcaggtgatctgcccgccttggccttccaaagtgctgggattacaggtgtgagtcaacacgcctggccgaaaatagcatcttcatccacttttatctaagcttaacatctattctgtttatggtgttgtcagagatttggggaactgggataatgagtttgtccatttcaactgttgattattttactaatggctatgaaagtgctatgatgttcagagcaggtcttttcacatttgatggataattttgggagcagggaagatagaccttatttccttgcttagagtttcatttcaaaacatggattttagatataggactgccagtttagcaaaataaaaatatgagacatgcagttaagtctgaattttagctagacaataaataattttagaatattagtatgtccaatatgtcatattgtttttactgcttattggaaattcaattttgactatacatcttctatttttatttggcaactttatttagatagtattttccataatgaagtgtcttactcctgtttctccatatatttccactcacagtaagtaaaggaatagaaactaacgaataaaattcatgtatgaaatatcaggggaaaaatacaaaattaaaataatttatattaaattaatagaaaatcaaagaaaatgccctttttctaaatgccagaatcatataaaatttgtattaggctatgtttattttatatgattaaacaaaatggtttagcaaatggcatttaataaacaaaagccagtttataacattagcataaacttcagaggattaaaaatttgttacagtgtctaagccatatttctggtgggtttctgtgatattctatgtggtctttgcattagttactacagagtatttttcggtgcaagttctggagggaaagttttctaagaaatgaacattcccattaaaggaatttcactcttcaattaatagaaagcatcatttgtttttcacatgatctgttgctatcggttcctttaaaatgtttgttagctttttaaacatctgttgctgtaagaagataaatcttacacacattacttgtgctgtgtgtttgccccagagtcaagtcaatgttttacatggcgcctagagatctgtgataacagctcactggctgtgttcctgcacgtcataatctaaccctttcccgtatcctgatctcttccttcctgaccatcctcaccatcctcagctcagtggctctccccatttcctgttttgctcagaccctcaccagagccaagctctccagccaggtcttctccctacattcatcagccaccgccctccgtccgcccggctgcggcaattctgtcctacttttgcagcctgaaccctgagcagagaataacaaacctggaaactttcatagtgtcacccaaagtcacaccgcacacacatgtgcttggccacgtattcacacataatgatttttttttaatttaatgagggaattgttatgtaaatttggcaccatttctttttgttttatatggatggacatgagcacttaaagattaagaggttattttcggccggtcgcggtggctcacacctataatcccagcactttggcaggccaaggcaggtggatcacctgaggtcaggggttcgagaccaccgtggccaacatggtgaaacctcatctctactaaaaataccaaaaattagccgggcttagtggcagacacctataatcccagctactcaggaggctgagacaggagaatcgcttgaacccgggaggcagaggttgcagtgaaccgagatcgcgccactgcactccagcctggtcaacaagagtgaaactccttctcaaaaacaaaaaacaaacaaacaaaaaaacccaaagaggttattttcaaacttgcatagtcacacgtcaaggcaggaacccaagccctgccatcaaatcaaagttttgagatttaagttcttcctctgtaatacaggatcgtatggtcccagagttaaaatagaacttaaaatacctagctgaagtgcttatagttatcagaaaatgtttgtttcttccctgcaattttcactaaagtgaagaagacgtgtgagagacaatttgtgagacctaattctggttgaggctaagaattccattcgttttccagtcactgacaaatttatttaactcttttgcttttggacatgtttctttgtcacacaaggttgttctgtgattatatgtttctataatcttttcagtttaaaatttgacttaataattagcatatagcaagtcaagaattttttttttttgcaagtcaacaattttcaaatgaataaatgcatgagtaaatggtggtatcccttgctttactacaaataatacaaaatattttgcaattgtttaatgacacatttgagagtgacataggtattttattgtttctgtggatttttgtttgtttgtttttctagatggagtctcgctctgccgcccaggctggagtgcagtggcgctatctcagctcactgcaggccccgcctcccgggttcacgccattctcctgcctcagcctcctgagtagctgggactacatgcgcccgccaccacgcctggctaattttttgtattggtagagacggggtttcaccgttctgtgggtattttaaagtaaactctaggacatttttaagtagttggatttttaaaaattgtcccacatactaagttacattttttacacagttgcagcacagtacttacctttgatcctcgtttgagcctctggctttctttagcctgcttaagctctgtcctctctctctttactcttctattcaaagagtagtatgtattttgtaaagattttgtaatcttgcctactaataaagtttacattcctcagcaggagagtaaggaactttacaatctgcttccaatgcaccaacataaactcgtatcaggctgtctcttcatctcctgtgtccaccatttcccagcccctacgtgtacaccactactttatatttcactcacactggggctccatgcaccaacgtagcacatgagcagtggtgtgtagcagaaggcaagaaagtccataagcgtaggctttggaatgaggcaatcagagctcaaatgtagctgtagctgtatcattttgtagctacacggctatctctgtctccatcaacctcacttgttttacctatgactaaaataatatgccgggcacggtggctcacgcctgtagtcccagcactttgggaggccgaggagggcagatcacaaggtcaggagatcgggatcatcctggctaacacggtgaaaccccatctttactaaaaatacaaaaaattagccgggcgcggtggcgggcgcctgaagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaaaaaaaaaaagataataacacagtatagagctcctataggattaaatgatataacataatttaaattatgttatgaagtgtttggtacagggaaggcaataagtgtaagctattgtgatacaataaagatggacatgaaagtttttgcttattttggttattctgtctaaaaaggtttgaattacttttatttgtggcaaaattgcataatctttgagatctgctaacctttatattcacattaaaatgtaattaataatgattatgttgcatgccactctcttatttcttagttgacattgtatcttttcctagtctgacttttctccagattaacactttaaaaaaagtcatacgcaatcagagtaaagggaatttgtcagtcatttactccaatatcctcatctaataattaacaaaactgaagttcaaactcgttgataactaacatatttttgtgagattgttgtataatgtctgccttcgtagtagcctgtgaatttccaaaaagtagaaaaccacgtctgtgtgaatggcttagtatcaacaatgattgatatagggtgaactctcagtgatgaatatttctggaataagagaatgttgtggaactacttctggccagacttcttaattgtaggctggtgctttttgtgttatactatgtttcttttcactcaaacctcatcttgttttgcagattcacttattaaaaatctctcctgaaagtttttgtatatcctggagtggcccacataaaactgatcgttatgagatccaggaactctcctggttgtataatgtgatcacctgcttttggaggtctaatgatgcatacccccagagacagaccaaggaaaaagtaaagctgaagcaataacttatttatttacttacttacttacttactttttcctggctaagatgatctagacatgtggatcttctatccttggcatcaaatttggtgctcctttcttgtgtctaacaattaattgcttcaaccttaatttcacagtagtaccaattttgtgttaaccttggctgtctgcagactactttcattcttgttgcttatttctactctttagtaacccggagagaagcagaaaagtttataggacttgtgttctataaatgagggaactaaggctttgtctgaattcagataccctctctgccatcatactgtttttacgttgtgcagttttgcctcccttcactgggttggggctgccttagaactatggttgagctaaggatgaggtggcctccacctgtaatcccggcactttgggaggccaaggaatgtggatagcttgaggtcaggagttcgagaccagcataggcaacatcgtgaaaccctgtctctactaaaaatacaaaaactagctgggtgtgatggtgcatgcctatagtcccacctacttgagagactgaggcaggagaagtgcttgaatctgggaggcagaggttgcaatgagccaagactgtgccactgtactccagcctgggcgacagaacaagactctgtcttaaaaaaaaaaaaaaaaaaaaaaaaaaggaaactgggcctcagtttggtcatctggaaaatgagccagatggtctctaaggttcttaccattaataagtctcttccaaaaatacaaaaaaattagctgggcatggtgccacacacctgtggtcctagctactctggaggctgaggtgggaggattgcttgagcccaggaagcaggtgttgtagtgagccaagatcatgccactgcattccagcctggacaacacagcaagactctgtcttaaaaataaataaataaataactatggctgagatattttaccacagtgaaagaaatctaaccattctccccgtaagttctagcaaagttcctagagcagccttgggctataggaccactgaattcccatgctaaagtccccccccacaccaccccccatggagtcctgaagttaaacagctggctagttcaaattgtggtttagggctgcaaggtctgtgtttagtaattagcacttgaacctagcaataaccttcaatgagtctctcattttcctgctctggggagagaaaaaatcaacaaatacagactaagtgtgctctagtgtcagatggtcagagtctggatcacttgttggatgtatggaactaaacaagttctttcatttctttgtacttcagatgcctcatctgcaaagcagtgtcaatctcaaagtttcttggaaagggtaaatgaaattataaatgtaatagcacggggcctgactcataggagtgctccgtaaatattagctcctaatcattattattattcagtacttggcaaaaatcaagttacagtttcatctaatctgagttgatcacatgcatatttttctttatttaaaaaaaatttctttacaaacatgaaataaatggggtggaatttactttcttcatttataactagatgatttcaattaatttgattttcagcaaaagcatctttatcagttttgaccatgttggaaactgaacacagcccatctggcattattggcaccacattggaaatgtatataatcttatggtgaaagtacaattacaagtgtaattctgtcttgacgtttgcttgaaattcatctcttttgggttatatgttaataatgagggcggaaatttgctgtgagcatttacatttgatctagacacaggctaatattgtttgcctgcaatatatttaacattccaaaactgctttctgatttatcttatgtatcttaaaacttacagctattaattcttctcatttttccactaaagctagcataccacaaagcaaaatatgaatatattctataagttgtagaatttcttaagatttatctctaccattggatgaggcatcataggcccttttcctcaaggaagtggaaaatattctgtgccagtagttgtcagtaaaagaggatatctgtccctaaagtttatttcatatgaatattaatattccttatatggccatcattttcagtgtttcattttccaaatgcactttctaaaaacatgttaaattatggtccattactaaccactaatggatgattttatgactgaattctgcaccaaaaatgattatttgctgtgtgaggacagatttgcaaaacaagatgtggtagcatttaaacggccacttatttttagtagaagactgccctgactgtggcctaaaacttagatttccatttcatggcatcattatcttcagacccagatgggcgtctcttgcacttaaggagcatgaggaaaaccaatttgattaaaataagctgtttcgtatcattaggaaatttggagatggaaaaataaagatttgtgtaataaatgtatgatctgaagccacgttcatcctccaaggtaattagcaattctgtatttgcaggaaccaggaaggcaacagatttttcttcaggatgctctttttgtggaaaattgtgggtataatacttgatgggtcaaactgaacaaagtgaactatttgatttatggtgtgaatattatgagaattattctgtagttcatttcttcccatcaattcatgaaatcaatcttttaagcttattttgcaatcaaaattcctaaaaaaaaaacctaaggatcttatcttataataacatcacaattctttctatattattttcattcaatatactgcatatctagatccattaaagtaattttaaaaatttcttctattgatatggctacagtctatttcaaatattggcacctgaagataattgtgaagtcagcaatgattcagcaaaacagaatttaaatagtgctgaaagcataaatagtacccaaggagatgtgggtcttttctaaaaaaatttaagatctaggatttacccatacttaaataaactttaagtatttattttttaactaatctccactcaaagctccttcaaacgctgtttccatgttgtttacagtgtaaatgaataggataatgaaaataactattaaataaaatagaggttaagtgacctgcctgcagccacagagttagttcatggctatgccaagaatcaaacttagattttctggtttgcccatgttcttttaactgctttttttgatgaagtcaaggctttgagataactgacctcaatacatagttcagtatctccgtttgtcagcacaaaatacacttcatgctattgtggtgtttagataaaatatacaaaatataaatgctaatgagatgcccaatatgtgatgatgaatcgcaaaaagcaatataatgtgacaaatatttattaaatagctaattctgtcaatataaatatttctgaggagagtattcttttcaccttcagaaagccgtataataccaacaatttatgaggggtgaaaccaatcaatggtaaaatactttcggatttttaaaaactaatttagtaattggcaatatattcaggaacattattaagttggtttttttgcatcacaaagattgaattctgctatttctgttgatagaacatgtactaaatgataacactgattaataagggtaagttaggtaatttttagaagtgcggttccaggaagaaaacttcctaaatgatggaagaaaaaaataagttaacttagatatttttctgtacaatttagaaacagacgaaccacagattacaaagcatgacttcatgatctctggaacaaggctatgacatgaggaatttaagaagctccccttacatacattgtatcagactcttgcccctccctccaggaccttgtgctgcctgttccattgcctgaaatatttatgtgacccaaagaagactgggtcttagatgttagattctccaagaatcctccccagactcccggtgtctgtgggaaggatggtccagtgcgccccttagagtctgtactttgtcagcctttgtcacaatataatcagcacatcgaatgctgtgggctgtttacctggcgtcatttcgctggagagacaacttcccaagaacaggaactgagtgtccagtggtctagctgtgtttcacccatagtaagtgatcaactctgattgaatgaagggatactcaagttaactagtccctgtgcaagtccctatagcgtagagtcacaggctctcttttgaagctctttactacactttatttcactcagatgacaggcaaggaaactgagactcaggcaggctaagagatcacacaccataaatggcagagtgaggaaatcaagcccattctctttccttgcttattctttcattcaacacatttatgctgagcatcctctatgtgtcagacattatgtcaaagctgagaatccaaagataaataggttaagatttcctgaagctccctgcctagtcagagatagactataaacagtaattataattcaatatgataagggctttgacagaaccatgtactctgtgctgtagaatttctaaagaaggaatcagtgtctgtgcatattaaatcgctccattttattttaatattcttttaatactcttttatgtctgactttagtatataactaccctcatttagaagaaggtaggcaaaggcctattcaatttaatgaaagtttaaatattgcaatgttatttctaaactaattagttttcatgattgttcatattgtacattaatttgaatatcaaacagaagtctaatagttttaagtggattgcttagaaaaattagtattgtcatttatataacttggaatccaaagaagattctctgaagagaatgatcataagcacattaccagagtagatgagtgaagaactggggtaggagtacactatggcatggagatggcttagggtgaatcaggaactagcaacacccttcgataaagcagctgtgtgcctgagttttgatcagaagttcatctgctgttgttaaagatcttttaaagaataactggatgaatagttattttacttctcatagttgcctggattaatagatttattttacttctcatagtttttaaattattcttcagacaaaagaaaatagccatggcagattatggcatttaataatggtaattcaaaatattttatcaaatgaatttaaaaaaaagtaaatgtcaataggcaacatcagtttatttccatttcttaataatcaccaagctattcaaaccgagagcaatgagaagctcataaaaaacaagccatgaacctaccaggaaattcgagggaggggatctccctttatcaatctgtgtatctccagtgctaagcacgatggcttatctcatatgtggttgaaaggcttcaaccacaacaagaagactcccaactgaagacttttttttttttttttttttttttttgggatggagtctctgtcgcctgggctggagtgcagtggcatgatctcggctcactgtaacctccagctcccaggttcatgcgattctcctgcctcagcctcccgagtagctgggattaccatgcccagctaatttttgtattttcaatagagaccgggtttggccatgctggccagactggtctctaactcctgacctcaagtgatccacccccctcggcctcccaaagtgctgggattataggcatgagccaacacgcccggcctaaaacttcgttctttaaaaataagtaaacaaaccaaaaattgaatagacataaaccaaataaggataaaagaaaactctgctttaaaagcctaattccaaaaacctatgagctgcaagtcatcagtgattaaaagctaggaggcacactggatgtttaaaagtagtacctgtgcccttctaaagcagccaaaccagtgaaaatgggtagaagccaataagggggcattcacccctttcaagcatctaaggaatgcacattcaacacattccaagcacacctcccccgctgcaggctgctcaggccagtggccttccacctctagccacattgcacaaaaattaataggaaaacaaaagagatgcctttctggatttgtcacattgcttcacactggtgcccctttctcttgtaatcaggataaagaaagtctctgccgggcggggtggctcgcgcctgtaatcccagcacttgggaggccaaggccggtggatcaccggaggccaggagttcaagaccagcctgaccaacatggcgaaaccctgtctctactgaaaacacaaaattaactgggcgtggtggtgcatgcctgtaatcccagctactcaggaggctggggcaggagaatcacatgaacctgggagctggaggttgcagtgagcagagatcacaccactgtactccagcttgggcaacaagagcaaaactccgtctcaaaaaacaaacaaacaaacaaacaaaacattgcagccccattgtgaaaagcaggaatgtgtgaacccaaaagttctgacaaaggaagtggacggggcagcaggcatagatgaggtagcccgtgtagaaaaactccagaatttgctaggtattttttttcttctggtcactatttagaattctttgcttaaactcccacttccaacttattgtatatatattgtcagctcaagaatggagaagaaggtgtttaactctagattagactacccaacctgtggtttagtagggtaaatagagttcataaacaaaaagccctgtccttaccagtgttcatcaaccacctgcttggactaattgtactatgtcactcgtttttactatacagatatctgtggatatctctccagaacttcatgtatatgtaagtgacttgctcccaattctttcacattttatcaatatcagctgtgttttgcttaaaaaatgagccttacctaactaaaatttctactgtaataaagcaagttaattgtagtgaaatctaattatctgtttactatgatttcattataaatcttgtgggtttttttttcttacattgtccttatgtattagcacctgtggtaagatatattgatcacagtttcatcagataggcatactgcttcaatattgtttgaaaaaaatctttatctttcagcttcatattctaggaggaaccaaatgtaacatttacttttcattttgattgcatattaacttgaggtcataatcttgctttaacaatccatctcttctaattatagatataggaggtatggaagtatgtgtttgccacagaacaaaccctggatatatttccatcttgcttataaaacttgtctttatgtaaatgtttaaataagatattttaggataaatggtttttatcattgcctattatgtcattttctattaaaagtgaattttatacttaattgactctgattcttaaggcattaaattctagtccattcttcttatgagatagggttagtaaaataagttagttttatgggatcaaaagctacaaacaggctgggcatgctggctcatacctgtaatgcctgcactttgggagactaaggcaggaggatcgcttgaggctagaagtttgagaccagccagtgcaatatagcaagacccctgtctctataaagaaaaaaaatcaagtaaaaatatctagaaatatactttccccaaaatgtgtatatttccttatgccattctgccaattaaaaattgtcagttcctggatgttacttggatggtgttttcctaatactaaagctacttattctaggcatttgtgagttttatcattctcaggaagaataaattaactcaagtgtcttgcctttactaataatctatagaagatataatacattacaaaacgagatcttcaaaggcaatttatctatgtctgtgggtcagcggagagacatcaagagttaggagggagtgtacctgtaacattctgaataagattttgatgttaaaaccaatgtggcttgttagtccgatatgtcccctctatgccactaaagatggtgcctactccttaccactcatacttgccatattctttacccatttttacttgactttgtaccccaaagttcctcttgtgggctatgtgtggaatgtgatggcttttaaaaacataaattggggaacaagtgtgaaaataaatatatggacaacattttaaatattctaaatattataatttaaacatcaaaagagttattgtatatgttcaagattgaaagttaaaaagtgaatataaaattctaaataataataactatttcaacatgaacctaaaactgtgcctgttgaacagtgcatagaatattaaatagaattagtaaagagttacttgagtagtgaattacatcctgcattgtcagcctatgatatctatgtccatatattttgtagcctagattcataaaatgtatattttttaaaatcttaacacttttcatcaaatggaatgatttgtttttaatttgattatggatcaatttttaatttgattctagagcctacttaatcattgctttaggttcttaaatttcttttatagaacataggtgagcagatttttagggtttccttttagatggttctgaggtttctgtccatgttcaatactatgagtttataactttacaatattcttttgtcacttgcctaaaagcaggtttgttatttttctttttctcaaggaaagctttagagagagaatctagatcttttaaatttgaaaggcattcatgatacccagttacttcctctaatgattgactactgttgtgaaacctaatgttaatatttaagaagtggaaaattatggattgtattgtaaaatagtcaattaaaagaaaagtatttttgtgtgtgggaatctagcaactttcatcccataatccttaaatcaagtttaatgtatactaaaaatatcaagttttactttgaactattaagattaatacaagactcccatgttttttcagattttcccaatcttcaatgttctaagggatttactctgagactacttaaaccttaacatttttgatgttctcatttactcactggctgttaaaatctcaaaccttgtgcatcaatactaggagctcttacttaaaatgattaattgtaatgttttcaacagtgagcactaatgtttttccttgggggaaaaaaaatcttccttatatgtttatgtggttctcttgcctctgtagttgacttagattaatttctttgctaattttcttgttcagttggataaaagaaagcttcgggctttgtatttcttgaaaaccaagaaaagtaagtattacacataagaaaatatccaattttaccacttcttcccttgggcagttgacccgtgtgcacatgtgcatgcatagcaatcttttgcaatgaactcagtttatatatgagatctgtttttcagtattgtagaaagatatctaatctatttgaaaatacattgtcagcacctagtgttccaaaacatagattgaatttagtgtgggaataccgcatagtattggaagaaaagtaattaaaatcatttagaaattgttttgaagaatgcattgctgcaaggtgtcatagccatataaacatgacaccaccatcttatggaatgtacagaaaaggggtgtctcttgtgccaaataaacattctttaattaacgcttcacaatatgtagtgtgaactttcctagtctgtgtttatccctcctggggctgctacttttaatgcctcaaaaactgttgcctgtatatattctctttctgctggatcttgggatgaagaattgattacaggtgcattttctccttgaatctgtctaataagctgaactaaaactacactaatacaagaaagcaacaagaaaggtcttcttatgatgaattagttgtgcttatatacatataagagttagtgagggccacaagaataaactggcacaataaactatttgtatttgaacactactatttgtattttaatataataattactttgaattccataattaatatacctatacgtgaaacgttttccgctcagcaaagtcatagactttggggggaaaatgttattttattttattgtgagggtttgaataggcattttgctattcattatctatttgcagggaaatgacaagttttcaaaatgaaacagtctttgttacctgtctcttttgaaagacttactctcatgttgtttatttaattgttttgttggcattaatcttgcttttttttaaataatgcatattccttttaattatgtctacttatttaaataaaacttttaaattgtgaatagctatgaatcaccatatccatataactagaatatgaaaatcttaaaaaattaatgtgctgataattataatattcctgtttcttgcatttgttttacattaatacacattctgaaaaagaggaaatgcttatcttgggagtggcttaagttgttttgggcactttttctcagtgatagtcatatattttggagcagccaaaattcatatctctttgccagtgtacagacccaaaatgtcaagttattatgcactagtagaaggacatattttcttcacactttattaattaatctatttcgtgaatttttcttttcaaatgtctatcactgtaattatctttgcttataccaaattcagtttcactggattacttagaatgctgatattcaaatagttttttgaagctcagatttcaggctttgttcagttctacttacagtatttattacgattaatcattattccacctgcctctgagcaccttttacctagtagtagcagaggtgagtccagtctcgtgcaggaagaacaaggatgtgtttggcaggtaagctgattagtgagtctacatcaagtgattgagtcaacagttcataccaacatagctagagcaatgctttttgaactatgggcagctgtccttcctcttgatgcatgcctctttaatcatttccagcattttcttttccatttgttattttcaccagggaagagagagccttataatattagtctgttatgttagctttccatagatgtacacattatttaaatcatatgtaaattagatccatccttcaataaaaattttaaaactagtaaatcatctcctaataatttttcaaaatttaaattactgttaatttcagataaggctaataggcaatggttttcttgttctacaatactcttaacctagaactaagccatgttctctaataaccagatctcaaggtatatgaattttctttcattattggaaacatggttagagtgacctaaagctccaacttattattacatacatggaacccaatctagctagttctttcttatttaaattatctttccttagagccctttcattgttcctcttggggaggacttaaaggttttcttggttctagtcacaatcagaaaatatataatgaattttttacatataaggtgaaagaagtagaggtacattattgcttgaaaacaaggtgtagcacatttttaaaaattactatgttaaatagaatcagcatatgtaaacagaacaccagctaaactacccccacctaaactttaaatgaagacaactgagtaaaatgagtaagatgttttctgacgtaatcactgaagtctcaaaggaaaacaggacagtcacaaaattaccaggtctgatgagttaactacttaaaagtgtgattaaaagccaatggaaatgataggaatggcagcaaaaaagcatcctgaatgtagaaatagaggtacattcaactggccaactggagtaggatttctgttatccaaggctgcgttaagtgattaagaatgcacactagaaggcatggttttcacattatctcaacacatctgctcagtggatgagtagtggatgatatggaggttgtctggtaatcttaaatggaagaggatataagccatgaaacaggagagtgaggaatgtgatagaaatatgtttgaacctcacatgttgttaagttctgaagcccttaggaatttcatcttttaaaattattattatgttccattgttatttctcctcaagaatagactgtgacttttctttcttatcttcatatttttaaaaatagtctctaacacgttttgtacaaaatctctaaggaaattttagggtttctttaaattcttaactcagtatttttcaaggcaaaccattccgaataaaggaacacaacatttctgacatatttgaagtatgtaaaaactctaaattacgtggatcctaatgaatcatagttgcagtttaggtagctatcctaaaaattaggaaggtcaaatactacctctttgtttggaaattccacctccgtgatttgttcatgatagcctttttgtgagaagggttttgactgtaaagaatgaatgaatgagtaagcagtttttattaaacaagctcaactttgttctgttgctgctgtctctttgttgttgtaatgtatgcttctaattcacgcaataccaacatgttttccctctcttcaagaaacaagctttactaaaatactttcacttctaaacaacgtgatacatatatttgaaattttctttgagttaatagaggcctactttagagtgttgtctagaatattgataaaaatctttttaagtatcctcaaagctgcctgaacaggggatgaagggtagtcagaaatagaaatatgccttctattttctcatactatttattgagtattttctaaataataaagggggaaagaagatataaatattatccaaaagaaatacgaaggagaaatgcttgacgtgatggataccctgtttaccctgatgtgattacacagtgcatgcctatgtcaaaatatttcctgtaatccataaatatatatacctactatgtacccataaaaattaaaaactaaacaaatttttccaaggtatatgggcgtatactttcactttacagttgtagaagttggatgcctgaggtttggataaattactgctttcacaagtcagattcctttaaaactggttggggattttgagaatgcatccaatgtatctgctcctgctctagtgaagaagtcctcggctgctgctactcaggacaaaatcatcatggtgcatggaagaaaccagtaaaaggacccgtaaatattagatttttctgacttgttcacttgcctcttcctccttcccataagtgtactcttttttttagggtctatgtgcaagcagttttttttaaatataatcataaaagttgctttttcaaaggagtctaaaatgcatttcatatttgtcattgttttctttaaatctagaactcttttggaagggatatgtaacttgagatggcattgttatagtttggaaactgtattcatctgcttcttcaactcaaaataacagtgccttcagatcctgaaaacttaactacttgtctttatttatttttaccccactacagcttatgtaccgtaatcaataggagttcagactttatcctcgtttttgctgcatttcacatcttcaaaaatcaacaactctgtcaaagaattccagacacataaagccaagtttaagaaatagtcatgaattgggatttttttttctccatttaacaaaatttactttaaaaatagcagggaaaataactccaaatcaatctgttacaaggaaatgttattttatgtttgtatggcgctttttgttttcaatggttttaaagttgcaaaattgatgttccattccacggtggtagtgtaatgcattttcaaaggaagaaaccgaagccttgaggtgttaagtatcctgtctgtagttgcacaatgaacatggcagagagaaaattagaactcagtttctaagttttgttttctttcatctgtctctctttcacatattaaattctcaaattagaagtgtgatgtgctttcaaatttaatttagacccctaaaaaatactttttctgtgatacatttatgcttacttttctatagtctaagtgattattttcaaaaagtttaaaaaagtagttagaaatatgaatgacccaggaatgcaaaaagaagcctccagactgatagattttattctggtaaaactaaaacgctcctggaagttttgttataaatttttttccaagaactgactttattcctctggaaatgacatcatgatgtatcactaagtggtctactttgtcatgaaacttgagactaccacatgggatagaatatttaagttcctgaacttcttaatgacttaagttttcttgaacattaaggtattcagtgactactctcacaggcttactagataatgaaaagtctaatctttagctgaatcttcagtcatataatgtgtagtcagataagaagtgaatagacaacacaatagttaagtaatgagccaatggaaaaatgaatgaatgaaactgacaagcaaagacttgaatgaattcatattagatattatggttttatgcttgatacattatagaattcaaataaaaatggaaaatatctctaggatatcaattattcagttatgccaaagttattcagctgctttaaatcattataaccttctcacttctacagtgttatacaaaggagagaattcaaatagaggaaaaagacacatggaaaaaagtattcattttaacactatacatttgatccccaatatttttggggggtgggggggacggagtctcactccgttgcccaggctggagtgcagtggcactatctcggctcactgcaacctctgcctcccaggttcaagccattctcctgcctcagcctcctgagtagctgagactgcaggatcgtgccaccacacccggctgattttttgtatttttagtagagacggtgtttcaccatgttagccaggatggtctcgatctcctgacctcatgatccacccgcctcggcctcccaaagtgctgggattatgggcgtgagccactgtgcctggccatgttcccaaatttgaagccttagagattctcaacatttgcgaattcgttaaacaaatacattcctgagatgaaatttttcacagctacttaaaatattgattagtccaatagtaacataaaagaaagaacatgagctttgagatcagaaaaacctatatttgcgtcctctgtcacttgcaaaatgttccaaatataaagaaactcctggaatctgtgcgcactgttagtttctttgtagaatcctctctgacctgacacagactacttatcctatggtgtactgagatttaacactgtgcttgcagagagaccaatttaattttgggaggtaatctgactgaagacttaagaaaggaatgaatggaatcagataggccacaatcaaattctggccacttactagtggtaacacattgggtacattacttctttgaagctcagatttcttgtcaataaattgctaacaattaaatactgtttacccagtggatgataaaatgccattatatgtactagcaccgagctaggtatggatttggtattaactacatagtaattgttagcattgttgttgtgtgtcttatgctaatctaaaacttttactcaaaaagattttagtcggtcatttatgcccaaagtattacttcttagtacaccaaacaccctgtctgaccaaacccccaatccaactgcctggccatttttcctagtaacattccttgtataagccagcatttttgcagttctagtcatttcccccaaactgtgtgaattcccagcctgagcctttcctcctgctcagcccacagactatgtcttttctccctcttctagattttcctgttgaacagtccttttccttcaaggtttaactcaagtggagcttcctgctggaagccttctataaagcactcagtatttactgtctttttctcctgtgcttttatagcactttgcatttgatagaatgcttcacactttccatagatcataatttctatatctgactctctaccatatattaaacttcttgaagacagaagctatttttcccttcatttttgtaattcttttagcaacttggtaacttgtgctcagtggatatttataaaatatatgtcaaattaaattcaagtgactgaaagctctagaaataaccttgtgtaacccttcttgacacagatgtgccatttgaagtgcccatttgaatatgattttttaaatttttacatattgaattttcacatacataaagttggttctaaaaggctaaaagtactggtatacttgacacagaatctctcccccctcacatttcattttaatttattgcacagatagaaaactaatgggtacaattatatggatataatctttccatctgggctagttcatgaacaaagcatattaggtaatttacaagctatatcctggcttgcttaaaacagtatctgtaacattttgggaaattttactagttcaagagagggagagataagtgaattgatttacatggtcgatttggaagacttatggatcctctggaaagaaaataaactcaagagttttcaaatataatgtcttacaattctctctttagaaaggaagaaattgtagttctttaaaactgattaactatgaggatggtaagactgggggaaaggataggccaaaacttggcctgaacacgagtgtcagctgatcttgaaagagtttctaattttagtgtaattaaaataaaaatttttaatagcttcacctattgccacataatattaattaggcctccaaagacaagaaaagctcctctatgaaccacttttacgggaatctctgtgccctcttagagtttcaagtgtgcgacttgaaagatttaaactacaaaattctgtgtgtatgtgtgtgtctctctctctgtctctctttctctctctatgtgtgtgtgtctgtctctcacacagacacacacacagacacaaacacacacacacacacacgtaattttctcccaaaaaatttacacccaaattaatggcgtgttcctttttgacaaagactttggctaaaccctcttgtaaaacattctaaaatggctagtgatatctacctactgacaaggagtcagtgtaatcaataacccaatcaaacactcaaaatgcttaactataatcttaggatttttaaatatcctgatcattttcacttggtacttcatattgaatgaatatcaccaagatccaacttgataggctgggcgcagtggctcacgcctgtaaatcacagcactttgggaggccgaggcgggcagatcacgggaggtcaggactttgagacaagcctggccaacatggtgaaaccctgcctctactaaaaatacaaaaattagctgggcgtggtggcaggcgcatgtaatcccagctactgggaggctgaggcaggaagtcacttgaacccggtaggcggagatcgcagtaagccgagttctagccactgcatttcagtctgggcaacagagagagactccgtctcaaaaaacaaaacaaaacaaaacaaaacaaaaaaaacaaagatccaacttgatttaaaaaaaaaaaaaaaaggtggggctggggctggactggccgggcgcagtggctcacgcctgtaatcccggcactttgggagaccgaggtgggtggataaccaggtcaggagatcgagaccatcctggccaacatgatgaaaccccgtctctactgaaaatgcaaaaattagctgggcatggtggctggtgcttgtaatcccagctactcgggaggctgaggcagaacccgggaggcggagcttgcagtgagctgagatagtgccactgcactccatcctggagacggagctagactccgtctcaaaaaaaaagtggctggacttgccagagttgggttggcaaagaaaacccatccaattttaaaatgatcaaggtcattgtagactttgaaaaatctttatttctgtttgtatacaatggtgaacttaaacaattcgtgagaattttgcaagtcagtataagctccaattctccttcttcagaaatggagaagaacttttttaatattacatatttttctttaaataataaagagacaaattaattcctattaaatcttaatttggaagtattgtttgattgtggaagattctagaatgcatgttaagaatctgattttgtctatgagctccttccctgtttccatggttctctccagttctaccttccaatattctcatcatgttatactttatccaaaaagactaaacttttcacccttctctgaatatacattttcattactttccaccaaactacttttaaatatctaaaattctaccactttccaaggagacttatgtgctattacaaacaaaataggcctataaacaaataactaatataaatgaaagctgccttaatcattacaaaaccattattaggattaaaaagcccttactaaatagtaatcaaacataattttagagctagtttaatggcaattatatttcaatacatactttaaaaatgtatgttgtgtctctttaacacctagctctaagaaattaaaattattattatcacaatattttatatatatgactaacaaaaaactcgcaatattaataaaatgccatgtttctctactctttaaaaagagttaagctaatatcaatgtactaagtaataagagtaaaatatgtttgcaaatggacatggaatattcacctatgttagaactttctccttcagtctaccagctcaaatctatatgagaaacctatttttagttcttgtaaaagaataaagcctggcacccatttttagtttagcaagctcatagtgacacatagagcatttttctatagcgttttcatagcatatgttgtatggatcacatactaaatatttattttgtaatttacagtctagaggaattatgaaaaaagaaactgggtaaaaaatattagatcaaactttgataataataagtttaagtaagaaactaacttttgaaatttacatgttagctgggcatatttcaagatatcatctgttgggaaacacctaaaacaagttgttttctagtaagatttaccccccaccgcccccgttttttttcttttagctgaattgttatgtttttttctgaacaagtatttgtgtgacagtttctactgctactggttcagctgacattctatcataaataataaaaattcttggatatttttactcttacaaatatagtaaatcttcacttatattaatatatgtaaattgtacatatataatatatgtaaattgtacatatataatatatgtaaattgtacatatataatatatgtaaattgtacatatataatatatgtaaattgtacatatataatatatgtaaattgtacatatataatatatgtaaattgtacatatatatgtaaattgtacatatataagatatgtaaattgtacatatattatatatgtaaattgtacatatataatatatgtaaattgcacatatataatatatgtaaattgtacatatataatatatgtaaattgtacatatataatatatgtaaattgcacatatattatatgtgtaaattgtacatatataatatgtgtaaattgtacatatataatatatgtaaattgtcatatgttacagatgctttagaaacattgtatatttgaataactatacatcacaggaccacagaattctggaatacgtgtgaattaaaatcattaaaatgtttataaactgaaaactcagtcatgtgaatttacttatgaagaataccttaatatcacagtagagaacagagtatgggagatgtttaattttagtccagttttaaaacaatgatatgtttaactggctgcttacttttaaatgatatattcataaagtttagcaatgttcattcacaaattttccctgtaaatttaactttccctgcactaatcaacaatataagttagtagactctagttacttctggattgcttggttcatatcttaaaaaggagagatttttttaaatggtgtttactcagaaagtaatgacatcttttaagggagaaaatttggcattttacatttcagaagcaacagtattggcagatgtatatcaggattttaaaaattccttgcaaaaatatgcatattccagccagctggaaacaacatgagacctttattctacgggagatctagagaggttgtgtgcctctctagatccccttcctccatatcctacagtgagttaataaccagtggtgggcaagaatgcagatcacctgccttttgggtaggtgtaatttttcattaccttgaaagtcttaaaggtaatcctcgaatatcgaatactttattatttattaaatcacatttctaactgttccagaccatgtttctatagcctgtgtacacagtgattgacacataaaaatcagtcacatttaacaagtgcatgaacttaaacatctttatatgaatttaatatctaattgtgaattgctactcactatgtgatcgccatctgtcattcagcatgaactgagaactatacattatcactatttattggttcaatctttttcaaggcacaatgcctaaggaagttactgattattgatccaccgtaattgaaatgcccacacatttgaaaaaagatggttaatgaaaataacttgtttccctgtatattgatttaactaaagaaagtaaaacgcatttgtgattcgcttgtacattgttttctaaccacaataaaaactgacttgagaagtttgtcagacgtatatatttatttcacaaataggtatctttttgatggcttttgtgaagaaaatgatgcattggaattgatatattgtgcataatataaatgccaataatacacttattcttctagatttttatttattctaagtttatccaattattatgtagggctgtttacatcaaagattgactgcctctggttttgctctggggagtcttagcttttgccctatgtacagctctgtgcttctaaggcagagcaaaagttgttggtgctcgtgggtttctctccttcttgtgccagaatcacttccctgcaagactgcttatggaacattcctaacccacatttgtttctcccaggactctggctcctttgagggatttgccggcctagctggatggaggtattccagctctgctttctttcagataatatttctattcattttatctaaataaaggattatattagctaaaaacgattgaacttgagatatgagtaggtacctttctagtatctggttttgttacaggttcttatggttgattttctgcctgtaatgtagtattttaatagaaccgtctttaaatagcaacaactcctaggaaaaagtttcgaggaaacctatgcaagctttttgaaagaaattggcatttaagtgcttaattcagttagcaactcataaagtctatattgactgggatgcaaatagcctttataagcattaatttcatgacatgaacattttgtagaagtgaatgtagagtttgtagatccttaggcaaatcttcactgtcagttgaatttatttaaagagcttttctggtcacctttgaacctcaatgatttctccagatgtacagaagtgaacaatgtaaaaatcttgctgtttcagcagaactgattccagctggctgggaactggatctgcaagtcattggttacagctgtgtttcgatttatgtgatggttgaaaaaataaattacccgattagatggctggaaagaggactctttgtttagcccttgtgtggggactgaaagtgtttatggtgctgttttctacgcagtctttgcaaagtaagctggacaaatagacttattcaatgcttctaagaaatgttgcatattcagctttaattcttctactaaagaaactgtatttttttatagtgctgtcatccagcaaatgttttaaaggtctagcatttaagagaagcagtacgttttctgtcctactgagcactgcatttagtaattgaaaagcagttttcttttgtttaatgtgtactttaaaacatgtctttgtcaggcacgggaatgggaatacattttctcttaaactcaatactttataatagcaaagtatctgaacataagttctaacttaacccttttcctcagtgagttatggctagtgtcacataagagaaaatacattaattaaattgctgtataaagaaatatagtcaaacattactgtaaaaaattaacatgcctgtgggccacttaggctattaggcttttgaatttgtgaatgttttatttgttataaaagtaaagttttgtatggagagtttggaagagcgttaatcagcatataactttccaggctagtaaaagtcaaaatgctaactcttggagctttggtatacagagcctaacaaaatacctccccaaagagactaatatactaacactatcttgtgtgaggagttttttgtttgttctattgcattatttttttaaggtaacttaacttggatcattctgtttcctaagttataagctgtcagaaccaatgaattgtttacagctcacccagttccactgtggcattaaaaaagtgagcggtggctctggaacagatagctacgatgatatgtcttcatcattattttctcaaacactgatttgctaaatgatttcaatattttttggaaatttatttttttctttaatgctttctaaactcctgaaaagggcccacattcttcagtgaacttgagactgaggccaagcacttgactaggtgtcacaaggtctcctaagttcagtagcagttcagtgtggggaacacccaggaatgtgttatattttccaagaaaatagacaattctttgctatttcctttcttaaacagctatatattatggaatttaaagatgcagaataaataagcataatatatctaataggagacaaaggtgggattgatctgtcttgaattgaaagtcagttttgctatgttacgctattttcttgatcaatgaaagtataccttctaacccttaacaaaatcaatacaattgattggaaaagatagaacaaagcatgagaatgcagaatacacttgaaccttcattattcagaaatatttaaatgatgtttataatgcttagaagcattttccactaactccatgtaatggaagcttctttaaccaagattgaagacctgagtaatagagtttgagaatatgctatagtggcatccttcatagaataacatggtttttgttttttttttttaagttaaactcatctcacattacttatacttctaaaagtgagagcaatttctattactgagcatagagatagcaaagtgaaattcaatcttgaaaataaagtatataaattaatatgaaaaacttagaaaagaaaaaagtatctataaagagagagcactttttaatttaaaataatttactctatattttgtgctcctgctaactgtcataattagtagataaagcattttcttttcttatgaaaagaaccctacaaaattagcatattttttacatgaaagaaaactctaaaaatctagaataaaaatgattatacacagtcagtataataccaatccattaataactttattccccttcaattaaggagcacttgaaaaatgaatattttttgaaaccaaaaaagatgtttttaaagtttttgcaagttgatagagaatttttaacctatgattcacctgtttttctggtttcctttgtattccaaatttcagaaatccacttaaggaggttttataaactatatatcttatcctgacaaattttaaatgccttattaaagctaaagtgtgtctattagatcaatgaatcctaaaatgtttttttaatccacattggctaatttttgcagtcatccaatgaaattatgaggttttctccccagtgcctatgccataactgtgtttacacatttttaaatcttagaaaattactatctagttataaaatgaaaatactttatatagtatttcaaataattaaaaatttcagtgggaataaagtaatctacataaaagatctagtataacattttgaagttgccatattatgcagctaatgtgaaatggtacaattttttttttttttttttttttgagatggagtctcactctgttgcccaggctagagtgcagtggcctgatctcggctcggtgcaacctctgcctcctggctcaagcaattctcctgtttcagcctcctgaatatctgggactacaggcgcacaccacaacgcccagctaatttttgtatttttagtagagatggggtttcaccatattggtcagactggtctcgaactcctgacctcaggtgattgacctgcctcagcctcccaaagtgctgcaattacaggaatgagccaccacgcctggcctgagatcatacacatttttgaaattcagctactaggtgagataccacagggatataggaagaggctatgttattagctttactggggataaatgttactggacagttattatgagggttaaattagataattatgtaaacagatatctaaatagcagatagtaattaccaggatgtgtttccaattgtactgtccttccattgcacaggatttagggctaaattgggctttggagataacctagtcctctctcctcattttaaaaataagagaacttaggttccaagagttaaatgacttatccaagatgatagacattattaattacagaattggcactagaaccagtttttctcactcttagatcagttatttttctactttctcacttcgtttcatggtgttgtacatggcctaccatatggaaaatagtacttttctatagttacgttacttaaaacataaatttttattgatcctgtaccataatattcacagtctaaatacaacagtgattctgaagtcatttgaaggcttctcacttatattcattcttaaaaagccaggattaattattttctctctcacctgttaggaagcacatcaacccagcagaaacattacttattagtatgtacaatatggagaactattgaaaaatactcttccagatttgtgtgtgtatatatatatatatttttttattttatttatttatttttttgagacagaatctcgctctgttacccagggtggcgtgatctcggctcactgcagcatctgcctcctgagttcaagcaattctcctgcctcagcctctagagtagctgtaactacaggtgtgcaccaacaagctcggctaatttttatatttttagtaggatgggttttcaccatgttggccaggctggtcttgagctccttacctcaggtgatccacccgcctctgcctcccaaagtgctgggattacaggagtgagccaccgtgcctggcctcagatttgtatataatttgttagggtataatttttgtggtctccaaattgccccttattatcattccctgccttttccctgaaagagaaacactccaccagcatcctcaagacctagttgttcctatgtgtggttgcacaacaaagttcacatcacttttaactcaagaccttcctcaagttcctcttcttgctctgttccctcatctcagtgtcatctctgtagtgtgctttgaatgaggtccccttgtggatactggtgactaacagactagactggaaagtaggttgtacacttccggagagcagaagaggggagagggcaagaggaaagaaaacagggaagggaagccatgaaaaagagattgctacaatgaattacaacttttttgtattactaaatgcaagaatgaacattagatttttacatgccaggatcattcctaaaaggaggagaaatctctgattatttgtttttccatggtagttgtgatattctacacttacatatatcaaaagaaagagaaagaaagtaatttcaggttggcaaacctattgcatcctggtcataaagtgcctgaatttaacactgagtcattttcttgtccaaatacaaaaatcttgaaagaaaatataggtcaagttttttttttccttgttaaaaaccaatgatctctttcatcgtgaaccttttaaagtaataactcatataaatttacattttacattatttaatttggcttaaaataattattagttctagaatctgatttgtaaatcaaaattgtcataccaaggtacacacacacacacacacacacacacacacactcacaaacacactcgtatcatctgggattttttctcagttaattctgtagaaaattcctaaccagggctgggagtggtggctcatgcctgtaatcccagcactttgggaggacgaggtgggcagaccacaaggtcaggagttcgagaccagcctggccaacatggtgaaacccccgtctcaactaaaaatacaaaaattagacagtcatggtggcatgctcctgtaatcccagctactcacgaggctgaggcaggagaatcacttgaacccgggaagctgaggttgcagtgagccagatcgtgccattgcactccagcctgggcgacagagcaactttccatctgaaaaacaaaaacagaaaaaaagaaaattcccaaccagttcatcctagtccacaagaatctgatttttgtctcccttgtcctttaattactcttccttgtctcctaaaaaaaaaacaaaaaaaaaaaacaaaaaaacagttttgtatgctcctaactgctgattgctccttattttaactggatttttagaaaagacttttttttttttgaatttttgctactcacactactattacatcacttctttattgaaagcagaaatatgtaatatgtgttgtttggctctaaaaagagaatgactgtcatttctggaaaagttagacaagtaaacacctcatatttattcggagactttagcttgagtagtttttttgtgtcttctgatagtattgttatcaactatttcaaagttagtatctatataccctttttccttaagtaatcatgcatatttccagactattagtaaataaaaataatagatactcttcagtcaaaagaaattctattttagatcttcaaataaatcaacatagtttcattctcttaaaagagacttgaaagaaaatattgagatcccataatcaattatgctataaaacttttcacaaggaaaatttaagtcaacagtctcctataaaactttctgcagggttggaaatgttttatatccaggctgttcaaaatggtatccaccaccatgtgcccttctacacatttgaaatatggctagggcaacagaaaaaaaaatgaattttcactttaatttaaatttaaatagctacacgtggctggtcacagcttattggagaatgcaggttaagtaaaacaaagaaaaaatgcaagtaataaacaataaattctgcacatccatgaattttgagtcaaaatttgaactgtagttgattttttgtcttttgtcttctatccttcttactccaaatctcactaaataatttaaatatgatccccttcttagcactgatttcaaatggcgtttataagaaataaaagattcctgccttagtagtcaggtagaaggcaggttgtattaaagtatttcagagtagtcagttattacttcctttaactgaaaatattttttgacattaaattcatatctatcttacttattttttagaaagttaacagaacaaatctccaaaatcacaaaaatagttgatctagcaaggcaatacttgcattatactacttaaattaaatgtaaaacagcatcaaaattttactttgtaaatattttagccatagtcaaagtataaactctgatttagggatgcttttgtattgatgataagatgttaagaattagaagagaccttaaacctgtatatatgacagtggtaattggactaattgattgcaacatcttctttcaaataaatattgatttaatcaagtctgcattcccattggccttaacggaagtcctaccagaagcctgtgcactcggatctggctaacctctatctggatataaatattttaaatgcatggccattcagttctaagtatgaattttttggcgagtatttattcctcttgattttctaaattcctcagttaacattgttatgccttctgtaaagttaaggcctgtgtgtgtgtatatctctgtatgtaatagagagatagcatggattaggggaaaaaaaagttgtatttgcatttgttgtttctgattcacagagctaggagtgcagtgttcatgtggagtccacagagctggaatatcagtaggcagttgctgtaagcacatgttcaattattaaaatagtcaacattttatgtctgatagccatagcgaggtcatgacattaatttatccaaagtattgtgggcaactgtctagaaaaataaatagcataaaggacacagatgccagagaactaaaaaagaaaaaaaaaaaaaggtgggtctgagcaaagagagattaagagatgaccaatttatttaatccacatagaacaggaagaagtcagcaggtgtctcaacgttaatgacaagtattttaagctatgctgcacatgagttaatttttgctttagtttttcattagattctaagcttgttgaatactactcctattcttccatgtcagaaacttaatttcatattttattgttgcttcaatgcttagggattctttgctacctgtttctttctctcctttttcattcttcccttccctcttcccatttctgtgtttccctttcttcttccctgttattattttccttcttgcttttctctctcatgagagtatattcttaattctgtttccttctggtgccaacttctttttctatttttattcttgcgtttgagaggtttctttttccttttgctttcaaatcaggagcctgtaggaactgatcttagagatacataccctactaccgatgcttctatctctttataggttgtgtgatgttttctttggaacctctgcgaatggttgtccttcttgtttgttgccacagatctgttgccaatctgctaccttagttgagcctgcagtgccgcactgcatgctgggatctgtctgtgtgagtaaactgaaatttctacagcaccagacagcattagagttggcttgagaattgccgtactttgcttccctttgtatgtatttcttgtatgctgccgagtcactgatggctagctctgtctggcaagtaattcaaaaatgctgtttatgtagaaaggaaaggtagggactttaccacactctgtcattaaagggagcaattgaagaacaaaggaactgagtaaatacctatatattgccttttgtgttgcgaaacactgtagcacaaacacatttgtgttcagccaaatgttttacttccttttgtaataacgcatatagtaggttgtctccacatatgtacaagaatccatattttatttaaacgtatatagtcaattgttcatatttataggctgcaaacatttctcaatctcaaagacttttacatatccactcccacacagctatttgttattattttaaaagttcttaaattaaaaaaaaaaataaaatatactaatatctctgttggttgattttattaagcaacttaggatttcaacacagtttaaatcatattgatgactcagatcctggcaggtcttacaattcctgtgaaatgagagcacagctaataaaaatattaagcaattacttttattaaaatcatagggtttttttcattatcacatagaaatgattgatctatacagattggtctcactcatgtgtcttttgggctgcttgggagcttcatgtagaagtggaaagtcccctttgctcttccttcgaccaaggtggggaaaatgaaggcatagaatacaatctagggctattaaagaattgctggcattacttctctctatcacgtgtgagcctggctgcctgcttcctgaggtaggggatccaggatgagactgtgccggagcctgtttccacaactgcatttggagatccgtcttattgattagcgggggaaaggggtggggatcaggagtgtgaggtgaggggaggaccaactgacgactggctcaatgaagcacaagacattttcttccggaaagatgtcaaacaactgagaaacagccagagaggaagtagaaaggtggaaaaatgaggagaccctggaagaaatgaaggcatttcctatgagacagccttggggcttttttcttttctttctttttttttgcttccatcatctgacctgcaaaggctagagtgacagcgtcatgcaaatgctgcagtccagcaggtctgggagagggtggatgctagactgtgagttaatgttaatgatgagcgcagtgaaaataccagccgctgccaccccctgctcacagaagcgctctgagtcagcatcagatgctttgcctcgcctctcgctgtgtatctgtatgcctgtgtgcgcgcgcgtgctcgctcgggcatccgtgtctagccgaggggagggggtggcgtgtgagtgcgtggagggtaaaagccagtcagtcagtgagaagcaaaggtacgttggagagcaactaaaatctgactgatttccatctttggagcatcagatgtattccctaaggaggatgggtctccgtgatgggggtggtataattatgttaatgtcatttttatggaggggtgagatttttcattctgataattggttgaatgctatggtcaaaaattgtaaagccatattcagttttagggaaaagcatggacttagatctaagggctgttttattttttcgctttttgtgagtgctgcttttttgtttttttggtttttgttttttaactatttattttaagccataagtgattcagtatgggaaatcaaatgataaacagaaagagatcttatataatgatgcattacatcatggagcagaatatttaaagtcttacaaggcagagtaaagatctggacagggggtggggggtggtggttggaaaggggtgtggtactagggtggaggaggggggccaattaccaaatattttgtgcagtatagctttccttgcagcttacttggaaatggatgattcacctgttctacaggaaaacattctaattctttccatttttttttttttcctcctcttttcccttttaagatcaaccacctcagaagagccagattccacttctgtggccaggacttttacattatggctggtccgattgttttaccctgcgttctatgctactaaaccttggatcattcctaaagtacaaattctgttctcgaaccacaaacaaggctaaaagatcggaggaaattcagtgaatatacaggattggggttgtgtatttttaaaagtattgagctttataatgtaattattcaagaaatagaatcatggtttttttatgatgttgccagcattttaaattacatgtttattaagtggcattgctcaaataactacagagtatgcgtggaaatatttgctgtctgaatagtttggagattcaaagagaaaaatcaagcttcagaggtattaaattatgacatgcagaaaagtttttgttttgttcttaactgcaacggtatatatttaaatccgatttaaagtattatatgtcctgggcccaccttaccagttgtgctgtatagcagtgtaatgggaagcaaaatttcaattagggtcccattaactggcatataatccttctttaatgtaatagaggctatggtgttgctgtacaaatctgctagaagcagattttaacccatgtttagtctctttctttggatctaatggaatgactcttaactgttcattgtctgcattgtttctcatattcttcattattttaaggtctggaattagtctataaatggtcgtcgtgattactcagctcatcctaacttttatatatcatatatatttctactgaagtattttaaatagtatttagaggtaaaagtctaagtgaacccaactgtaatttctaagctatccttatttctggaagaagaattctaccgcatcaaaccagacttttcctagtccctgagaccctaacttgtgaggtattttagtaacatcacaagtcaggctcttgggacctaggcggaggggaaccagcagctttggaccttattgattgtctgcagttaccaccagaacaaaagaacatacatagattctgcctaggagaaaagaacaatgcttttctttatcatcagcaacgttttcaccatgacccatccccaaaaatactattgtcagaaactgtactctaaagtgattacacagttgcactgaaatagcgtttgtattataacgatcatacaaaagcaatataagaaacctgtgtaagaagcaaaattaaaatataagtgttttaaaatgcttcttttggtgcattttaaggtggctagtataagaggatatctcttcagttaatgaagagaggggattatatttataacttttcatatgcattgaaatatatacattagctacttaaataaatcctgtatgcctccatataactatggctcagactatgtcatatacagctataagcatgcttgaggcctagaaataacatgatttacaatcttctttattgaccctattagattttactaccgatttaagaagaatgctgttttatactttgtatttattgccagggcttttctgagtcttctatccaaccaacatactttatatgtcttaacaattctaacaattattttgttacgagagtccaagagtgaaagtttcaccaataatctgggaaaatatgtctttttaaaattttttacagtttactgtgtacatatcatgggcctacgtgagataaaacagtaaacgccacctatgaagtcaaactgctttgactagcaactgcatatgaactgcatagttttagttttataagaattttagctttatcggaggtaactattccaaccataagtaatatgtcatatttgaaagtttaatagccattgccacatcagatatgtctttcttggagatagaatcagtatgctaaatctatttaaaaattttacaataatgttacaaatatcaagattcaaaatggagatgacagactttccttaatagaagcaacaaagtggcttcattcttttaactattgccttagatgggtgccataaattatgtgtcttctgcattgttaaaataaatttatgaatgtattttagaatactgtacggagtctttgttcatctttttaaaaatttcttataatacctacttgaaatattacagaatacaaatcatctattagtcatagttattaaaaattactataacaatatcataaacatacacatctatataaagcatgcagaatatgtttaagcatgtatgcacactgtacctattcagattctttatttatatcatctacttcatttatctagaagttctgaaattttaggtgtgtgtatgtatatgtataaatataagttttaaagctccaaatgaaaggaggtaatataaacagtaaagagctttggtagtatttatcttttatttcttttgacctcattctcattggaattgagtattttttaaaaccataagtttcttaatacaaagaaatctatgtatgtgtgtctacatgtacacagaagcttgattacatttaatagcaatgttcacacaatggatctgaaagtacttcttgtaaaaaagaatatcacatacaagtatgtgtttactaacatctgttttaacatgatcataaataatatctgtgaaaggttccatcaagttagttccaaaacaatgtaaggggtagatgtttattggctatagtgatatcagatataggttattcaaacgtgaaaattttttaatgttatcatattcatgaaccacactatatattaacttctgtctcataaaagaaatataccaaaactgaattgagaatgcagtcatgtttgttcattttcaccataaacatataaaatgttttttactgataatcctgcacaattggaacttctctatgtaaccctcctatatgaacagtctttcaagagcgtcattgacaaagcttttcttttacttcataaaggtgtatatagatttaagtgggtgactttgcttatgtaggctactttatgctgtatgtgcatagacagatgccactttttctgcatttctatctcagctgtcacaggataatattgttttagggctttatgatatgatttggaaaatcagatcatactaagcttaaaataaaaaggagagatctacaacaaagagcgagaaaatgatgtgtgttgcatgcaaaaaaaacagtgatattaacaattcgatggcttcctggttgggagaccagcctgagccagacgcatatattaagggctgtctgctgccgatgtgagcttgctcaatgcggtggaaatgaggaatcatctcctttctgacaccagcttatttgtacattttaattttgaaatagccaatcactgttttacataaatatactaacccctgcctgattcattttctttcccatattgtttgttaatttactgtgaacttcaagttcctttttttggcaaaaaaaatcatcattcaacttcaacatctaccaaagaccaatgaagtattagcttttcttttgtctcttttgtattgctctgataatattgtgatattcatgcttttaacttttaatctctgtaaggaaaacatcaattttccaaaatagcattttttaaagccttttaggatccatcaaggaagccactctggaattttgccaaatctaaatatgattatatttcatttcagggttcatgggatcaatatctttttcagtataaaagtcccaaacactttagtattccagtggagctacagaagaggtgtagagatattcttaaatcatttaagcattaggctacattaatagtgtcttgaagagaaataagtatctcaggagaattatagtacaagttaattactaatgaaattagaaagggtatgttctgccttaaactcctcttcaaatggacaggctggtacatgtgcctaggcttggtctaatacaccttaaatatataaacggttttacaagctgtcatgtttggatgagtttgagaaaagcagtatataaagggttagctaacgcccaaattttcttgccatttacacatgcaatgcagcctacatttctgtaggcagcaaatgcaggcatcattttgattgcttgaattcttttgtttaattttttactagacatttaacttagcactcaaatcccactgatcccttagagactgcatttggataaggaaaacaaagttcctaatatagagaagtttaaaaaaaaaaaaaatcctgggcccttgtaaacatttgagaaatagacttttagtgtagcgctgcaaatacatatttagagtgcagaaacttaggtacctttattatctatcatcatcctggttttcttatctttcagtgaccaactatagagtcggtcacatatttatttcctatatgtctttatttcttgaaaggtttagtaaaaacagtgtaaaaattgacatatcttcataaaatgattcacaccatttcttcaatgagctagcttcaattttcattaaatgttgcttttctccacgtctctacatgttaaatgtaactttatgaagtacattagcagccaataatattaacttgtatgtaatagtttacttgtaggaatttgaaagcaggtggaacttgaaggtaattgagattaagtgaatttaagattaaatagcttcattttatataaacagttaatttcatgcatattttatggacaacttaaaagtgaaaaattctgataaggtgaactaaatttttcattattgatataagtaacgtgactttaaatctgttaccttaataattaatttctaaacaaacaaaacaggtataaaaataatcatggactatattcattaggtcaagtaaataagaataaaaacttcctaggttttgtcttggccatataaggtctttgaggtgttttgggttcttttgtgttgattgatagatttaactttgcctctcttctgagaagtttctccctctttgtcaataggtgtctgatgatttgtgagcctcaagtgactactctgtggaatcatctgtccttgcctttgaattagctttccctaggccatgagtcaacattagtagtttatacatccaaattggtaggtctttatgaaattcttctatgtattcgttctagacatataagtgaagtataagaaattatagatttacattgtggttgtttttacagcttctggacatctttgagaaaatacttgggtggcattgaaacactagccaatggaagcatttgattttgtagaattttgaaatgtagtgccttactcatagtacacttcctagtcttgggggtgggaagaccagtctgtagctaacttattactgtcttatacatcatgctaaagcccagcctgggcatttgtaaacctcggggaggtttctactttagacaacagtttttgttgagggattacaccacagtcagttccctccatttctccctctcttcctggcccccctcccacccaacatggagccttttcaactcttcaaagaagtgggaaaaaaaagtagactctttattaatggcagaaaacaaactggctgctgtacttccgaggcagctctctaataataaagcagagtaggcactgcaacaaagaattcttgaatgtactaaatatatagggaagcctatttaaattcaccagaggggcttagaggacaagcagcagaaagtttagaattcaattcaagccatgccagaaaatgaaaatgtacttaaaaaaggatttctgaaacaattgttcaaagaaatgtcaacttttaaggttctttctagaagaatgaaatttgtactctaatttatgtggtgactttttcaattagagaggaaaagtgattaacagaatctcaaaggaattgtatcttatgtttaaagaaaacgtgttttctttccataggatgttctctagtgagggccacctagtgcactgactaaaaacaaccaaatatatttatgggacaaacagataatgtatttttttttttttttagcaattagacataacaaatgctcatcttactttgacagaaaaatattcaactttatattctttctagttcattttctcacattcagctctacgatttaaaatattttaattgtaactctgaaagagcaatttgctgataaataataggactatgtgtttctaaatttaagagataaaaaagtgatccctaccttatctcttagtgattgagtcaagaaattatcgttgcccattatttacctatctataagacatgtgtttctataaggaatacccacatctataagaatatatattttattaatcacaatgttcactttctttataaaaactgcttataaagatcccagcactttgggaggccgaggtgggcggatcacgaggtcaggagatggagaccatcctggctaacacggtgaaaccccatctctactaaaaatacaaaaaattagccaggcgtggtggcgggtgcctgttgtcccagctactcgggaggctgaggcaggagaatggcgtgaacccgggaggcggagcttgcagtgagccgagatcgcgccactgcactccagcctgggcggcagagcgagactccgtctcaaaaaaaaaaaaaaaaaaaaaaaaaaaactgcttataaattttattcaaggccagtatggtcttgactgatgaatgaaatttcatacaggctttccttaataccttcttttagaagtaacatagatattggaaaaaaaagatcgtttttctttgtcctcaaggattgcaagttttaaagagaatggaggcttggacttgctagtgaccatctttgttgccattgtggagagattctacctgagaatgaaacccacatggaattcatcagttccacagtataatttgtcagcttaaaataagatatttatttattaatgcatctattcttcccaccctcccccaagttctctctgctggctctgcctctccctctcacctgatatgttctccctctttctttctctttctctccagtgttgacttcattctcaggtaagctttctgaatgtggtggcaaagatggccacatacaacttcagacttgcatcatgcgtcatcctacagcctgtgaatccaggaaaaataaacaaacaaaaagattctctttatgccaacatcaatttcagttgtcagaaaatcttggattggctctgttttggtgacatgcccatatgtggatccacttatttgataaacaaggactactctgattggatggccaatgtagggaggcaaaagacgactagcctatcaaggtcatgaggaatgagtgagggtctgtcagtcgtagaaagtgaaaggaatttaaagcaggcgggaatgtaatggaacacacaaccaccactacacattttttaattactgagtataatgatgattgataggcttttgaaaatgtttgtcttggtaaactcactggtacctatcaatgtgtaggcaacattagtttattttgccaaatgtcctcttacagcatggaaactataaaacatctgctgcagcaaatctcaaccttgagtgtcatgagattaattacttttattaacactttccataagcatgtaatatatgacatataccaggaaagtcagcatttggtctcatttaggaatttgaaattttaaaaattatttaagattactagaaattgtttggtaaagaagagatgattatttttttctgtagcctattgtgtctatccttaaccaccatatgatcagaccatttccttacagcaaattttatatcctccccacttttacctctaatgttagagataattagtgctgattcttggaaatttttatttttgtttatgaattaatttcttcctctactactattatacatatatatatgcattatatatacatatgtgtgtgtgtgtttgtgtgtatgatgtatatatgatggctacagttataaaataaggatgttagattcttattccatatcctttaccttgttgctcttttgtttatcatagtatgacctgggtggtttttaacattttaccatcaagaactactatttaggaatctttctcaatgaaaaagagattaatttactatgaataatggttctaatgcaaaacattttgggcttttgttgtgatgcagatgagcaaagccataaatataatttagagagtttgaaaatgtattttaacattcacaattcttcttactaattaatcaaattacaaaattatgctgtggcttccagtatattaaaataagttgtcatatttggaacatctgtttatggtcctattatgaatatgtatttctaaagggctgaaatatagattgccataaataatgtttgcaatttagtccgtggaaaaatgatacctacttcccttcacaatgcttgtttatttcccacgaagtaaatcttccagattgtattttatcattttcttatcaagacggaggaaaaaagactcgggtcttacttaagccttgctgattggttaagaaaagagatggctgtcatcggcagccttgccagacactgtaccgtggctccagacagtcagctggtactatcgctttgtctcaactataaatcacagtctcgtaatggccaaggctgacaccttgacattttcaagaagagtaaaagacctgatttgaatggaaatcaatttcatttcacaaatcttgggtgactactccaagccttttcttgtgtcttcttgagacttatttgggattttcatgatcatcagaggattatttgagtgttatattatgactttttaaagctataaaaccatattcttacttccttcttcattcctaacatgagaaaattgatttttaaagttttatgtaagaaaaatcactaataagcactgatagtttttaaaatggcaatagcagccaatgctgtttagttttgcaaaacttttgtaaaatgttctctgatttaaaagtacaagctgtgtacacacgtatccagattaacctttgattacctgataataaatattagcaattatcaagtgattttgcacttcaatcaagcaggtctcaatgaaacttaaaatcttttgaaaagtattttcacttttacgttcttagacataacaagaaagttttaagccttaaattttaagtattctagagccaatgatgagtaaaaagtacttaattatgttagatgggaccttgcattaaattgcatccgatcttttgaccattcgacccaagtgacacagaaataatttcatactttactagtatgaaaagaaattctttttggggcttttaggagcttggcattgaatgtttaaaatgtttaatatacttattctgttacatctttctcctttagaagaatactaccatttctttaaaagcacggaggggaagacatttcttctttcctggtattttgtcttgatccctctccaagagtgatctaagctcagtaaagccttggtcttctcgacacaatattaatggaaaatgttaaccttacctatctctcttttttaagtatggagggattaccacaatgccttgtgatgatttctcttcatcttcattgttagtcctcaactttgtctcaaatcataattttaaacagataaactttgattgttaaattcattattttgtaaagccctatgaacgagtgaaattacacacagttacaaacaggattcccaacccttaaatctttttattcatccttctatccatctactcattcattcataatctatacagaacatgatcctactgaggtcatgagttcgagaccagcccgaccaacatggaaaaaccccatctctactaaaaatacaaaattagccaggcatggtggcacatgcctgtaatcccagctactcgggaggctgaggcaggagaatcgcttgaacccaggaggcagagggtgtggtgagccgagattgcgccattgcactccagcctgggcaacaagagcaaaactccatcaaaaaaaaaaaaaaagaaaaagaaaaagaaaaagaaaaaagaacacgatcctatgctacgtaggtgggaaatacaaaataaaattagaattctttctttacaaaatacgttcttatgagaatttgtttaaaaaacaaaaaagttatcaagtcagaaagtgatctatccacaaaggagatgtaaacacaacgttctgatgttttgggattctagaaaaggcattttttgttgttgtttttttttttggttgtttgtttttttgatggagtcgctctgtcacccaggctagagtgcagtggcacgatcttggctcccttcaacctctgcctcctgagttcaagcgagtctcctgcttcagcctccagagtagctgggactacaggctcccaccaccacacctggctaattttttgtatttttagtagagatggggtttcaccgtgttagccaggatggtctcgatctcctgacctcatgatccgcctgcctcggcctcccaaagtgctgggtttacaggcgtgagccaccgcgctgggcctgaaaagtcatttattttagtcattgaaaatcaaggacaattccttggtggaggctgcatttagctggtccctagataggaaggatttctagagaaagtgatggaagggcttgggtttctgggagactatacagtatatacaaatgtgcaggaacaggaaagctgggctatgtttggcaatgaatgttgttgcaaagttaggtgcattgttggaaagttagtaattgagtgcctaataaaaagtaagctgaaatcagttgatggagtagctacagagttcagggaggttgtcctggggattgtgcaattttacaatggagtaggcactgaggaccttttaaatatttggggacagacgcaaggatgtaaagtgcaagattaatctgtttccagtcaatatggcttaatactccaatccagaggacctgtcagaattactgagcaagctttatgtagacacaccatttttcctaccccttaaattctgactcactaggtctggggtagagaatgtgcaggtgtgttttgtaaaagctcctagatgactggctaacacacaaattgagaaagagttggatagagaatgctgaaatgagaaaatataagggattattagatagaaataaagactattgcaatgtgtaggaagaacaaaaatggagatataaaccagggtttcctaacatgaatttcacatgcccctagacttttggggttttatattcctatgagagtgcatgtaatattttgagtgtatgtctattttttttctggaaaaggtgatctaaccatgtatataatattttcaaagactaaaatcacccaaaattaagaactactagggccagttagtatgaagtaaatgggagaaagttcatgaatctacaattggaagtatttaatgacagagtagattgcatagggatgaaatttgtggcaagaaagaaaggcagagaagatttcataaagtttttctacctgttgatactaaaagaattagaatcatcatattccttttgtgaattagcattaacttcctcttacacttgtatttcagttaatagaactttgatattaggcatggtgtgaatgtggcaccacaggaagttgttgaagcagtagtgaaaaatttagagatgactacatagcttcagaaatcattcttctagaaacatagttgaacacttttgaagttagggatcaggttgcttccatcttgttgctctagtagaaatgcaaggagaaaaataaaggcactgcactcccttttaaggaaacaatttggatttttataaacagaatctactatgtccttagaacttaatcacaagttacacaaagttttggagcggaggggtgcatgaaaatgcagacttaattctaggtagttatttacccagctaaaaatcagaagaaaaaaagcagtagatattgaagaaaaactatcaacctgtcatagtgaacatcaacaattttgaagcatctgataataaatgaacccaaccataatatgaggacatttatctcaaccttctccttaaataatatattttgcttagaaagatgtacagatttctttataacatatcttatgacacattttaacacctgtcttatacaggtgattcatatcctgaaaagattagaacacttccatgttcaactggaaagataatattactggttgcaaatgcagttaaacctattccaatgttactaagcctactagtcttgaaccattttaaaacaatttaagatattttcacattatctaaagataactaggttttttacaaaataaagtctggggaaggacaaaagaaaaagtaacaaactcttagagatcgatgatagcaaatcttcattttataaaattataaaatgaaaaattccagactaaatagaaaaacaaaaacaactattagtctcatcagccagagaatatctcctattatcatacaatgtaaactcatgtgctctatctctctccaccatcacatacatgcactcaatatttttataatcttttgtaacttgtttttcaattgttatatactgaatactttgccacatattattttatcatatgcttattatgttattgttttatgatacactaatataatttatttaaccagtcagctcacaggtgtacattgaatttactttcaccttatttttaactaatataaacactactatgttgataaatacacatacatataattatatgtagtgattccctgggtatattcattggaacagatgataatggcctgaatgaaggtgatggcagtgggattagcaaggcaaagagggatcagagaaaatttagaaggtagaattaacagagtcaagtgattgactgtatagttgaatgatatctggaaaacttaaaccaaaataattacctcctaacattatgctgttgctctattgttctccgctcatttgatctataacatttctttctttcatgggaaggaagatgcaatcaagaatagaataaacagaagatttgaagtgactggtagattattttttaaacttatagcaagtgtaatgagctctaaacaaattggtctggtttggaagagatagactcacaagaaaaaaaaatggttttacttttaatttctaaagttcatggccagaaatattagcctaatcctagagacctggatcatagaacttatcatagttaactatcaaatagagaagactttaggatatgatctgaaggtagtcatccatcatatagaacaccatgatactttctagactggggtcagtgaagagactagtgtcctagagagagaagaaaaaattgaatataggcaaatattccttatttcactcctagttttacactagtggtcgttagtgtcctagagagaaaagagaaaattgaatataggcaaatattccctatttcactgctagttttacaacctctaggggagggagtgaaaatcagagatgtgtaattccacctttattatacactaaattctcatacattctagaatattctagtccattttaatattgtagatacaatagtaataactattgttctagattttcttttccttttcaagattccttgaaaactggaatctttttttcatggagcttatccaggggtagcataggacatagtcttttttgtttttcctaagtttcattcagactttactttttcttctgtctttatgcagataatcaagtacttgatccttagcagataggctcatttattcacttagtcaacaaatacattaaataccttccatatggaaagcaaattattttaagttgtaaaattaatttcagctacaatttattgtattacatttttttaatgttaattgaacatatcaaggcctttatgcgggttggagcatatgcttcacacagatcgcacttagtattttaagattataattagaaataaacaaagcaggccaggcgcagtaacttatgcctgtaatcctcgcactttgggaggctgaggcaggtggatcacctgaggtcaggagtttgagaccagcctggccaacatggcgaaactccatctctactaaaaatacaaaaattagccaggcgtggtggcgcatgactcccagctacttgggaggctgaggcaggagaattgcttgaacctgggaggcagaggttgcagtgagccaagatcgcaccactgcactccagcttgggtgacagcgagacttttaaaaacaaacacactacaacaacagaacacaaagcacaaacacacagagacacacctacccacaagcctgtaagaaatattgatgatggtgctaaagaaaatgtgtgaagaaacagttcagaaagactgtcgtggcacatcttttcaaaatcattgactaaacacaccaagagaaaaaaaagaatgatttatttgttagtgcttctagtatctttcccaagaattcaagtggaacagagaatccagtgaaatttggtgctttgcatcattactaaactcatatctgcaaggtaatcatgtgtgataaggctaaaatgtaaaagcatttaaatcaatagctctttcagatgttcttctgataaaattgcttcatttactttcctaactaatttatgtaagtgaaaagattaagagaaaaactaatattaggagtaacaggatccaaagaatgtattgaacttcattgttttagttggcatctttgcgagccttttaatgatctgatctcagaaacatctatcttagaaaggggtatactttctggcttcatttacttgaaaataaattaagttagggtcataagcagaggttaggttacttctacctggaaattaatcagaaatttgattttgccctttgtattgcttttctgcccccacatctcaacacaccttctgtcgtacaatcctaaagctccctttcttgcatcgtggcagtttaaaggaatttgaagttgtggatttccatatttacataattatatactgaatatataatataatagggtagggtaaagtgtttttaaaagatgtgacatcttaaagaaaatccacagatatcataagtgagtctaatttattggcaaatttcaggctatgttcttagtcatatttctgctagaagaaaactactttccattttgtgttttctcatttgcattactgcaaagttattcatgcatatgaaaaggatattattcatctctgtattcctttctctccttattccaaacccaatgattttatgagttatacataaagaaacacactgctatatctatatgtttatacatagatatctatgtgattcaaatttggtattacagctggatagcaaccccaagtgataacattatgtgctacatgtgtcttattacatcattaatgatataccaaaattgtcaaatatgttgaaatccaacaattgtaactgacaagctttagcatgatttgcctccattgggaatgaaaaagagatagaggaatgtatttctgaattcttcctcaaagtgcatatggctgtacgataagctcttgtttcttacctgctaatatttttagtgagatgctgttgtcacagtattcatggtaactggtttctgaagtttttatgtgcataaagccatatcatctcctaaattgaaattccagtgatattccagaaggaactatgaaggtgaactggcaagaagaaagatgaccaacctgacagggctttttcctttctctaatgtttgattcttcttatctcaatatcccaaggaaattatttcacttgaaagtttaggcagaatccgcagaaaaaaaaatttctcttttctactctccagttctactcctaccccttagaaaagcaaatggtattccttcaattcttgaaagtttttccttaaaatatcttggcatttgcaaggcagaggaaaatagggttgacagtgaatttcatggacacaaacctcattcatgacaatgatgaggtattcaagatttctcaccctttgtgtcctgctttatgtgtatttagggatggcatgaaggaggagaaagaggaagcttatacttttttctttaaaattaattcccatttagccgttaaagagtggaatcgtttttaagccgggaagacattgtatttgcattttccttttcaataattgtagcagatatgaaagtgaatagacaatggcagtcacatacagaataacctggtttcctagatggacccacttgtcggagatcaaacggctacagcacatttagggttacactctctttcccttcctccttattctcaactgcagtggagcttgttccaaagttgccatggtaacactatatctggctgctagctctgtcgtaagttattgaactgagactggcttttggtttagcagataattaggttctgtctcacaggttcattttcctgtgactgggacgtgaatatgacctacagctggcctcaatttcagtgtcacagacaaaactttaacccttccaagctcctctggcacactcctaagcaccgcttgtgtggtagaggaagtccagtgtatgtcacccataccttgaggaggattaccaagtcctcattttattttttatctttagcataacactaaagaaaatatagtgaaggttgtacacatagagcattttcaaaataaaaaatataacaatgtgatatatagttatgtattttatatatactacatgaaactttttgtagtcatattatttccttgagtctctaataatttttaagtcacactgaaatttcttctgttataattaggaatccacagaatttcaatttcaaaacctctgttctcagaaatattaggtgggtacttttattctcagctttgagaactgtctgccagttcattgacactcctctctctgctcttatataccctgaattatagctgacattaaaaggttccattggagtcacaggcagacccatatgacaggaaacaccgctaccactctactaaatgccaaaatgctcactcagggcttaaatcttgctggcttggaaaaccagctacttcttttgcatgttgtatttggaagatttcaatcagttaaatagctgccctttgtttaagacaaagaaagaaacataactttgggaacagatattgaattcacaatatccatggcaacacagagagctgtggaattgctaagagaagatgtacctttgtatgtcaaacaatgggaaagaccttcaaggaaatctgtttaaaatttttagtgtatgtcacctagaagcttaacatgaaaaggtaagaaaggaatagggagagttgagtttaccagaattaaaacatgagttaaaggaattccataccctaattggccgaaggatcacctaaccatgttaatagtgacaggtaaaatttgtgaaagggaagattagaagattcaacaattgcatattggacttatgatgtgtgtgtgtatgtgtgtgtgtgcgtgtgcgcatgtgcacaggcatatgtcccgcatagactgtactctattttaatccgtgcctttcattctcaaactctagatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaatatgtgaggaactgattgctgtgcattattttccactgaacagaccttcttttaacttctaatctcaagcacatagcagctgttgttttcatattaaagatcagtaagtgtttgttgaatgaatgtataaattcttccccaatctctgttccatgtaataagaactaagttagcattcaattataaagaggacttagaaagtctgcagacatttttgatcaaaaatccttttaactgtcttcttatggttcccggtaacacctaagcccaaaaaactcaggtcatttcttgcctgtactgttgcaatagcctcataataactagtcttctcctttatcaaccacagtcgtctccgctacacaaagaagagagggtgctaatctaaagtgtaaattattttaaatcagcacccttcttgtaatttcccagtggtttttcctgtcataagaataacatgcaaaattccttgcttgcaaagccaggtatgaccttgccccgtctaccttactggcatcgtctctcatgactcttcccctttttcactctccatcttgccttttcccaaccatgcctgctagtgagccttagcccttgtgttttctctgccagggatgcatgactggcttctttactttattctgatctctctgctcaaatgtcatctttttagagatagctttcctaaacatctttaaaagtaccccatgaactgtgaaacacctttcctgctttttcttcatagtacttatcacttcctgatattatgttagacaacaagcaaataagtatatgctgttcccactaaaatataagctccatttgaacaggagccttgattattcctgagtatacccctagtgcccagaacctagtagggctttaataaatattagattcatttgttgaatgaaaaaatgaatgaataattgaataaagatatccaggtagagtgtccgggcagcccaacctatgtgaagccagtacaagaatgtttctgtgacatagtgagcgcaattattcctctaaatgatgaacttgcatgagtacacaaggataaaattaagcacgtagtttagatttctgcaagtctcttcctcagattgaggaaaaacaaagaaattgagcttattctcacctcattcttacatgaactaaatccagaataaagcatcatttaaataccaagcacatccctacctcagccactcatggaatactttatctgtaaagggacagatagatagtaaatatttttggctttggggaccgtacagtctgtgtcgccactactcagcacttctgttgaggtgtggaatcagccctagacaacacataaacaaatgggtgtggctgtgttccaataaaatgttatttataaaactaggaaatcagcagatttagtccacaggctgtagtttgctgacccttgaattagagagtcttccccaaatcctcttcccaagttattgaaagaatgcccataggaccatagctccctcacctggttctttcaagaaatgagacaaattcagggatggttggagggtggaacgcctacctgtgacatgactattgagcctgatttctttccttttatctctttaaagtgagtcaggtcttaactttaaactgtctctaaagtggcaataactgggccatgtcaaatactcccaatgacaaaatttcttcttggagaatgaatgagggttgcatacagtggtgtgttggtaaatgtttagcaactggctctcttactgatttctgtagtgtaaattctcccatcctggccatctgaaactaccaatatgatgtcacttgatgtagagttgggaaaagacagtctcttgaataagtatgagctggttccagcccactgctgaacacatatttaaaagctacaatagctctgctcactgccattgcagagtctggaggaaagagtagcaggcttgataggagcaattggctgaataatcttttgcaatgccaataaataatgaaaaagtatataaatataacgctgtatagaaagctctcaagttcagtgtttggttaaaatacatactcagtaaatggtagctattattgtcttagtttaagttattgcaagcattaaaattaaatgtttagctacagactcaatccagttttaatgtcattgtgttaataaggcctcttaacattgaagcaacaaagataaaggaatttttttgtagctattcacgattctgcccagctcaaggtaaagatagcaacaaaatactccaaccagaataaaagaagtctccacttgactgcagctcttcgcaacacttcacaagggtcaagctgtgttagtttccttcagtgttaaacagaatgcatcttaagagaatagttcaattattgattgaatagtaggttcaagttgactataatcccaactaatacactctaagaccagggatgggccgacagaagggtaaagttttccactcaagtctcgaggcaaacactcagatagaagtagtaatatggatgccttctattatttggtcaatacaatactgttccagcccagttgtgcaaaactggtgaaataaaaggcaaaaatattgacaacagtttgggtaactggattccaaaatgggcatccatctaagag

SEQ ID NO: 2720 - DNA, 415397 bp, Homo sapiens
ttgaactgaaagaacaaatcgcctacttcaggcggtggcaagcgtatggaaattatattagaacttcagcaaagtgcacagctgcataatagagaagccggcactcagattgacaggcaaataagccagcttgtggaaggggcctctgggtggcagctctgggcttttgggtgttggacaaccataggcaaaactgaaatggaacaggggcagaaaatagcacacttttactctacgcaactgttgctttttcatggtgagtgcagatttaagatattatatttaaaatatactttctatgttgtaaaacaagttaagaaatctgttgtgctttgagggaaattatagcaaaagcatttcttagaagttcttagacgatgtggttttgtttctgcttgatttcacactaaccttggtgatgcaaacagaaaaatacaatatttgtattgtctcgtgtgtcctttttctgaaaattgtcctttggtttaaatcatgcttctcttcaacttgaatcagcattgttttaggcaaatcatgtgtgggatagatgatgaaggaacaacggtgtgacagaatatatgtaaacatttcatttagttcgactttgtgtcacttctccacggcttcatgttttgccgccttatcttaggaatatatagcgcagtctgcatgaaaagagctttgtgtgagaattcctggccagttgaagggtcagggcctgtgcgttatctgactgccagcaagatcactggtgtgtcctcttatttttaacttaaaataggaaaaaaaaaagtgcatctttacatattaaaaagtaagtgtgtttgatttcaacagttcccttcttgtagtatgtggatgttattcctggcaaagaattgtttaaatttcttttaggaagcggcatgcaaacttcttttgtttctttttgtcttgtttgctcatatttcattgaaactttacacactttaaaaaaatttgaaatggtaccaagtagtttttattttggtgcaaatattttgaaagttgctaggcttatgttttctggagaacaatgtctcagagtgtaaattttgtttaactccccgtgtagtcatacttataactctactttaaatgtgcttcttattttaaaaatatcagagcctatagagactattcctagaaatgttaatagaaatgtttttctttggcaaaaattgcagattcagttttacaatttattaagtgccaagatatcattgctgttgttgactttgctaaaaaagcaattttattaacaaggtgactgcattagatgttaccaactgagacgaagtgaaacatgtgctttcaccctgttgatctgatgaaatatagaggtctgtgtggttacttcgtgcgtcacattcatttaaactttttaaagagcagctgcgtaatacaaattttgtatactcacttaaaaaataaaatttactagagtaggctcttgtttttggagacttatacattctgtttgctaaagtaaactaagaaactgaaaaaatatattggagttagaagctccaaaactcttcaaagggaagaaagcttttaagaaaaaaatgaatgtgctttcagttataaggcaattttgaagcattacttagctctcttttgcaaagatttaaggaaaaatcaactgttgtggaactaagtaataggcttgcctttatacaaaaattatgtataaaaagaataattattttccgaactgtttctatgatttgatacaagcttccttcaacaattgcaaaatgtgactgacaaatccttttctaagagaacaagttcattatgctctcgtcacctgttacattcattctcccttgcccacatacacagttcctagctgtttattagtgctgcaggaaagtgaaaatattttttttgaaagaaaatgtcaaagattttatttgcatgaatcttttgagctttaaaaaattgtggtcttatcataattgcccaaagtgttttgttaataaggtcttttgttattatcttaatatgaatagtcaggaaaggacatataaatcattttggattttctttcactatatctcaagtaaagttaaggtgtggctgagggtttttaaaaggccaagagattagacctttgaaagtttatcctttttgtataaagatgttttaaaaaatgtttaccacttacctattccctccaaatgaatgtaaagaccaaaaattaaagggaactttattattttacttggttataaagtctaaccacaaggcaggaagttactaggctttggagagacgctacaaaagaatgagcttccctctaatgaaagtacataaatcgtgaaaaactaaagacctacttcttagttctcctaacatttaatcttaaactagtaacgcctgtcttttctttgtatatttacttattgatttgctgctgagacagaggcatcttttaaaaactgaagtcaaccacataattttaataccatgattttaagaaggtgtatattttcttatgtaaagctagtcttccatagatgtttagattacgtatttgattactaggaaacagtggctatatggtcacagattaatatatgctgatctctcttatctatatataaaacatatattcacatacaaacataaacacatatcttgtgcttaggcctctaacatcttaaggcaatgtcttttcctcctagttatgcacttagttttgaagacatgtgtagatgaaataaaacgaaagagtcttctgacaagtgttctgaataaaacaagaaaaaaaaatgcttcaccaatggtgtgaagcgtaacaccaagcgcttgttacagaatatatcactagtgggtttgttgcttttcttatgtatttattaccatattgatgattacttctcctttgcctatagaccaggttggtggtgtgtgtgtgtgtgtgtgtgtgtgtgtgtgtgcacttatgagctcacatagggatgagagagtagcctggacatgtgccagggttatgacactctttgatttacttcttcagttctcttggtcactaaatttcaggctcttctgtacccttgtagcagttgacagctgatacagtgaaatcgtgccttctctttaagagtacatattatatcagctgcattctttcaaatggattgaacaatttatgttaaagatgatttattccatcaaaatatagaaaataatctataggactagatcctatcatcccagacaaattatgggtccttaaagactttcctagagagtagcagtatagttttattcttcttcttactgggtagagagcatagagtttgttcatctttctagacactttgatcttcctgaaattatttccacaattttgatcccacaaagcacaaatattgctttttttttttttttttttttttttgacagagtcttgctctgttgccaaggctggagtgcagtggcgggatctcggctcactgcaacctccccctcccgggttcaaatgattcttctgcttcagcctcctaagtagctgggactgcaggcacccaccaccatgcccggctaatttttttttattattatttttagtagagacggggtttcaccatgttagccaggatggtcttgatctcatgaccttgtgatccgcctaccttggcctctcaaagtgctgggattacaggcatgagccacagtgcctggcactgcttcttttaacattagctctaatctctttttctggaactccataatagatatatgttaaagtttcataatatacatatttcttaaattctctttcacactattttatatatctatctgtgctgcacttttggtgaattactgagacatcttcccatttactaattctttttttgactatgtccactccagaatttatttttttgacaatgtttttcttttctggaaattttaattgattctcatcgccacttcaaatgttttatttctacttactttgttacacattgtattgatgttatttcttgtctcttccaaaatcctagcatgcttattttgaagttattctgaaaccgctctattattttcatgtcttctggaataacttcactgaatgttgtttttaaaattttgctggtgcctttttatatcattctctcatggcttagaattttggttttcaggcttaactggaatgagaaggatttaaaaattctctctctctctctcattgctagcccttctgcaccattcctattgtcttagtgttggctctgtaccctctcgtttcccagtctataatctctgctaatggggatatcaaaaacctagtcactaaatcaaagagcagtctgtcccaggatgtgactgtgagattatggctgcttgctttggcctccccaagaaagcagctctatgcaagccgtggctccaggaaaagggaggtgttagtcagttgttcggcttcctcttgtcttaccttcaggttttaatcagtaagcttggcactgattattactccctgtgggacacatgtggcatccagttactttgcagatacaaggattggcttgcttctcattctagacaccatctggtgcagtgtacctcactttgtgtttatagtttatttctggtatgtttatcttgtttttgactattacttttcttttatatcacctcttttaaaacttatctattattgttacatgttggaagcaaaggcacggggctcaaaccatattattgcaatgccatcttgacaagagttttcaaagccgtgggctttggaatcagaaaacttggtttcaaattctgactcacttatgatctatgtgttaccataagcaaagtctttaatctattataaacctccttttcccttgcaaatattgatagtaatgcctacttcgtatgactgttgtaagcattgaatgtgaaaagatgtggaaagtagttaggcctgtgcttaaacattctgtgcgtgcaaattctggaggtggagaaaaagcaattaaaaccaaaacaaaactagatgttactgattatgtaattaacaaatggtaattggagtatcaaatagacttgcttcttgtattctgagtgaaagtaacactatcatttttgatatctaaagcacatttctaaagatgactgctgactgcatgagtttccacaggtggatcaaagctctgttacactatccacctacaccattcacctaattcagagaatcttaataaaatgaaaagcattcttcagaatgaccctttaggtatggttctctaaatccatgtcacttaagacagatggaaaagaagagagaagtggcatgagaacatgcttgtggcttgatgaatagtaatatatataccacccaggttgggtttctgtaatagtgaaaatggggaggagggtggtgatcttttgtaagtgtttcagacagtcttgttttgttgctttgtagctactttgtaatattgtctcttttaaaaacatatattttgatgacctagcattcaaatttatagcatcagcaaagggtcggtttagttgagtgggaaatgaaattctgaaaacaaaaagttttaaaaataagaaagatggggatgaagataaagaagcagtagtagcaacttggaatttgtcttagaatttgaaaatagaaacaggtttctaagaatcagtcttagtccattttctgttgctataacatgataccacaggctgggataaattataaaccatagatatttatatggctcatggttctggaggctgggaattccaagagaatggcattggtggaagcaagaatgtgagacagatgacagcagagagcccgaggggtagagtcccttttttaaaaaacttttttctattttaagttctgggatacatatgcaggaagtgtaggttttttaacataggtaaacatgtaacatggtggtttgctgcacctgtcgacccataacctaggtattaagcctaacattcattagctattttgcctaatgctctctctccccacaccccatcccccagcaggccctggtgtgtgttgttcccttccctgtgtccatgtattctcattgttcagctcccatttgtaagtgagaacatgtggtgtttggttctctgttcctgccttagtttgctgaggataatggcttccagtctctgcaaaggacatgatctcattcctttttatggctgcatagtattccatggtgtatatgtaccacattttctttatccagtctatcattgatgggcatttgggttgattccatgtctttgctattgtgaatagtgctgcagtgtacatatgcatgcatgtgtctttgcaatagaatgatttatattcctttgggtatatacccagtactgggattgctgggtcaggtggtatttctggttctagatctttgaggattcaccacactgtcttccacagagcttgaactaatttacattccaaccaacaaagaatatttaaagaataagcagaagatgctcctacaaatggaaatgaaaggaagaagctaacctggtggaaggaaagccagtggtttggccatactgcccgaagtatggccttactgcccaaggattcccttttacaacaacccgttcttacaataactaacccagcccagcaataacaatccatttatggaggactccaccctcatgacccaatcacttcttactaagccccacctcttaatactgtttcaatggcaatttagtttccaatgtataaactttgggggacatatttaaaccataacagaagctattgtcaatatgtcctcaggtaggacatttatgaaataagcattttatttttctttcttaccactgggtttccttccaccagattagcttatttctttcatttccatttgaaggcacatcttctgctcattctttaaatattcatgaacttcactgctttttcctgggttgccctctcttacttttctttctcctttgttcatctcatccatctccgtaacttcagataccattataagcccatctctagcctgtttcttgctctcaaactttaagccagtatattcagttagccacaggcacttcatcctcaagacgtctgaattcaaataatcatctttttgccagaatcttttaccatgtcaatccatcatccacctggttgcacaaaacagaaacaagatacgaactttgtcttctctctttctgtctctacaacatttaaggcttttgaaatattgatttctaaccatttctatttttaatcatttttttaaatcacagctacacatttcttactatatgattaatggtggaccacttcagagttgtatcacttgaggacaaggaagctggggtgtgtatctgaaactcctttctgtcattggttgaaggttactcctgtgaccatgaattctagaatcccagcccatctcaaggcaaccctagcatgttcttggctagagaacaccctcaggcagagagtggcaggtgcttgcagtaaaacatcctcaatgtgtaaggaaaatataagtgccaaggttatatgagaacaccgaaaacatctgcattgcacatttcagaggcatttaagttgtttctatgtgtttgctatttcaaacagcattgcaaagaacacaattatatatgcacccttgtgaacatgtatcaaatttttcttaggataatacccaaagtggaatttatatgttgtgagatatatgtggtctcaattttaccacttttccaatcactctctaaaatactgaaatttctctccaagggtagtggacaaatttctatttccatcagcagttgctagcattcccatttgcctcagtcctttccaattctttttttttttttttttttgagacggaattttgctcttgttgcccaggctggagtgcaatggcatgatctcagctcactgcaacctccacttcccaggttcaagcaattctcctgcctcagcctcccaagtagctgggattacaggcatgcgccaccatgccgggctaatttttttttgtagttttagtagagacggggtttctccatgttggtcaggctggtcttgaactcctgacctcagatgatccgcccacctcggcctcccaaagtgctgggattacaggcgtgagctaccacgcccggcctccaattcttaatattgtccaatgttttaacttttatttgttgggtaaatgatattttaaggcttttaaaattttcatatttttgattctaaatgaaaacagaaagatatctagtaaatctctgaaatgaagtgagcgatggagaccttatatacaaaatgcaatacattcatcatttttattataaatgtatctttatttattcaagtgttctcttcagtgaagtgcttccttataactttgacaatctttattaaattgtttatctttttttattgactttttggcatttgctatatacattctgagtgctgatactttgtcttatatgtttcaaataatgtctccaaggctatcccttgattttaaacttttgttatgtttttcttataaagaaggtgttagaaattttaattatttttaagataaacatattcatgttgaaatcacaaaagtagacaatatatagagtgaaaagtctccccaccatccttgtttctcatccactccgctcccactggccccttgtggggttcttgactataaaccaaataaaagcatacaatttacacctccttcaattacatacagtgttttaaaccctgcttttgtcatgcaatgtactgtggagatatttcaagatatgtaaggaactgtgcttcattctatgagggatgaaaatatgaacacaatacacagcctatccactgaaagattagtctgtcataccatgttgagagagtcataaaacactgggaattccaaggggagatatttctttccaactgaaagaatattcttcagaacagttgagaatcatgcatcaaggagatacagtttacttcaacaccagaattttttttaatccaacatctttcctttatttttttctcttgagacagtgtctctctctgtcacccaaactggagtgcaatggcacaatctcagctcactgcaacctccgcctcccaggttcaagcaattctcctgcctcaacctcctgagtagctgggattacaggcacgcaccaccatgcctggctaattttttttgtatttttagtagagacagggtttcaccatgttagtcaggctggtcttgaactcctgacctcaggtgatctgcccgtctctgcctcctacaatgctgggattacaggcatgagccaccgtgtctggtctccagcatcttaaacattaagctttctatagctgagaaaagtgtagcaaatttataactgaagaaaatatatattaagaacctagtacatatcaaacactgtgagaggtatgagggatgtaaaagtgaacaaggcagatagtccttgattttgtgggaggtaaaggctgagagttgaactgcaatgaagatatggtggataaagtgtgttaataaaaaggtattgggggtgtagcatgtggacagggtgcatgggtttcagatggagtcttgttgaaagagtagagagatatgtaagtgagagtaagcaatgttccaggcagaggaaagagatatgaaatattataaaattgagagtctggtgagcttgagaaactgcaaaaagtttaaattgtatggagcaccgagtgctgggagtggcaaagggctgagaaggaggtttggagataaatactggctccctcctgaaaggtctagtttggattatcctaagggcactagagacaaatctaaagggtttaataaggttggcaaatggttgtatattttctttatttagataggaaaatatcctggaacatgagtggtagttaaaccaagataatatgtgccatttctcaagaattttttttaatgctgttactgtagttacttagaggattcgaagataggcttcagagttattaaaaactaccagcgtttatatgctgtataagcactagtataaagaagaatatatgtacatatcctttattaaattctcaaacatttcattgattgaaacattgaaaaatcactagattaaattaagaacagtggttgaccagaaaagtacccttaagaacctttaagaaaagaacctttaagaaaatctttaagttcagagaaataacagagagaatcatggaagccaagtgcatgaaagaagaaaaagattccaaaattaagtcctttacataaaacagttaaattccctcatggtacaagccagcctttctgtgctaatggggccgttctgctcctcaaggtaattcaggagcccaggtttctttcaccttgttgctctctcatcccacaatatgttgccttttaggttgcagacatcactgagttcacatatgaagagaaaaagagccaagtttcggagaccacagcctgtctttaacttgaagacagcctagaaattaaacacagtatttctattctactcatctaattgtagttacacagtcacaactgcatatgagaaaagttgggaaatgtggtttctagctggaaagtcatgtctttaagaagagggacaatgaattttaggtgaataacaagcagttgtcacaccaaccttttaagtttcaaaaactattgagtgattaaataagtttacatactcattaaacaagtatttatcaagtgattgctgtatttggttgattattctatgtgatagcaatatagactttttttttttaagaaaatcattaccaagtggtacatattttagaaaggagagataggtgttaaccaaattaccaaataaatatgtggataaattaagaagtaataagtattaagaaaaaaataaatttaaagaatagaggggctgttttcagatagaatagttagagaagggctttaggttaaaaattgcaaaacgttctttaaaggatacaaaattgagatctccctccttggtcgagattttgcagttgagttgcaagcttagaacagtagttgaaatagggcagggagcgtagctcattggaaggagattcagagttaaagtccaaggagtgttatctttttaatgagtttgggggccgtgattacagcttaatgaacaaatgcatgcagaaatgagattgttgagatacttgtgctgacaggaaggagggaatgatgggtaaataagaagttagcaaagctactgagagtgagggttgtgtggactgattccagttcttgatgtagtcacataaaggcacggagttgttatggaaaccctccaggaagttgagaagtccgagtctagtaggggaggtgtgtcatgagactgaacctgtgctagggcttctctagctgtgtgcactggaagggtacctatactaggtaaagaggaggtggcaatgagagaggtttaagtgaggaatgtaatgtctattctacatagcaaaagaaatagtctttcagaagagaactgactgggaggcgggcatgtggctcatgactgtaatcccagcattttgagaagccgaggtgggtggatcacttgagctcaagagtttgagaccagcctggcaaacatggtgaaaccccatctctactaaaaatacaaaaattagctgggcctggtggcgcatgcctgtaatcccagctactggggaggttgaggcaggaaaatcacttgaaccccgaagccggaggttgcagtgagtggaggtggtgctgttgcagtgagctgagaatgtgccactgtactccagcctgggcaacagagaaagactctgtctcagaaaaaaaaaaaaaaaatgtggcagaagagaactgactggaaccacatgctccagttctagatgatgcctgaatttgtaaagagactaaaaatgtgttccagattatatttttcgtgacaggtttttttctttttaatttaatatttaaaattctaaacttttaatttagttgactctcttgattttgttgtgtggggattgttgtgtagagctgtaaattcatggtcacagttataaagttaggtagataagtcataaaaaatattaagaaattaaaaccctcagtgaatctctattatattctgcatttttttttgttaacatcagccggttcctagtggatttattgattttatttcatgtaataactagggaaacatgtattcctgaaaaaaattaaataatgtttaaaagctatttattgatatagttcatttagcatcatatgcatgatcttttatagtccattcctccgtagatactacatcatagagcaaccagccttcttggctagtatatttttcttgataacttggtttcaatttttttttcgtcctttatgtgtggatatttgcatattcctatttctacttccatctttgtattagaaatgacttcagatataaagaaactatggccagagctataaggatttttgccttttgaaggtaataccttgatatcatgacattttctatgattttaagctttttagtttttatcattttatataaagtattaatcatttctgtttatttgctggttcttggattactccaaaaatatctaatatagaccttttgaggcattgctattgttgtttacttgtttctaagcaagcccattttctctagtatttattttttattagttatttgttaaataactaataaaactgttatttattatttattagtttgtctttcctccaaggacatgaacatgtctttaatattttctcctgttcttttttcagttgcattaacttgtcttatttgacttctcttacctttctttctgcaaagtgtagctgatttctgcattcacgtctcataatttgttactttggagtgaaagtcctgtttgccttcagctcttagcaaaatctgtctttcattaccctatttgtattgccacttcttggtgctttaaaattcttctacactgttccccattgctgacacagttcctctcctcagcagaaattttactccactctctgtaaaatatctgtctcaacaaagaagaggtaaacgttttaaatcttgaagctcaatatggtattctttgacatcagtctcttctatgttaagttttgatatcttatagcaacatttaaatgactttcttattgttctcatcttctcaatcaatattttcttgtcagtcagatttaaattagcaagattagatttcatatattcttgaaggcaggatatcacaaaacaatttagcaagctgtttgcaatcaatattatttatatattcacacactagagattacatagggacaaatataacaggaatatggcccaaatcatctagatttagagccctttaatcaacatttagaattatttacttctgtgggtagaagaaattatcgatatttactaaatgttattaactttttaatcactgttacgcctttagcaaataaatttatttatgtattgggtgattagaaatgactagctacaaacagatatgtagaaaagggacattaatactatacacatacacacacacacacacacacatgcaaagactaatagtgacagatacatgtacatagagagatatacacatatcatactttatggaatgctatattccatatttcatctgcataagtcactgatatactttaagttaaatcatgacaaaatgaattgtatggtttgaaagttccagaatgcaccattaaaaaggaggaatcagagtgtgtattcattggaattcttattttaaagattaattattaatgaatcaagtaatttcaaagtaatattaatcctttttaggaaaatttgagtgggctgactttctttaatatctttgaagccagggaattcagttttttaacatagggaaaattttgtattcatcatcaattttggagcttccaatctttccctggtacttgctagttataggggctcacagataactaagatggttgtatctttttagtccatttcattttgaagaatgtgtgactattgcttttcatgacactgtgtctcatttatttttaattttttcaaataatgacaatctagatgaactttttgggattagtgggtgtttaaatttgttttaagaggggcaatgctacatgttgcctatcagcaatccagaattttttacatgtctaatcactttacagccactatggaaggtgctttgggatctagagccaactatctgagctataattcctattcacacattgctgagttgcagtagggagggttaactaagagagcttccttaatgctttatagaaaaaagcagaatataaataggtttattcagaggataaaagattaccaaatgaatgttagagatgtaggaagcaaggcaagaacattctggattgactgataataaacaatgtatgtgagagcaaataatgtaagagcaaaacatttgtttgactttgagtgatggcaaagattggaatatatggctaggagtttaaaagtttagtcaaatggatttagtggtcagtgagaaggtctgaagaaccaattccatacagaggtagcaaatcccagaagagtaacagtgtccaaatggagaaattgttaaatctaagcagcagcaaaaggctgggttcagcattggaggaaagacgagatggccatgccagccaaggtaaagtcgttccagccaagttatcccagactaaaaccaggagaaaacagaagtaagatttagttctaagggacaggattgtagggaacagttatgacccctgttatatataaagtatggactggggaccttctagttcacagacatttttgccaaattggtaaaagttctcttataaaatctttaactctaggaaaatataattctcaaacacatgagggtaaattcttctgttctataagatgatggacatagaaattatgggaagccaaggccaggtatggtggctcatgcctgtaatcccagcactttgggaggccgagataggcagatcacttgaggtcagagctcgagatcagcctgggcaacatggtgaaaccccgtctctactaaaaatacaaaaatcagccacgcaagttggcgaatgcctgtaatcccagctcttgggaggctgaggcaggagaataacttgaacccaggaggcggaggttgcagtgagccgagatcgcgccactgcactccagcctgggcgacagactaagactctgtctcaaaaaatgaaataaaataaaataaaataaattctgggaacccaaaagagatgggtagaataggaagattcaccttttaaaagtgcattctgagggaaaggaacgtgataacttgacagagatgtttgactgctcctccttctgaatcccctgctaaaaacttcagctgacagtttcagtctcacccagttcaagggcaaaggctactgggccagtggctcatcgacttattgtttccaggggagacgtaagacagtctggaggatgaggagttagtctggaaaagtgaagagggcctgctatagatacagaaactgatgggtagcatccatagttggagcacaggtgcagagggtgtgttcctctgacacagggcaacttgtggtggagtttgacttagaagtgagattgtttgggggatgaaaagggaaagatagatatgaaaagaaaatttccaaatagcaaatatattggtcttctgctgaaaatggctagaacggacatataaactctgagaaacaggaaattcaggaaaggagctaatggtagagagactagaggagcttagtttgggaaataataagtttgtgaggggtgataagaaagccgagaggcaagtccttttggcagttgcaagcaatgaaggagagaagtcaaacctggagatgcgtattttaagagcctatctcaaatgtgcagatcatactggttttcatatatgattttaaaaaaagttaagaaaacatacgttctttaaaatgcaataaggttgtataatattctctctggaccagtaattcacacagccatcacaacacaagtaaaacatgctaatatcttctggtaaactacctttcacaattcaattagataggtattgtaccagctccatttcttaatgtgttcgtttatctcaaatgcaacagtgtggtaggattgtatgtgcctggagaccctgagcatagaaacaggggagaagagaaatgcattaataagtacaaggcttaaactaaatataaagaatttcaatatcacgaacatataatagctttaatcatgcttgttctcaaacattatttatggcagtggtttatgtgattttacttaattaaaaattaggtaaactgatttttaaaaatgtatatataaagaaagcaagctattatttctttgaaaactgagcttttgctttggcaagtcttgataaaagtaagtctctaagaagtatttccattgcataaagtatggacaatacaaatgtaaaagactacacaaattataaaaattcagatgtctgtactgaaatttttttctctagtgactaaattctccattcatttaaaaatatattaaattcaaaattattgatggggcagtttatacacaaaaagcaatagcaataaaattatgcttgatgggcacacaggtaaagaaaactttaactatataaatatacacatatatacatatgtctacattaataacattatttattatagtctccattgtaataattggctgaccaatcagcagacttgctgtgttataaggatatatcagctgatgtaatagataaaaccccagcttcttagaggttcagagcttgttcagattacaatccacgcagtatgccttggacagttttttactccctgattcaaagactgaagttctttccatcttgtagctccaccaatagcaacttccacagttgctattgaagtattagttcacacatggggaaattttatggtctggacctggagcagacccatatatactccactcttcagtgcccagccacatggccataccttgctcaggtgaatctgggcaatgtcatctctctgtgtccctcatgagagccagataacacacgtaggataactttggttgtatgtacaaactctgagccaggcactgtggagagcacttctacaaccagtatacattttctaccctctagattcttagtagttacggaacagaactttccgtaagtcagtgttaatgcaaggctggatttattagcttatacagtagagggataaagactttctcataaggagaaactttttgcaaggggcagtattggaacagagcttgaagcataggcagggactcgtcatcagcagagatagaggctacagcatgaaaagtgacatgacaacaggaaactataaaatggccagagatgagattctatgataggggcagagataaagatatctgaaagatatttgtggactatcacatgacaggccttaagcaccctatttatagttcaggagtcacttcaaaatcttcagcaaatgcttgagaaagaaagcagtgttcagaacaagtagaatggaaagaaattaggaatgggagtagtgcagagcagcttgaactaatgcactgggaatggaaatgagagaacaggcaaaacatttgagaaagtcgatttgaaaaggcagattgtttatgttggtgagtaatccagagattttgtatttcactgacagagtgttctcaatcgttaatccttgggaattatttgatgagttccaaagggcactaacagctaacagtcgatctcattaactaaggatctgttaaaacctgccaaggcaagaattttttctgggtttgacaatgacgtctctgaaagccttgaacttgaagagaagcacagtaaaaatatcttctgttatagccacaagttaccacattttgcaaaacaaaactgaataataaattatataggatagaccatgcccccacctttttaaaaactcattaaaaagtcttttttatctttgtttttccttaaccaaaattatatggctctaatcttctttctacattctcttctagagttatggtcagggtatagatattttttgaaatgatactgaaaggtaacatttcagagagtttgaaggcattatgagtcttgattctgctagacttcagtgaaggaaaaggtaatattggagttcttcttcaatggcacctgtaagtctcatctgcataatcaagaatactgtattcacaccataaagggcactcttgaaatagggttttgagggccattcttttctcatttttatgatgcaggggaagtatttaaacgtttgaggagtaaaatagcctcttctattcccattagacgtagctgcaatttaccacaatgtaaaacatcaaatagtgttgatgtagaatatgtgaagtctcattttcaggtatttgacttaagaatatttttcactggcaactgagactgttagtcctccaagaagatagcctaagtcttgccaagttcaaaatgaaagatcctcctcaactccgtcagagaaggggtaacaaagtttagatgacagccatagagtcataattaacatgtaacttttagattgataatttaaattattccaactttcagaaaaattgtcttactaccctcaaacatattatgtgctatgtataattgttaagcttagaatggcaattggaaatatagtgtggtagcagaattcaagtggaagtgcattaattgtaataaaaaattgtatctaatcatgtggtttcctgttataatgggtagtagtatttatgtgctctttaaacactttgatctaaggtgtaggtttcctttcaataatggatacattccaaaaatatttaaaagggaagaaaaagacatattaaacgtgtttgaaatttacttttattatttcctactcgttgatggtattgagagagtgaagaaaattttgattaagcaagaggaaaaaggactaagttaccagaaaatatgggttttagcttagtttccctccttattggccatgaaacttgtctgagtttttagtttttatccacataaccattctatccacttcacagagttattttgagggccaaattattacatgttttacatacacaaacagtgtataaaatcatttcccttctgaggtcactctagtatttttataacatcatggcttaactccactgacataaatcccatggcctattgttgcgactttctgatcactcatgagtctgtagaggagtcttggtcctcagcctaccgatgagtctgtagaggtgtcttggtcctcagcctaccagtctcggcttttaacacctgggagaatgatacaattccagcaattcagtaaggtaaaatattagggcaatgactgagataaaaaaaaaaagaaagaatataagttttaccctataattggttgctgccaaaggattatttttctacattgcaattcttattacatcacaccactctacttaaaattatctgttaatgttttttcaagtctcttggtttttgattttggcatttcttcaaatctatctcatgtactagaatctgtgatttgagaatttaggctgaaaatgtgtaagaatcaggtgctcttgttaaattttgttgagttggaataaaaccacaacagaatacttttgagtttttaaaaaataaactcccactgatttttaaatagtatgcacttggagggaaaatttttattttgttttgctatgcctcatcaccatttcttttgctctgcaggacagtactacagaaggactaagtatataggaaacttgacttatttaaataaggcagtgaaaaaaatagaatatggggagtaaaacaacctctgaagctaagtctgcatatataataactgggtaagtctttcagtgagtttattgattagtaacaggggtttgatacgtaaaacagagcaaattgcatataggtatgatttgaatgggctaacatacttacaattaatataaaatatttccagattaagaattataagcacacattaaaataagaataaagaaactttttcaggtgtcttgaagaccctgaaggatttagtgagtcatcagtgagacatattaataaggatgagtatatgtatgagtacctgttgggtttgttttcctatcgttttttcactctaagtagtagcatgtattttcttttttctttttgaaatggaggtttgctcttgttgcccaggctggagtgcaatggcatgatctcagctcaccgcaacctccgcctcccacgttcaagtgactctcttacctcagcttcccaagtagctgggattacggccatgcggcattacgccgagctgattttgtattttttttagtagagacaggttttctccatgttggccaggctggtctcaaacttccgacctcaggtgatccacctgcctcggtctcccaaagtgctggaattacaggctgagccaccgcacctggcaggtaggatgtattctctagttcttttacaaaaggaggattttcatttacctgcactttttgttccccaaagagggagtcctggagtctcttggtgtgtatagaaaggcttaaatattttagccagtcctttgtaactttttccttgcttgtcaaaagcaataatattgccatcattgagaaatggtttcaatgatggcgacacttcacagataagaacaagcttattaatcttgggaaactcacaaatgattattgagtctcctagattgctaaaaacaaagaagaattaattttttgtcctgaagatttaaggtaattgtccacagcttaataatcatcaggaagaggataaactcaatcacaggaaatacaacgtagtagtgaaatttgttcaattacagaggaaagttccatcggaaatggtggaaatcctggcacttggaataagcaaaaccaaacaggacaaagtactaaactacaattagtaaggttctaatacagctctaaaaaggaatgcttcctatattgatgataattagttgatgatagattactgagctgaaaacttgacatttgattgctacttttaagtgttaggcaaattaagaggtatggaaaattggacatatcatagtgtaaatgaatttattttctccatggcaggatttggttgcttgtgaacatatagcagattctctaatactcataaggctccctctttcctttaatacgaaggatgtaggagaagttcagcaagcacttatttgttaggttgaattctaaatatggacacagtgcagtcttaaattatgttagaaaaaggacatttggcttagtgagacacattaatcatagtgcagtcttaaatagatctgaggacttacaacagtgcatagatatgtctttaaatcagcagaaattcagaagaacatggcaggttagaaatgataggatgataacttggatttgattatggcaagattaactaagcagctgttgagattggataatgatatgtgaggttctcatcaccctgtaacttgtttccactaatacagattaagaatgtctggaggaactataattatctctgtggctcgtgcataacataattatgttttgccagtgcaaagcattttattaagtggaaaatgatttttaaaaagttatacaagtggctacaagaacaaatcaactaagaacagaaacattggcacttcataatagtaatgtgaaaaatacttatctctttttgttatatggagttttcagaatttaaagccttgtttatatgacagatacatgagggattatttcagtgatgttgaccctcttactgaagtttgtgccccaggtgtccagaccacaaaatagaaaatgcaatctttgtctgccttacataaatacagtactgagatcagcttgtcttttaaatgtctgattgctatttaattacaaaaaatttgtctttaaacagagcacccaaaacaacaaaaaaacagtaaagaactcatttcggagccttgtaatccaccctaccacataaaaagagggtgatatgtctgacaactctctgtataatcaggtttattaagtgatagtcattatgcattttataaacactaccctaaaatatgtaatgtgaatgtatctgttaatcagaaaaagctaactaaaactgaatgcaatgtactcatttccattctggtggcattcttacataatgattttaaagcaactgtgatgagatagaaagagtgttaaagctgtagtgaacaaatgggaattcaaattccagctctgaagtgttccggctggctgagtttcttatactttctgagcctccgtttatccagtagtaaaatgcagctatgaatttctaccccagtgggctgctgagagaattaaatgagataatttatgtgaacaatcttcttagaatatgtttatttaatctgaccttgaaaaataattcacaaaaaatgtgtcagagtaagttttctctcgtctcaaaggagagaatatgaagtagattaagtgacatttttgaaaaaagttccacatttgaaacttttatttataaaattgtgaatttatctttagttatagaataactttcctcttcctttgatctttttaagcgtaatatttagccctctctttattactctgagagaagatgaatattttaaaactatttatatcacatgtctaaaagtatttctcatttttttcttaagctcttttttgaatatttataatttctttcccttttattctcatatttcacacctagtatttctgctttcatttcattaatctttttttaataacttggcacctgggcctgttttgcagctatgtgcagcaatcttaagtactatgtatagtttagttttcaatcagttccttgctgttactttctgcaaataaaaactagcttagctatgcatgtgattaacatggcccaggtattcctattactaggtctttctattactaggtctttctttccttctgtgttatttaatataaggcaaaataggaccctgccgcttaccaagctttcaggatcctccatcttccatcttccactaatcccttcctatgtctctatgaaaaatatatctctaagatggtggttgacaagagtgtgagagtcaaatggtaaggaatattgcttggaaataaggctgaattaataattccagagaaacattgtgaaataacttataggtacataaattcactatatttagatctgcctcatacttttaaaccagcagcatgataattcatagcatggacttatcatcataccatatattgaaacattcctctattgttggatggttatttcatttcctctgcttcattgttttgaacatccctataataatcaccactgtatatgccattttttgcagaagtggaattcctagttaaaagttgaatttcaaaattgttcttgacagtttatacttctagcaacaaagtctctaagtcttactattaagagaaaatgcaagacttagaacaatacattttataaatgacatgtgtattaaaaaagatctattatgtgaatgtatcatataacttgaatgatatacactaaacacttaacctctggggaggaaaataaaattaagaaaaggtggggaaggaaaatttacttcaaatacatttgtattgttcagattttttacaggaaagatgagtttatatactgctatgtgtgtatatatatatataacatatatatatctatatatatatatagatatatatagataaattttttttttttttttttttttttttttttttttttttttttttttttttttggagacggagtctcactctgtcgcccagactggagtgcagtggcgcaatctcggctcactgcaagctcctcctctcaggttcatgccattctcctgcctcagcctcccgagtagccgggactacaggcgcccgccaccacgcctggctaatttttttttgtatttttagtagagatggggtttcactgtgttagccagggtggtctcgatctccagacctcatgatccacccgccttggcctcccaaagtgctgggattacagatgtgagccaccgtgcccagcctactgctatgtatttttaaaataaaattaaaatagagacacaaaggtattactatagtggtatcaaagtaaacagtgtgaaagcatccaacctgaatttcatagctgcagtgtgatggcatttttattcagctatttctaggcatattttaaggtctgagactcaccatatgcactatcatgtaaatttatttttataggtaaaaactgtaaagtaataaaacagtctcagtttccagagcaaatcatatccatctgtactgctgggtaaatgtagttctgattcaaccacatgaataagattacacgtgtttttgaaaatcactatttgctgaagatcataagcaattcacatgctttgtctatggttaattttggtaataagatgcaagacagctcacagatctttaagctatatctagaaatagtgctgattgaatttaagctgattatgcagcttattttggtcgtttgccctcttcctaaattctaaagttcaaagtttaacgtgaaatagttttctcaagtttagctctagccaaagtccatgaaatggcttatgtctgtcaatagttgacctaatagatttgtcctatgttgacactttgttcttttcatactagactgtgcgtatcatgtaggtatgttattttcagtgtgctgtgctttaaaatgggattagaaagtcatggagaattttttgaaaatgttttgatgtgttagtgttttttggtagggttttgggatacatcatttatttattaattaattcattattctgtatttattctagaatgtcatcagtaatgtattgaactaccaatcatgttagtggagataacaaggcaagaccagtatagtgacattagaggcataaaatcaatgggttctataaaatatttgagttgctttataagaactgtgtatcaacaggagtaaagtcatcaagaagaacctcttctaccagtgccatcaagaaagggttcatttatatggggaagctccaacagaatctggatagacagaaataggattctttttcacaggcagggatggagatatgttttagacatggaacatttgagaggataaaagaagcatgaaaccacatgtctggtacctgtgactactaaggcatgtaaataaggcatgctgagagatgagaatgaaggtaaggtggtaaagcaggggtaagattttggaaaccattaaaaaccatgccaaagttcatgaacattttcctttaggcagtgaagatcttttaaggggttttcagcaggagagcaacagagctgtacattttagaaagagccctctggcagaaatgcaggggatgaatggggaatgcacaataagaggcgttaaatgattccttctggtaatattgggacataaaataaagcctgaatggtggggatagagaggaaaggatttgatgcagtatatgttaaggaagtagtagggtgtgtgtgtgtgtgtgtgtgtgtgtgtgtgttttctttctttctttctttttttttttttttttgacagtttcactgtgttacccaagctggagtgcaatggcacaatctcagctcactacaagctccacctcccaggttcaagcaattctcctgcctcagcctccagagtagctgggattacaggtacatgccaccatgcctggctaatttttgtatttttagtagagacggggtttcaccatgttggtcaggctggtctcgaactcccggcctcaggtgatccacctgcctgagccttccaatgtgtcgggattacaggcgtgagccaccacccctggccagaagtagtattaacaagtcaaagtcaatgataaaatttggatgatgtggaagaggcagtagattcccaagcatctgtcttgggttaatgggtagatggtgatgctgttcaccaataggaataggaaaagaggtttgggaggcaagagtgagaagtggttagtgttcagtgtttagctatgttttgtttggagtgtttatgtggcagccaggtggagattccaagtatgcagttcaatatgtgggcccaaaggttagaacacagggacgaattagagatgtagatttgttggtcattgacgtttcataaatgtagtgttaatatcgcacaaagcaaaatgtttagaggaggaagaataacattaggaatagcaacctgccatatatatatatatatatatatatatatatatatatatgacttaccaacataatccatagggtgtcacaattaggagtttattagggacgtttgtgagaccagtctcagtaacatagtggaagtataagtggagcacccactcagtgcatagtagaataaaatacaaatgaaagagttaaaatgaacaggttcatgttcttttttgaggagcttagctatgtaggggaggggaggacattaactggaggaattcacagggtagagggatgcattaattaattagacaagagacacaaaggcattactaatagtctatgggaaaataactggtggagtgagagactgaaaatgtagaagagataggaattactcacaaggcacagatacagcaactctcaacacaatgcagcagaaaaagggcaaactggctattcttattattgagaaaattgtggatgataaaatagaaattatggtatatgaaaggacagcctattaaccacttatatagcaatgttttaaacctgcataggtaaaacggccgaaatggtagtctttcttccaaatctctttccctccaccatatgctagacacacccttttaataaacagcaccacagtctaccttgttgcttcagctgaagacctgagttgtccttgattctcttttccacagtttattctccagacatctcaacttcctatgttcctgtcaatttctactactgcattctaattgaaagtatagttacgttatccccagactacaagagtagcctaacttttctctctgcttatctagagccactccagccccactcttccatctgttctccacttaccagccacaataatatcataaaaaagtaaaccaagtcatgtcactctctggttcaaactcttcaataatgcatagtgggcatgtggtaaattatgactattataatcataattagaattttcctttctctttctctttctcttttggttttctctttaccttcatttaactctataatagcaaagacatttaaaaattggccaatctattctaaacatatgattactggtagatttatagaaaacatattcagcactaatgtgacttatttctgtcataaacatttgactccttgctgttgccttatttgaaaatgacaaatgacaaataagtaaaacggtgtttctgttacttgtgttttatttgacccctcaattcccagtaataagtaagataatactttaaacaatctttgacatttttttctaattagatgacaagcaatctcaatgcatgcaccacgtgtttcaaggatataaattagagtgaatactttaaaaaaatagaataaaagcgggacacactgatatttgacatttttgaaaatctcgaatctcacatccctgatttttataatgacagtgattaggaaaaaaaagcttaatgtaagacaataagctctgagatttttcttagaaatgtactaaatttgattctaggaggagaaggcacttgagaagagcctgttgaagtctcatctgctggagaaaatttactccaagaaaataggatgaaagtgtcaaagacaatagttacaagccttggtggtgcaattgattatgatcttgtaatggtataattctgaaacgatgacacagatagtgtctttatatgatggagctggtccctagaagcagaaggcacagttttcaagttcagaaatttctaattaatatcatgtatatggtgaattacatatatatgtaataatatgtaatataaggttctgtaatatatgtaaggagttttattttatgatatataccataaaatgttccttatgtcctaagtgtatgacaaagaataaaacacttcatatcatagctatgacgttgtggaaaagacacagaactagtagtaaaggagcatgaaccagattccattctatcaatcaccgactatgtgcctgggtttgtctcctctttaaaacatagagaatgcttctcctcaggcgttctctgatgggtccattctatgagctgattctttttggtgaaatcagtcactaattcagtatcctgaatgccatattaaggaggtttagagaaaatctgaaaggtaactatgctaaaacagaggcatttctaagtgaatcaagttggtagtcacattcagaggctttggactcggtcacaaggaagcctaaccaataatcacttcacactgagtaaccattctacatatctttctgttgttataattttaggaacaactgtaattttaggcaaaacttggcaacttggccttatgtttagtaaattattttgggctctttgttttccagatttcaactgatgtttttatagtgacaaaaccatcccaatttgcctcatgtgaaagtcattctaaaataattgatatccaaagtcattaagataatgcaactaaacaggaatgtagttacttatatcttattggtagggagcataaaaatgtaggcacgagaaaggtgttttagtgatctaaagatccaatctgttatttttaaacgatgccattctattttgcaaatgcctactataagcagaacagctgaactcactgccaaatatgaaagagtagttaagaaatgatttgcagaatggatctcaaggtctttattttgctcttgcgtgtggaatctatttgctcatttgcacgtgtggaaattttaatctctacagcatgtttttaagcgtcacactgagcctggaagttaacacagaatcagatcagtaagtaaataaagcatatctttgaaaacatgaaatggaaaaaaaatacttgttttttgaaagttttatctttgcacaaaatgtctatctacatgtcaaagatattcagatgttcagctaagcactttgtaggtcaaaaaatatattttttgcattctgaactcttggcatcttggttaaactttcattctatattaattatacggatggaagagtttattcaatactttaatgaaccaagattattagaattaagcttcatgaaatcaggttctttgtctatcatgttcattactgattccccagtgctcagttagatgcttggaatatattacagctttaataaatatatttcaaaataatgccatggaaagaggcataaaataaagctttgagacttagcctggccatagcactgcttctaagcttagatcttagccaagccatttctctttccttgagtttcattttcctcatcttctaaaaataaggatttttttaaattgatgagagttctctggtcttataaaagtacttgacaattattataccatgtctgaaataacgtgctaatcacaatcttaaaataaatatatttccagaggtgatataattgccaaacatacaaattagctcacctagtatatagactcaaaaagttcagaatgtagatttcctctgatcacacttgaagattatagtgcaattttctcctacagaaagtttgtgaagtaccattaaaaattatgagtgtaggttgtggggaagatagccaaataggaacacctctggtttgcagctcccagctagatcaacacagaaggcgggtgttttcttcatttccaactgacatacctggctcatctcattgggactgattagagagtgggtgcagcctatggagggcgaaacaaagcagagtggggcgttgtcttaccaaggaagcacaaaaggtcgggaactccctcccctagccaagggaagccgtgagggactgtgccgtgaggaatgatgcattctggcccacatacccacagaccaggagactccttcaggtgcctataccaccagggccttgtgcttcaaacatgaaactgggcggctggttgggcagacactgagctagctgcaggagttttttttcatgccccagtggtgtctgaaatgctagcaaagagaactgttcactcccctggaaagggggctgaagccagggaaccaagttgccttgctcagcagatcccactccacaaagcccagcaagctaagatctactggcttgaaattctcgctgccagcacagcagtctgaagtcgacctgggacactcaagcttggtggaaggaggggcatctgctcctactgaggcttgagtaggcagttttctcctcacagtgtaaacaaagccacagggaagcttgaactgggcggaacctactgcagctgggtaaagccactgtagccagactgcctctctacattcttcctctctgggcagggcatctttgaaagaaaggcagcagccacagtcaggggcttatagataaaattcccatctccctgggacagagcacctgggggaaggggcggctgtgggcgcagcttcaaaagacttaaacgttccttcctgccagctctgaagagaggagaggatctcttaacacagcactcaagctctgctaagggacagacttcctcctcaagtgggtccctgatctccatgcctcttgactgggagacacctcccaccaggggtcgacagatacctcatacaggagagctccagctggcatctggcaggtgaccctctgggacgaaacttccagaggaaggagcagacagtaatctttgctgttctgcagcctccactggtgataccaaggcaaatagggtctggggtggacctctagcaaactccagcagacctacagcagaggggcctgactgttggaaggaaaactaacatacagaaaggaatagcatcaaaatcaacaaaaaggacgtccacacccaaacaccatttaaagatcaccaacatcaaagaccaaaggtagataaatccacgaaggtgaggaaaatccagcacgaaaaggctgaaaatgctaaaaaccagaacgcctcttctcctccaaaggatcataacttctcatcagcaagggaacaaaactgcacaaaactggatgagtttgatgaattgacagaggtaggcttcagaaggtggctgataacaaactgctccgaaataaaggagcatgttctaacccaacgcaaggaagctaagaaccttgaaaaaaggttaaatgaattgctaactagaataaccagtttagagaagaacataagtgacctcatggagctgaaaaacagcacaagaacttcgtgaagcatacacaagtatcaatagctgaatcgactgagtggaaaaaagaatatcagagattgaagatcgacttaatgaaataaagcaggaagacaagattagagtaaaaagaatgaaaaggaatgaacaaagcctccaagaaatatggaactatgtgaaaagaccaaacctacgtttgattgacgtacctgaaagtgacagggagaatggaaccaagttggaaaaaactcttcagtatattatccaggagaactttccccacctagcaagacaggccaacattcaaactgaggaaatacagaaaacaccactaagatactcctcgaaaagagcaaccccaagacacataatcatccgattcacaaaggttgaaatgaaggagaaaatgttaagggcagccagagaaaaaggtcaagttacccacaaagggaagcacgtcagactaacagcgggtctctctgcagaaaccctacaagccagaagagagtgggtgccgatatctgaccttcttaaagaaaggaattttcaacccagagtttcatatccagccaaacgaagcttcataagcgaaggagaaataaaattctttaaagacaagcaaatgctgagagattttgtcatcaccaggcctgccttggaagagctcctgaaggaagcactaaatatggaaaggaaaaactggtaccagcaactgcaaaaacataccaaattgtaaagacaattgatactatgaagaaactgcatcaactaatgggcataaaaaccagccagcatcataatgacaggatcaaaatcacacataacaatattaaccttaaatgtaaatgggctaaatgccccaattaaaagacacagactggcaaattggataaaaagtaaagacccattggtgtgctgtattgaggagacacatctcacgtgcaaagacacacaggggctcaaaataaatggatggaggaatatttaccaaacaaatggaaagcaaaaaaaaaaaaaaaaaaaaagggttgcaatcctagtctctgataaaacagactttaaaccaacaaagacaaaaaaagacaaagaaggacattacataatggtaaagggatcaatgcaacaagacaagctaactatcctaaatatataagcacccaatacaggagcacccagattcataaaggaagtttttagagacccacaaggagacttttactccaacacaataatagtgggagactttaacacccactgtcaatattagacagatcaacgagacagaaaattaacaaggacattcaagccttgaactcagctctggaccaagcaaacctaatagacatttacagaagtctctactccaaatcagtagaatatacattttctcagcacattgcacttattctaaaattgaccacataattggaagtaaaacactcctcagcaaatgcaaaagaatgaaaatcaaaacaaacagtctctcagtccacaacacaatcaaattagaactcaggattaagaaactcactcaaaactgcacaactacatggaaactgagcaaccttctcaatgactactgtgtaaataatgaaattaaggcagaaatacataagctttttgaaaccaatgagaacaaagacacaatgtaccagaatctctgggacacagctaaagcagtgtttacagggaaatttatagcactaaatgcccacaggggaaagcaggaaagatctaaaatcaacaccctaacatcacaattaaaagaactagagaagcaagagcaaacaaattcaaaagctagaagaagacaagaaataactaagatcagagcagaactgaagaagatagagacacgaaaaagccttaaaaaatcaataaacacacgagctggtgttttgaaaagattaataaaatagtagacccctagccagagtaataaagaagaaaagagagaagaatcagatagacacaataaaaaatgataaaggagatatcatcattgaccccacaggaatacaaactaccatcagagaatactataaacacctttacgtaaataaactagaaaatctagaaaaaatggataaattcctggacacatacaccctctcaagactaaaccaggaagaagtcaaatcactgaatagaccaataacaagctctgaaagtgaggcagtaattaataccctaccaaccaaaagagcccaggaccagaaggattcacagccaaattctaccagaggtacaaagaggagctggttccatcccttctgaaactatttcaaacaatagaaaaagagggactcttccctaactcattttatgaggtcagcatcatcctgataacaaaacctggcagagacacaacaaaaagaaaagaaaatttcaggccaatatccctgatgaacatcgatgcaaaaatccttaataaaatactgccaaaccgaatccagcagcacatcaaaaagctcatccaccacaatcaagttggcttcatccttggcatacaaggctggttcaacatatgcaaatcaatgatgaaaaacacatgattatgtcaacagatgcagaaaaggcctttgataaaattcaacaccccttcatgctaaaaactctcaataaactaggtagtgatggaacatatctcaaaaaaataagagctatttgtgacaaacccacagctaatatactgaatgggtcaaagctggaagcattccctttgaaaactggcacaagacaaggatgccctcgtgctcaaaataatattggaagttctgggcagagcaatcaggccagagaaagaaatgaaggatattcaaataggaagagaggaagtcaaattgtccctgtttgcagatgacatgattgtatatttagaataactcatcgtctcagtacaaagtctccttaagcaaataaacaacttcagcaaagtgtcaggatacaaaatccatgtgcaaaaattacaagcattcctatacaccaataatagacaaacacagagccaaattatgcatgaactcccattcacaattgctacaaaaggaataaaatacctaggagtccaacttacaagggatgtgaaggacctcttcaaggagaactacaaaccactgttcaaggaagtaagagaggacacaaacaaatggaaaaacattccatgctcatggataggaagacccaatatcatggaaatggccatacagcccaaagtaatttatagattcgatgctattcctatcaagctaccattgactttcttcgcagaattagaaaaaaaactactttaaatttcatatggaacccaaaaggagcctgcatagcccagccaatcctaagcaaaaagaacaaagctggaggcatcaccctacctggcttcaaaatatactacaaggctacaataaccaaaacagcatggtactggtaccaaatagaccaatggaacaggacagaggcctcagaaataatgccacccatctacaaccatctgatctttgacaaacctgacaaaaacgagcagtggggaaaggattccctatttaataaatggtgttgggaaaaccagctagccctatgcagaaaactgaaactggaccccttccttacaccttgtacaaaaattaactcaagatggattaaggacttaaacataagacctaaaaccataaaaaccttagaagaaaacctaggcaataccattcaggacataggcatgggtaaagacttcatgactaaaacaccaaatgtaatagcaataaaagcctaaattgacaattgggatctcattaaactaaagagcttctgcacagcaaaagaaactatcttcagagtgaacaggcaacgtacaaaatgggagaaaatttttgcaatctatccatctgacagagggctaatatccagaatctacaaagaatttaaacaaatttgcaagaaaaaaaaacaaccccattaaaaagtgggtgaagaatatgaacagacacttctcaaaagaagacatttatgcagccaacaaacatatggaaaaaacctcatcatcactggtcattagagaaatgcaaattaaaaccacaatgagataccatctcatgccagttagaatggtgatcattgaaatgtcaggaaacagcagatgctggaaaggatgtggagaaataggaatgcttttacactgttggtgagagtgtaaattaggtcaaccattgtggaagacagtgtggcgattcctgaaggatctagaaccagaaataccatttcacccagcaatcccattactgggtatattcctgaaggattataaaacattctactataaagacacatccacaagtatgtttattgcagcactgttcacaatagcaaagtcatggaaccaacccaaatgcccatcaatgatagactggataaagtaaatgtggcgcatatacaccatggaatactatgcagccataaaaaaggatgagttcatgtcctttgcagggacatggatgaatctagaaaccatcattctcagcagactaacacaggaatagaaaaccaaacaccacatgttctcactcgtaagtgggagtggaacaatgagaacacatggacacagggaaggggacatcacacaccggggcctgttggggcgtgggggggctaggggagggatagcattaggagaaataaatgtacataggtttcacaaaccactatggcacatgtacacctgtgtaataaacctgcacgttctgcacatgtatcccagaacttaaaatataataaaaaaaattatgagcataatggtacagtctctctattttgtttaaggggagtatcaagtcagagtttagagtgaattatttcttttaactgcacagtgtgattcgtgaaggtcagagttgaggttcagtgcagtcaggctggaaaggtagctcctggcaataagaagagtgtgtgaataaataaaagacgtgagctgtttcctaagtttacttaatattcagattaaatgaaaattatgagcctgaatgtaggagtctggaatgaatatgagtcaaagatcacatggaattaatgtattataaaatgatatacaagataggtttaattaatcttcctcaatcattcttatttttcagatcttcaggaattttactgggataattatccaaataaattgcaagcattctatccaaatggtaagcagaacatcttattatgtaatcatatttgtttatccataattaatataactttctgagtattgaaatgagaaacttgatttactcttcttcactcatgttttaatttttttataagaaaaactagaatcactaaagaatttctttttattttatttaaaaattataatcctgagatgcaaatatatgccatgtaagcctgggaactatttaatcactttactctaaaatctggtaaaaggtaaaatttctgaaaataggtgactggcaaacattttgtaaacaatatataagaagaattgtatatcaaaatatacacataaaactatcttttcagataattatgtatcatttattttcttatagcgaaattataaaaatacaacctatagccttccatagatacataattaactatgttttgaaatgatatccaattcagtaccctcatacatttgaaactttgataagctggtctatcttcactttggggatcttcttcattaagagtttgttttctcaagttttgaggtaggatacatgaagtcattcttcttctttataattatgtggcaggaactatctccctgaaaactttatgcttaagtttttgacaatcacactgtcagtcagatggtgcaaagtcttttaatactttttaatataagagagttgtctaaaatacagatagttctccatctgagctcatgacccaagcaatgtgcttcaaaattgcatttattgtatttttcttattacaaatgatactatgttcataatggatagataaattagatacacataaatacaattaaaaagcatattctcaccacctaatgtaacctgttaaccttttgtataaattggtgaatggtttcagtatatgaacacacaacctactgtaaaaattcaagaaatgagtgtgatgatgatgtaaaatgcaggttcaccttctctgtccccacttcctctgcagcttgggtataaatgcctgctccaccacctgttctctgtgtgaactttggcaaatcctttacactctctgggctgtcctttctcatctgcaaaatggagctaataatacatacctagctgaaggggttgtcttgaggatgaaatatgttaatacaagttaggtgtatagaacagtgcctagctcataagtgttagatattacaaaattacctattgtatttgaattattttttagaattcttaagatgtgcctattttgtatacttatatctcatttagctctttattaatggcaattattcttcagttagttattttgtggttccagatagaatatcatattttctaaaaacaataacaattttagatacttttatttttttcctttttagcatcatacttttttctattttgagttcactacttattgccttggctatgtctttcggtgcaacatgaaataactgaataattctttgttctttctgattttattaggaattactttcatgattataatttgagtactgtgttgactatttgtataagttttattctttttcttaagaagtaattatattcttaattaactatatttgatgatcagaagttcctgttgatattctataaatctcaattaaatataaattaatgttttaaaatctgttgagaagatgacttggttctcctctctaggtcagcagatttgctaatattatgttactcttgcatagctggaagcttacttttattacataccttagctcaattcctttttgtttacttgagaattctaaagaatattccaaagtaagaatgatatatactattttttattgcttgatatctatgtggtactattaaggacgttatatccacattgaacttcacaatattttctgtggagttacatatatgtaaaaattacaaataaaataaaaaccttactggtagaatattcagaccacagaatctattttggaggtgaaatttagaaaaaatgttttattaattgttctttgaattttgtaggaattctaccttcattgagttaatttctagtctgacatttaaaaagtattgctcattttgttaagtttttcattttactgccacatatttataaactatagtcttttggtttgcaaagttattgttgaataggtttgatagactcctcatcatttctaatttttatgtgtttttcttcatttttcactgatatttgtgtcagaagtttccctgttttatagcttctctcaaaaagccaaaagtggaattatgtacttgtttgatatatttatcttcctgatttattaattctgcttaatacctagtgtgtgtgtatatatatatatatatatgtatgtatgtatatacacacacacacacacacatatatatatatttatttatttattattttttttgagacgaggtcttgctctgtcgcccagattggagtgcagtggcgcaatctcagctcactacaaccttcgcctcccaggttcaagcaattctcatggtgcctcagcttccttggtagctgagactgcagatgtgtaccaccatgcctggctaatttttgtatttttagtagagatggggtcttgccatgttggccaggctagtctcaaactcctgacctcatgtgatctgctcaggttggtggatcaaagtgctgagattacagacatgagccatcatggctgtccaaaacctagtctatttctaatgccattttttaaattctgagatttatttctatgaaaatatttctaagtgtatcaggttgtatacaccagggtttgaatatgattgattttttaaatgttttggaaatatttgaaaacagtatgtaatccttgtcatagacttatttggatatagttctatcagttcagcacaattcatcataatattcaaatttcatgttcttatattctatttgctggacagagatgaggctagtttgtgcaaattcttaaaatgcccaagtgatccatttggatttatacagtaggcataaaactattgaatataagctggtgagttatatgagtagaccctatataggaagatgaatctttgggggtatgaaagatcaactacagtggcgtacaactaaggccaaatataagatttaaggatctgtttatttcagcatttctacttttaggaatctgaccttagaaatatcttccagtctttgaaggaagggtttagtgttcttaatctttcccaagccaattcccgccatcttctacttttccttcatccagtccatttcctccatcagctttccttctcagtccttttgtgaccttctgtgacatcaacttcttaaatgtaaaatataatgactttcttgtctcatgaattttatcccccacttttatttttagaaactttgatatagcttgtaaaagccaagacaaatttctaccagaattagagatatggcattcatccagccagccatcaaacatttttgaaaaccaactatctgctaggcaccatgctaagaggtagaaaaagctgcctccctacaagagatagaacctttaacctccatacgaaagagctcttaatcttttgcttgaattctccaaagttcagcatctccaactgacattaatatatttttgattcgatgacctgaagacaaccaaaactttaatgagctcagtctttatccctaacctacctctcctactatttcctctcctggttgatggctgatattaatctgtgctagaaacttaataggctgtcaatatataatctttatttaattaatattttatgctgtatctttactctgtcctatccttaaccaaacttcataaaagtcctattgatcacatctttacatgtatcccaaacttctctttacctctgtatttattacctcagttttaggaccacaacatatgctttttgattttttataaaccactaattatttttatatccctacctcttttgtccgtcagctacactcctaccagaatttgcatattatcatgacagtcacccattgaaaagtttttatgattttcgtttgcttagaggaaaaaaccaaaatcctcaggatgcattcagttttcttcacaacccagtaccaagtttatctcttctcaatttattccctttctccatctccatcatcctcattcccctgaatttcatcacatctaattaatgtgcatcatggcttcttcatacttagaccatgttctcacacatagtgggtattcaaccaatgtttgctggtcattattttgaaaaggcaaagggctagattaagcaggagcatatgatcaatcacctgagtgggtcagactgagaagacagtttagttgtttagttgataacttattggaactcttgaagttttatattagaataccatggaaatggaattcataaatacaacttagaaatgacctagtctaagctatgtttcctgaatgttgagacctgaagtatcagggacttgttcagaatgatagttgcagctgtttaatactatgagatttactgctcccgaatctgcggcaactgaggtaaacaatggtttgagtcctgagtaggaatttaagagacatgatgaactgtaactattattgatagaagtagattattctgacttgattccaaactgattgcatacatgtaatttacctccaagggtgtataattatgattttgcctgaggtatctatatggaagtatttatgaggatgcaattttcagggttttttttaaaagcatgtaattggatatttgatttgtaacctctaaaattaaggttagaaatagagtcatgagtgcttcatggaagacttcaaatggagagagagtgaattaatttagtagctgcttcatacaacttggctcaaatagagattgtagtctttctcctagtctttatcatatgaaaagcagccaggatagattttccttgttatatttttgtatagttgaaagttttgaatcaaattttaagtctttacaattgcctttttaaaattttaactgtttgttcttcgttacttctttctaaatgtcaaggtatatttatttactcttaataatgtgatatgtagtattccacaaacattgtcagtgacaaatcttttgaactaaagaatagattgtttgaccattccagtaattaaggaaactagattaaatatacaatggttgcactggtttttcaaacattgatgaagtaaacattattctcaattgacttagtagccagacattcttctcccaagtcttgaaaaataaaatattcaactttctgttcaattgagtggggagagctataaattttgtttcatagctttgtttatattgtctgcatttctctagattttatagttttagaacattataagccttagaaattcaaatgccgttttgcatttaaacttatgaaaaataatttaggcccacactgaagatctgtgaacacttttcttccaaagaggggtcgtactgtttaagtttgagaaacactgtatgaaactagtagcttaaaatatcccttttctaaatgttaagatggttcctattgtacaagggcaagtttctgaatatatagttataaagcctattgatatattgggtagtgtttttttttgtttttttgagtgcatctaacccaatgtccacattgtataaagtgccagagagattgaatgaattatcaagttcgtggactagtcagtgactgacaggacacaactatagtgataaatatatacaaataaacatgacaaagtcattcataataactttaattataacgagagagtcgggtctaatcaaattacatacaggaagagttaaaataactatctgaatattaaaagtaagataaaattttgcttgatgtaggctttctggaatatttaaataaacaaaattctgaaataccctctaataagtatttctctatagagaggtaattatatttaacagcaaaattaacattgatctatattcactgtgatatattttaaatattgttttgaaatactattgtatttatacaatgcaaaggaaagatcgctatttttattaaaagaatgttttcaaaaaatattttaaatttttatttcaaagtgacagttattcaaatgttgaatatgataagtgttttgtcatataacaatgttgtaaaatataaatgatttttatatataaatagaaatatgtcattcatcaagttatatgtaattggccacagctaactctaagtgggaagatttttttctcatcctattacttttttcctgagtatctcaagacataatgcttgtttctgtatttagacttttttagtttcccttgtattttagttagaattatctaattgctgctctcacacaaatgatgttatgtgactagagagaggaatcacgacttacctctttatctccctgtagccccctgtttctcaactttggctgcatgttagaaacactgcagaagattaacaaataatcatgtatgggtgataaatcttgattttactgatagctttacatgtatccacaacttctcaaattatacactttaaatatgtgcagtcttaaaaaaaaaaaaggaaaacatacacttatcatatgacccactaatccccctacttgggggtgggaaggggaaaagtgggagggttcaaatactcaggtcccatttgcagatattctaatgtaattggtcttaagtgaggctcaggctctgatatttattagaaacttcccatgagatcctaatgtgaattcagcattgagagcttctagtgagtactttgcatataagttctcaaaaataattgttctcatgtttttatatatataatgtgtatatatatgtgtgtgtctatatatatatatacacatatatatgagaatatatatctatatctatatatatatatgtgtgtgtgtgtgtgtgtgtgtgtgtgtgtgtgtatatatatatacatacatttttttttagacacaggttctcactctgtcacccaggctggagtgcagtagtcagaccatggctcactccagcctcaaccttctggtcccaagccatcctcctgcctcagcttcccaagtagctgggattataggtgtgatatgatatcacatctggctaatttttattttttgtatagacagggtcttgctatatttcccaggctggtcttgaactcctgtcctcaagcaatcctcctgccttagcctcccaaagtgctggggttacaggtgtgagccaccatacctggcctgtcctcatattttaattgaatatgttttttctttaattacaagtaatgtaacttgggcaacatggcaaaaccccatctctacaaaaaatacaatataattagccaaccgtggtggtgcgctcctgtagtcccagatacttgagaggctgaggtgggaggatcacttgagcctgggatgtctaggctacagtgagccataatcatgccactgcactccagcctgggcaacagagtgagattctgtctcaagaaaaaaaaaattacaataaagccttgaatacatacattgaaaagccttgagatgtataaattatgccagaggaagtccagtaaaagaagtactcccaaatagctttttgcaaatatagacatgccacagccttataggcatacatctttactaagacacatcataaaaacacatctgtgtggtacttttggtgcattttgaataaggactgaaaaaagttcacaaagattggtcagtttgaagtatggaatttaaatcacagttgtcatcttattaatggctactatttttcttgaaatttccattttatatgatatagtagtttgcaaatcactttcatttacatagtatacggtcatttgagtcatatttatttgttttgaacatggactttgatggagacattcccagttttttttaatataaaattcatttctttaaacatcagtttataattgaaaatttcagttttattgaagtttggttccagacagttaaggtttagtagtgtttgcatttttgtctttgtaaaaatatttgcacatttaatttatgattcaatttaatttttctgttatgaacatgagtgggtagcagaaaaaaattagagtgtagacattggtagttagaattgtgggtctcaaaaatggggtataattgagttgacaatctcatactttgtatctagaagagaaactgtggcaagaaacattttatatttattttttgttctttgggtataacctttataatgttaaccttttggaatgtatatattttgtgagtcagaatactatagactatgctgtagtaataaaccatccccatatttcactgatttatctcaacaagggtttacttttcctttctttctttctttctttttctttcttttttttttttttttctgacagtcttgctctgttgcccaggctggagtgcagtggcatgatcttggcccactgcagcctgtgcctcccaggttcaagtgattctcgtgcctcagcctcctgagtagctggtattataggcgcctaccaccatgcccagccaatttttatatttttagtagaggcagggtttcaccatgttggccaggctggtttcgaattcctgacctcgagtgatctgtccacctcggcctcccaaggtgctagatttacaggcgtgagtcaccacccccagcaggtttacttttcatttatagagcaaggggtactcagcatgttatagttacttggagcccagactcagggaggcaccgtattgactcatgtgacagggaaagggacactgatgaacagcagttcactgttaacacatgtcacatgggtacttctcattcaaaaggggtgagaaagtacattcctactatgtgcctgggaggagaggagaattggagtgtttgtaaacgagtcctagagagacccacaaacgtcttctgatggatgagataccggatgacagcgtatctttttcttctcaacataagcctgtattgtaaggaaggtagaatcttatcattgcaccttctcagataggaagttgagaatcagaatgcctggacagcgtcactatacacccacagctagtgagtagagggatcaggtttattatgtctttacagcataattatgtctccatatatttcattgatatgaaacctgtactgtgttctgctactttacattctatgatccttttatataattgctactttattttataatcaaacaaagagccagtttatgataagcatagattcttaggtttaagtgtgtaaatttataactattaccatcggtttgtcttttatactttcctttaaataatattttttagtgttaaaaattattcctaccttcagtccacctttacattttcgctaaaaaatattctgttaagttgaaaaacgaagcaaatcattgccactggacaccatatttatatcactgggaatgatgttgtttctcaataggatttgattttatctgaaattccaatgtttccaccgacaatataaagaaaaaacaaaaacaagaacaatctgctaatgaacagtttctgaagggacagaagggaagttttccaaatgcaaagctcagccaaaagggagaatttattgttgttgttgtttatttgtttcctgagacagagtctcactatgttgcccaggctggacttgaactgctgggttcaaatgatcctcctgcctcagcctcccaagtagctaggattctaggcaggtgccaccagaccagctcaatggggaggtttactaatgcaattttgctacaccaaaatggtggcatctatttatttacttattttaaataggaagaagtcagaagacttaatgaatcaagcattacttataattatattttttaatacaacgctttgagcatggacttaaaaatgcagagatgaaatataagagcttcttggaagcaaacattgttggacagacttataatgtgtcaggattttcaaactcattttctataactttccaaagatgctgtcaaatgaaggatgagtcaggttttccataaaaacatcattctaattttgtaaaacggtgtggctcaaaactataaattgggctgccaaactatttctctcaaatgtttgatggtttgggaacatgtagaatccattatattttcttcattaaaggactccatataataaagtgatttattgtgacaatttaatttattgtgataatttaatgtttgtgattcaatggaaaaacatcattcttttcataaatgtgatgtaataacataatattcatcactgggtgcacaaaagaagtttatggatatatgactctgctgctaagctatcagaaggattcgtgcccctgtcactccacacacgctttagaaagataacagccatgatttttgatatgtaaagtcccaaccattgtgtgttcaggaatctgtctgcatcatgacacaacggtggaactaagccataatgaatgatttagctctgtttcctctttcttcacaatgtgcccatgattctcataccaatatgcctttcttggacttatctctgaagtctgtaggagataacttcctccccattactagccagcagggtggcctgagtttccttgtctggagctgcaggatatttgttctatcctgtttacagccaatggggggccctttttcttccctacagtgagccttttcatctgcacagagggagatacaaaatcggaaatgatcttaattaaatgttttccgtccagaaacaactagtccactaccttgatctggcggaccttcttggaggtgccccttcccacctccctctgtggtgagattgcaggtaatagaccttatgacaaaagacaaggataaatatttatcagggcaccgaagaatttttgagtatctacaattatttacattcattcctgtgaacacatttaaccatgtgaggtgttattagtactccccgctgacattttttcctttataatattttcaaataaaattgtatcccctgaacaaattacaaaagtgcctttaaatatccagaataaatattttgagaatattcattttaaggttcaagtttctaaagtaccctattcgatgctaagttattgcaatatctgtcgtttagaggaacttgtaggtttattagctctataatgtcaacattcgcagatatgaagcattttatatttcttagtgatgtataaatgtatgaggaatacatgaaaatgcaacaagattttggttggcttaataatgagtttctttcttaaagatcaagataaaaattctgaatttctattgttctgtttttaaaattataaacttaaatgtatctagctccaatgtaaactctacattgccaactttttggaatatgaatataatgaaagtttatatctggttagttgtgaaaaaaattattattctatcatgtaaagaacatagaatttattaaggagatattacttaattggtagattattcacaagttttagctgaattgatttttttaaggaaaaaattatgtgaggaatttaacatatttgttttggtagaaacatgttttgacagaggaattttatacttagataaaatatcagtttcatataaacaaatcataacttttaaattataagtacatcttataatttttatgttttcacgtccatagattatttattgatagataaatagatggatagaaaaatttgcaaagttcagatttttttagtgataatctaattttttaaataaaatgatttaatatttgcacagtaaatgtgatgaaaactttgtgtacagatataaggtcctgtggtttggggtttcctttttgtccaaaaggcattgttctatgtgaattagacataccgatttaatattctaattcaatgcctataaaaccaacctttatttaattctctgctttctgcaattcctcaaggagtgaaaaaatagactgtgacttctttaaaagaggcattttgttaaaagaataaaatgtcttttgaaatattagtgaagtactagtattttaatacccttttttaaaaaaaacaattaaagaatcctatgattatttcttttccctatctcaaaaccaagcatattttcaagtaaaattaaatatatttgaatctacactttataatattacaataaaggaaagaaatagttatcattactacatttggagatttttttaaatgtagtttctcgttgaaagaatttactttcaaccacaagaagttgattattctgtgtgtttttatcagataggctttatataatttcttgtatctcataaggaagtccatgcataatagacaaagcatccaagaacacaaacttaatgaaaaaccagcttttgttgagatggtttcactccagtaaccttggaagtgttggcgagtaatttgagttttagtgacaagattctgttgctgctagggatggttttggccatttgataggctgagtttttacaagaataatttactgtgtttacagacagcttaggtcttattagggaatattaacccttcccccaagtttaggttctatgtgtgcgtaaattaagagatctatttctgttttggaaagcacacagtatattttaaatataatttttaaatgtaatttttaaaagaaaggctctattttagccttctaaattatatcttctatatacacttggtattgctgaataaccaaaattagctttcgcttttcttgctggaaatttgtaattttcttaacatattctttctgttctgagtaaaagtaaataaaggtaattaaaatacagtatttttttaaaaacttttgaaaaggttcatcttttaaattcttcaatgatatgtaaaagtttctacctatgaatttattttttgttactgataaatttgtattaaataattgatgcctaaaatatatatttagtagaataaagaaattagctataaaacaaaattagaagagccacaaactagacagggcactgtggctcatgtgtgtaattccagcactttgagaagccgaggcaggtggatcacctgaggtcaggagttcgaggccagcctggccaacatggcgaaaccctttttctactgaaaatacaaaaattacccaggcatggtggcaggcatctgtaattccagctacttgggaggctgaggcaggagaatcactagaacccgagaggtggaggttgcagtgagctgagattgtgccactgcactccaacctggtgacagagggagactctgcctaaaataaaataaaaataattaaaaaaaaaaaaagagccacaaactaaagtctggttgggttgggttccattgcctttgctcagaatgtaagctgctactatctaggtacatcagctgtacatatgtcttgtagccctttagggtctcagaatttgtctctgaaaataagaggattggataaaaaaaaaaaaaagctcagtactattttataattccagatgacaagctgaaggatcaagtctttagcttcttaaaattgttatagaggatattgaaaatgttattactaaatttggagtgaacatacatgaaaacattgattctttttatttttgttttgaaaatagttaaaaataaaaacaaggggaatttattatgtcaatctcacaatttataaagcttgatattttgagttgcaagtaaaattaaatataaaaatctttattaattctgtcacattagtagaggtctcaatgctgtgaaagtccatgtctaaattatgacaaaattattttcaaccatatcagcattgtttcagaagaaaagatcacaactaaatttacttacagcaatcttacaggtttaagttttattgcgatttcaaaaacaaaataatttcactatcaaattaaaaacaattcattcttttatccagaaagatagacattaatttgaattaataacatatttctgttttttatgttgcaatttctttcctaaagatataaaatcttgtgccaactgtcagaaaaaggaaggatgagattattaatatgtgcaatgtgaatcaaaaatgattcaagagaaattatatgtatatcaggaaacttcttgttctttcttattgatgctaaagcagggtggtgatgacttgaggtataatttagttaacactatttagatatatattgtcaaatttagaaacacatttgtagtaatataatatatcatatatgacatgcttttctgagggatttgtgataatagtaggtttcatgaaaatctctcaagaagacattgatttttttaccaaaaggtaaggctttatatctatagtatggggatgtaaacataattatcaaatgaatatttgattcgaatgatttatttgatattcacataaatcaaatgatttatttgatatttatgaatgtgatattcatattcatcaaataaatttgatattgatgaatatcaaataaatggcaaagaaaatatttatgatgagatgaacttttttttattcacatcagatgttctatacctagtattattaccttttgtcactcatcaacaaaaggtagtattgagttgttttcttactggcactttaaaatattatgcactattaattttcttcagtaaaatttaatctacttaatctgctcttataattatattctgtgatgttttccaatacaaatagttattccaaccacttttagaacttgtttcctttccaatgtcctttcatagcatcttttagtataaaacaacctttgggataaatattaataacatcaagtcaacacacagagtgcctattcatctttgttcattatatcacttgctctatttagatgaaaatcatataatcaaaaatgccaatatattgtctgtgtgacaaagtgtctccaatgacacatttagtataaaagccatgttgtactaatctgagaatagaatagatctatatctcattctaataataattctcaatgaatagtgtggctctttcaactgatgcattaaacagataaagatatttcttggagagttcagtcagttggctatgccgccagttataacagaaaccaattttcaagccgtgagttcttgttttttgttttttaccaaaggtactgtttccgtacactggtattaaaaaaatggattattctttttgatataactaagatgaaacattttttcattttttcctgtgattttcagtttgtcatttattattatatttaccagttttcgtttctatgtgccttacacacaactctcacaaactttgtttctccatttgctttactctttttttaatcaatctgtctagtttgtcctgatgaaaccaagtaccatagacagggtggcttataaacaacataaagttatttctcacagttctggaatcagggaagtgcaagatcagggtaccagcatggttggattctggtgagggtcctcttccaggttgcagactgccatctgctcattgtattctcacatggcagaaagaggactggagggctctctggggtatctttcataagagcactaatcccactgacgagagctccactttcatgatctaattaccccccaaaggccccaactcctcatatcagcacattggaggttaggatttcaacatatacatttctgggcaatgtatacaattccattggacagtcttacaatcttttcagtgtttacatgcataatttactgcaagacttggaatgaaacttcttagctttgcttggtctatataatatgcttcatcttaagcaagctctacattactagtgatgttaaatttcagtaaatggaaaaattccttgagaatactatattctctttcattatccaaatacctctaattttacaatttgatcagtgttcctgcccgtgtacaacccaattgaattacattggatgtaattgccagtttttaaaatatatctttggattaaaagataaatattatgaaggaccctgtctcattgtgccatcagtatatcatggctgagactatctcagataagataatgtattagtcgtctgcttcctaggaaaatgaacactaaaatgaaatatggaagaaatggattctgagtgttaaatgtgagaaacaaggtttatactgaacattctaagccattgccaaatgtcaactttaaacttcagatcaagagattcagaattctacagtgtcaggtatggtagatgttctcacaccaaggtgaacacaagaatcaaccgagtgatttatttaaaagagagtcctgagtgccacccccagaaattcagatttttaaatttttaaataaatctgagtgtgtcttttaaacttacattttgtaccagcaactccaagttattctaatataggtaatccacagataaaaaatatttgttagaacgtattttttaaaaatattgtttagaccataaatattttagccttttcttttttttaacaaaatataaatttatactttttagacagcaaaaaaaaaaaaaaattgtttaaagaaactctggccgggcgcggtggcacacgcttgtacccagcactttggaaggccaaggcgggtggatcacctgaggtcaagagtttgagaccagcctggccaacatggtgaaaccccatctctactaaaaacacaaaaatcagccggccatggtggtgtccgcgtgtaatcccagctactcaggaagcggaggcagaagaattgcttgaacctgggagacggaggttgtggtgagtcgagatcgcaccactgcactccatcctgggcaacggagagaaactcagtctcaaacaaaacaaagcaaaaacataaactctaaattccattatgtatgtatgtatgtatgtatgtatgtatgtatgtatgtattttttgaggcacagtcttgctctgtgttgcccaggctggagtgcagtggtacaatctcagctcactgcagcctccacctcccagattcaagcgattctcatgagtagaatgcctcagcctcctgagtacctgcgattacaggtgtgcaccaccatgcccagctaatttttgtatttttagtagagacggggtttcaccatgttgaccaggctggtctcgaactcctgacctcagatgatccacccaccttggcctcccaaagtgctgggattacaggcgtgagccacctcacccagcctaaattcctttaaaactatatttatttcttaagaacctgatcactagtctttctgtcagctctttctctttttattttttatttttggtcatttctggtttatattttagaatgtgctactatagatttgctgggatgattctgattttaatcaattttttttccttcttgtaccataaaaaattgaaatgtcccagaaattttgaatacatctagaatctagactgtatctcccagattcctattcatataaaaattttcaggcaaattgtccctctttggggttcacaaatcatgattgcaagagctagaagtaaaccactgtagaatattttagaggctaatagtttagaggctaaagatgtctcagagaatattggtctacccctgtcctatggatgaattcactgtttagcaaagcactggacgtgtattatgtcctagagtatcccaaaagggtatactgaatcatttctaaaaacagtcagtgtattaggaatccatgtgcaagtaacagaagtccttagtacaggagcataaatagaagcatatttacttgtctcatactacaaggagcctgagattaggccacaggctaatatagacactcaagagtgccttcaagatttcgggctcttttttttttttctgctctgtattgcgctgactactattaccctcatgctaactccttcttaggtagatgattgctacacttctaggtcccatatcctcaggataactacctgggaaagaaggaaagaacaaattagcgaaaagcaatgctctgtttttcaatttggaaagagatggccctttcaacttcatgttattacccaaaactgtgtcactttatctgctctggctttatgagaagctaaaaaattgagtaattttacctgggtacattgatgtcccaaactaaatcagggttctgacaggaaaaaagtaggaatacatactgtatcagaaactggaattgtttgctacagatagtatatctataaagaaaaatgtgtaagaaagactcagaacaattaatgtagacataaagatgtagattattatttgcctgttacatgtattaaccgtttggtagactattttttgggagacatcgttgtgagtcttcataatgctcatctcactcacccatgacagcaaaatgggggttggtcgctaattattaggtaaaacattctaaactaacaggaaaaaggaatccttgagttaatcttgggaggataacagtgggtgaaagacgatgataaatgcgcaaaactgctaaagtttaaatgattggcactttcaggatggtagcagtcaataagaatatgactgctgtgtagttaacctctgcactttttttcttttttctttttttttttcttttcttttttttttttttgagatagagtttccctgttttcacccaggagtgatctcggctcgctgcaacctctgcctcccaggttcaagtgattctcctacctcagcctcctgagtagctaggattacaagcgcccaccaccacacccagctaatttttgtgtttttagtagagatgaggttttgccatgttggccaggctggtgttgaactcctgacctcaggtgatctgccccctcagcctctcaaagtactgagattacaggcatgagccaccatgcccagcctctgccctgtttttatcagtttacctttatgactgactgaggaagtcctgaagttgcagctgctccacttctgagtgatcctggtttttttatttcttgttgtcccacagcagacagttattaaaatattgaaataatgagaatcctcaacaactctagtcacctttggcacctgcaaaatagaagttttgctatagtggtctagggtgagaggtaccccaaagaggtatattgaatcagttttaaaagcagtcagcttgttaggatttcatgtacaaataacagaaatctctgctacagtggcttcagtagaagcatactcacttgtcttatactataagaagcctgatattaggccacagagctaatacagaggctcaaggatgtcctcaaaatgaaaggtttcagtgttcactggcagagtttcctctggcaagcctggaggggatgggcagaggctggagtggaattcagattactcagaattaatcaggtcagaattaatcctggttattactttataccatggttcagttacttttataggtgaagatgtattttgtgcctaatcctacaaaaacatccaccccataatatgtcaagagcctgcatttattctgggaagaataaccataaaacctctcaagagaaattttccactataaaatacaaaagtaattttatgcgatacacagatcaatattacttgataaatatattacacaatggtcttgaacattgaaatatatgttaataatactttggtgtacataatacctgtatttcccatatgtattaacatcattttatagaaaagatcataattttaaaaaaagggtttgcaggaaggtacagttgggacctgtgcacacattgcatacatacagggtcttaatggaaagataattcaatacctgctgaaaccataacagatcattaagaacttttaaaaagacccgtgtctgtattgaaatagagaacctagctcctacttcaaatttacaccagaaaatggaacaattgatattatttttccattctttaatttctttttgcttaattgatttttgttttgtcttagttatcagtttgtcagatagcatgtggtttgttatttttagagagctcagattttccaaaataagagtaagcttctttgtcattattttatattaccatatatatatatatgcatatgcacatagatatatatgtgtgtgtctttacacatatgtttactataaaataaagaaagcaatattttacataatagttttaaatattctgtaagtaccatttggactagaattggtaagatttttttgtttttgttttgttttgttttgtttttttgtttttaatttgagacagagtcttgctctgtcgcccaggctggagtgcagtagtgcgatctcggctcactgcagccttcacctcccgggttcaagtgattctcccgcctcagcctcctgagtagctgggttacaggagtccaccaccatgcctggctaatttttgtatttttagtagagatgggtgataagcattttaaacatatttttaaaaaattatataaatttaggggtacaaatggagttttgttacatggatataccgcatagtggtgaaatctgggcttttaatacaaccctgtaatatcagttttgtcaaactcttatcagtcccacagtttatgaagagttttgaagttttgttatggtgtggattacagaattgtaatattgtcgttaacacctatgggtcttttcaatgaccataaaaaagtttggaacctgtattcattaaggaagaatttcactaacctcagaaggaatgagatatggttctgagacagagagaccctgatgaactctaatacacaatggtagttccagcataagcataatcatatatggacaagctaatttcattccacccttatggaaatctgccaaactccactatactttcaattgcaataaaatagcttcaggcaaatctgactttttatctacttctttgtgtactgtaaaaataaaactaaaacaagtttttactctgaaaagcttgtcgtttcaaaatgtatagtattaataactatgaagccatacagttatcactaccattacttggtgtttattttcatttattttttcctgggtattgattttgcatagttggaatcatagcacaaaataattttgtccatttttatataaaagggctattaacctttgttaatttcattccagtttggtaattggcttccacttcattactgttatatggatgtttatataactgtgataattgcttgcgtgcaaggacagagtaaagaaatgagaagttttacaaatttgtaaaatttgtgtcagtgattgagcctaaaatggaatctttacttcagcatatttgacccttagactttttaatgtttatgaaaacaattactaaaattatccccattttctacttgatccagtgtacctcatggaaagttaaatatgtttgaaggtagtgaaagtctcagcaagacaaatgccataaaatgattctaatattgcattcaaatgtttctatcatgtatatagatatgtatgtgggtggtctgaatgtatgtgtatgtatatggaaagagagaaatgattcataatagattttacattgaaatgtactaagcaaaataatagaaaagcatgctgcagaatataaaagcaatagagacaagcaataaaaaaaaaagaaaatgtacatatcagaaataaaacccactacatgcttctgtatatttgtgaataaccagtactcactgtcatgtaccaattaaaaataataggaaattttataaaccctataaatattgtgtttaactttttataatataggacttcaatagaaaatagactgcataaattaccttttatagaagtttagttgttaatgatcatttttagggtctcatccagagaggttcaacacattgttatggctgatttaaattatgattacaattatgaaatattgtgtctgtgaagttcaaaaatttacataccacagtcagcagtgaaatctattagaagctctagtgcgtttgtaggtctaatgtgaattgatatactggttcaattttaaaacatgttaattcagtcccctgtgccatgccactgggattaatattattataatatgtcatatcacttaaaattaaattatggtatactcttttgtgataaaaattaactaaagtgcatgaaattgtttctgagtctctaacaaaattacacattccttcgttttacgtaatttaaaataatatgaaaaatgtcaatatttggagctaacctcacatcattcaaattatagctaaaaacatagaattgctacattatttcttagattaaacatacttttccttaatgtgaaattgatattgaaatgtcatctagacaatgctatggatatctacagctttttaagtttgcatccgttctaatagattatttgaaatgaataatcatcagcttctttgagacagtaggggaaatcagaaacttcacagatgtttagtgatcttccaaggacaaaataatagaagtaatttaaattgctaacgtattggtctgttttcgtgttaccataaagatactacctgagactgggtaatttataaaggaaagaggtttaattgactcacagtttctcatggccggagaggcctcaggaaacttacaatcatggtggaaggggaaggggaagcaggtcacaccttacatggtggcaggagagagagagaaaaagacggcagggaaacctgccatttttaaaaccatcagatctcatgagaactccctcattataaggagaacagtatgggggaaactgcccccatgatgcaattaccttctgccaggttgctcccttgacttatggggatgacaattcgaggtgagatttgcttggggacacagagccaaatcatatcaactagtttgtcatttggattatagcactcattgggaggcacagtatattatgtaactttgaagtataactttcagttaatttttttttttatcattgcatttgtacacatttttgccagggaggctaaaacataggttaggtaccaatatttaaatctatggactgctttccactgggggatacgtattttcaacggtaaataaaagaaaataattttcatttcatagtcccttaaattttacttggagaatagattgcctggtaatcactctatcactcctgtctcttttcttagaagcaggcaaagttgcccagctaccatagtgtggaccttatgggacagctctggatatgtatgtcactgatacccttgttcactgtcaggttgacagacctgatggaggtactctgtaccacctgtatcacaggattttcctgcaaattgatatcaatctatcaattgaatagaattgaatattgaatatccaattcccctccctaacataataaaatacactagtaacggaatttcagtccccctggaagagagaagacattttggggctggtattatacttaggaccttccaccaatgagtccctccacgttaaaaattgtcagtaagagtatcaaatagatcacttatattagcatttcttcttccttctactgtgtaaagtcatcaaagatcattttgaagactgattcatatattattaaatgtagtattattttactattttttactaaatttgggaaatgactcagaactctttaataattttgagaggtatgaaaaataaaagtttttttccccatatttttgtgttggtagccctctttaaaatagaaagtatgaatttatttaagccagatcaacccagcaaaaaacaacaaaaaaagacttttgactttatcttgtgttatttttgttactgctggtggagaatttgtttctcaattcttccacttatttttataaacatgaataaattcctcattgaaaaaagttcctgtatttctattttttagtgctaccacgtaacttattttgagtgtgacatttgccaaaataaatagttccaataaagttccaatgaatacttgttcacaagtatgtccagcatgtcatctatgctaaatagtttctttaaatgtcatttcttctccaatcatactaggtactaaatcatctctattttctactgccactggaataagttacatgtacttcagtttacatctatctggtatattattaatggcaattgatggcttaggaatgaaaagttttgtgattaaaacttaggtttagcccgatatgagaggcaccaacatgagtgttaatacaatagataggttatcataaattattgctcttaaaatgtcaaatttgttaattccatcgaaagaaatagcttgaaaaaaagaaagctagccaattgcctttcactgaaatgtaatggtttatctgtagaataaacagaattagtttcccttcgtttgaagattttgtgggaaatacatttcattcattgtgtcccatcctgaagtatgctagtctatgatttttattatgccaccttacagaaattatagaatacaaaacagatataatctcctttttgtgcagagaataaatagaaatgcatatagaaatataaatattaaataatccagaactacataaaaagcaagtccaattcattcaacatacttgtgtattactcactgataatatccatgaattggactatttttctccaactcacctgtctcatgctacacaggagcctattttgaatgtttcccgtgggaaagaaacctcatgcattcatttcaattaaggcagtgattctcaactgggggattggttgtatagtttataatagtaatggtacagagaatttctactatacagaaatgttagtgatagaatccttaatgatgttaaactgttgatggaagtatgtcatgtctgtcaggattctgagatggaaaaagattggcaaatactgaactataatattggtcactggtagtagcttggaaaattctcttctaggaattttgcatttgatagggaatcattgaatatccaattcccctctctaacataataaaatacactagtaagggaatttcagtccccctggaagagagaagacattttggggctggtattatacttaggatcttgccacccatgagttcctacatcaggtacatgtttacttgacattcagtcatgagattcctgggccaatctccacactaacatgcacagttgtgtgtatagacgagacacatacatagtaggcttaagagcaaatgtctaccttttcctctgttttcaactcaaagtgttggtcctgggtaaacaaaagttttgattatacagtttttatcagtagatacccccaattttttttccatctcatctcaaatgattcattgcctaccaataaaaatagactgtccactggcagtaacttcagatctaatatttatcaattgtttaacagtgttgtgggataattccgccgtattgtttactatttctcttttccccaagatcagatatgtttgtctctagttgcatatatttaaaactttctagtttatattttcaatacgaagacatatttaaatacattaatttccatagcctgaattagagtagcatttgtaatagcattttcatctcagttgatattgattttctaaaatacatttgcctcagaaacattctttttttcatttggcattttctttacattgaaaattgaagaaatgcagtcattaaattatcattttcatttaactggatcttgttcaaatttcaatcaggtgttctacaaaaagttaatagtttaccagacattttcacatttctactgtatgcaatgggctattagtttttttttaaaaaagagaaagcttacactttttctctctatgatttggcttcatttattgcaaaagattgcaaagtaattgaaggaaaatgaaaactaaatgaaataattaaataagcaatctaatttctaggtgttaattcaattctttttctaagcaattttctgtattttaaacttcatttgctttctatctactttttgcctgcaggcttagatgtctcaaattatgggatggatacatcccttagtacttagcatgatgacacaggggaaaatgccactcagaggactagactaacacatttaacagttatttcattatttggtggcctcaaactccagatggccatatctagttgattttattgtctttgtcgattaaatacctgtattgtaaaattgtatgactataaaaggataaattttgatttactaaaggtgatcttctgagatattttgagggaaagaggtagtataccaaaatggaaatactacgcaaggtaagtgaaaacctttttaatgtatcttggtcagtaaattaaaccaagtttatattgatgccgttgccaaatttccatgtcttttaccaacacaggttcaaatctggaaaaaacatttactgaagaattcactgatttggcttgtaaaagccttttctataaaccataggatcaattgtcagtcctgtcttgaatgattacttatctctaaagctaacagagttgctatttaagctgaataccttccttaaaagcaagaaagataagtaggagtacacaggacactgtttgttagcattataacaaatatcctccagcataagtgatcaggatgttaaatttatggtaattgaattcaagaatttttgtcagaaaagtattttcagatatgaataggtaaattcttagcaagctagtcttctttggaaggtgcttatatttgaataaaaaggatttctttaaaaaaattgcttttaggatgccatttaaaagaaataggcaaacttcagaagccttaatggatttcttacagaaaacaaaccctccataaaattccaccttagcttcttgcagccctgaattcatgagatgttaactaaattaaccttgactgtcttttattggtctgtttaaaaaattagaaataattaatttaaattgtcattgcttggttctaaatatctttgctggccatgtctatagagagtaggggagcatttttgaagataatcattagcaaatttcctagattcttccttactactgattgctttattataaagctaatattcatagtttgattatattaatgcgatcttgttttcttaatctaactgcatgaaaacatacatggaatgacagatctacctgtcatttacaacatacttaggagattgaccaatttctaaatagtggcctaattaagaaataatggacattaaatcaaactgtgtgtatatgtatcttcacatgtttgtaaattatcactgtggcaagttctttatagcacatcaaagatctagttctttatcactcctctgcccttggagtttttatgcatacctttgcttctctgtggctaagcacatacccttaaattatatgattgcatgtggcagcagtctctcttatcgacatcttgaagacggatgaagtgaagctggatttgtggattttgccttcatttgtgtcagaaaccaatgccctctctcctttgggagccaatgccagttatgaacaaaaagccgtaagcagttgtgtttccccactcccatattctaagtgatcagaatgtgggatttcaatgatttatcgtcttccaaggataggtacatttcaggttttttaatcatgttgaaaacttccaaaacccattactgctgtatgatatttacacggttctttactctgatagggcctgttttataaggctaccgtgtctaatagtaagcttgcttttaattgtgacagtctgaaagcttactttgaaagctgcttctagagaaacctaattattcctggttgggaatgttcttctggtgataccactagcctcctgggtactaagcatgtctgatgataggtgattcataagctcaatgtgacatttcccaatgagttgttttgtcacgggttatccattttgtcagacatgttatttcatcctgagctttaatgtgactatcatgttgctgggcaagtagctgagagtgtcatatagcttgtcaaaaccgtaacaccatttgaaccagaatatgtaattttaaaatcagagctgtgaaatttaaacgaggatcttgctaagtcacagctaattcctttcttacttggtaacctggggtctaatgtaagagtattaggttgccgtcatcagcctttgtaaataagttaaatcaactgaaggacatagtttctggctagggcagggtctgtcacctgttctgggttaagttactgtggggtgcatttgaagatttgaagaaagcagtctgttgagatgacgaacttcttgaatcaactgtgacaaatgcaaaaacccatctgtgtttttttgagtatcattctagtagtcatgcctctagtgttgctttacttactctccaaacatgaaagttagcacatctattaaaaagcaaatctgtaatattagtagaaatcattctgatatagtaactttgcatgttctataaattcagaggagtagaagattacaaaattccaacaccaatacagcatagctatcaaagctgttcttaaaaatagtttgttaatatgactacattttaaaataaaattagaagttctttgtccacatagaattccctttagttaaattattttgaaattagctagtaaaaaggcatttacagaatttgaattagttgacagcacaattttaatacattcctttgtgttggtatttggagtttgtttccttttaaaatgtttataaatatatagatatacacacacatatatatacacacacacatatatttacacacacatagataatacattatatttactatatatatgtatatttgtgacagttacaaacttttctgaaacatgtatatatatatagtagtggtgcctgagtgtttctaaaatcattgtaacaatacattaagccaattagtagttgaatcaaaataaaaaaggcagaaaaagaaagacttcataaaaaaatagtaagctttgcaaatatttaaatataaaattaatacttagcaatcaagggtaatattgtaacagaggtgtacaaatgtttaaacctaaagaagataagtataagaatattcattttaaaattagaaagtacaaagagatgacgtagggacatgtgaactgctgatgtcttcatattttacagaatcctacagaattataccctgtattatagagttttaagatggaaaatgacatcacttcttaatattttaaataatttcttaagcaaaaaggaaatttaaagaaatcatatctttgttggtaaagaaatattagaaattcaccactatctttagtgttacttcagatttattttgttataatctataaaaattaagtttaagacttaaaaaagtgtttataatgattaaatattcataaatgtatcatttaccatccatccatccatccattcatccatccatccatatctacgcacagaaaaatgcctgaaatgaatttcccctcatatcaattccagttatttctttgttaggattttgtgtgtttaaaaatattttgctgtacttaaataattttttgaggttttttttttttttttttttttttttttgcagtgaacatgactcctagtaggaaaagcaaggaagaacactaataaaaatatgctaagatattattgatggttaactctagatggtaagaatatgtatgatatgggtgcccttgtttacttctttaaacatttttagtatcttttcaattttaggaaatataacttttaaaattaagagagacaaaccatggtagaacctattattagcaaagtatggtatttagaagaaaaaataattgaataaattgttttcataatgtggagttatgtgctgcctgttaagacagcaatcccaataatgtttccattcctttaggaaacacattatgaaccttataaaatcgggtgggattttccatagggatgaaattcattagagcaatgtctgcattctatgaaaacatctggtggttttggtcattctgtcttgtgttttggcctaattttctaccacgttgtaaggcacagttttaagaataattcacacatttttccatctagagatttttgaccaaaaaaagtatatttatactgatggactaaacaagttgcattataattgtgacagttacaaacttttctgaaacatgtgtatagttttttttttttttaattttaaaagtagatgtcacacctaaaatgggtaggtccatttcattttataaggaaagcacccagaagggtccatatgtatttgtgctcgaaaaggaagtaattgtgtgtgtcatttccgccccctttttatcaatattgcctaatatcaaggagaatcagtaataatagaattattaatagcagtaatagaatcagtagaataagagtggtagagttagtactcatcagtgaaaaactaatcaaccttattactttgaagggaaatctgggaagaaagagaatagaatgaggtacatgttagaaatggaaatggcgaagtaagtaatttttctgattttcataattctgtttcactagttaaatctattttccacttttctttccttcctttatctggctcggttctcactttagaaggcaaaattttgattatttgcaagagtgctcccaactcaagtctcttagtcaacatttccttccctcaggcttcagtctatgatatttcatgtaataatttgtaaaatatagttctcattgcgggactcctcacttctattttaagatatttttcttaaattattttatttctattgctgcatgcattcattgatttgagataaaattttataagtttgtggaaatcattgaataggaacttctcagtcagcgctgaaagaaattttatgaatgaataatacaattccctcctcctaatgaaagtattgtacatctcacatttagtttatattgattgctttctgacatggaaataaaacaatctttatattatgcagagttcctgttagtggtactatcaagaatataaatctgcccttgtgacttctatttctatgcttttctccaacctgaagtaaccccaaccaggtttttaattaaagtaatgtgagtcactgagtgtatcaccccttttatgcatgatcaagttaccatagcataaatatattccaactcttttgtaaacttgaattttatggataggtaatacaattcttctttccaaagtttgcagttttacttccacctttaaaaaatgttgtagtctcttggcagtgcttatataaaaatatgtgaagtgtgggtaatactagatatagtatatagatgtactagatatggtttgcaaaggtggacttggaagccattttcatttttggcctatttagaaaattaaatgatactactttttcctatacaacttatatttggtgggatatttttatttacttaatttgaaattttagactgaatagtcttaaatttccagcataaatattctatattttaatcaatgtttccttgtatgtagcatttgtacagttagttttttgaagtttttaattttttttttgtttgagacagtgtttcactcttgttgcccagactggagtgcaatgggcgacctcggctcactgcaacttccatctcccaggttcaagcgattctactgcctcagcctcccaagtagctgggattacaggcatgtgccaccacgcccagctaattttgtatttatagtagagatgggatttcaccctgttggtcaggctggtctcaaactcctgacctcaggtgatccgctcacctcagcctcccaaagtgctgggattacaggcgtgagccaccattctcagcctgaagaaggtctttaagaatatcaatgaacattaataccagtaatatcaaatgttagccacacatcatgaatattaccatatataagcacagatggtaatatcgggtagggcttaagagtgtggtgtttggaggcagaccaacttccaacacttactggcgttaggacctttaacaagccttcccaaacctcagtttattcatctgtaaaggtgagaataattatattactgcctcttgggtttgaggagattagagataatgcaattgctgcagggcctgactcaaagaaaccactctaaaatgttaactagtctcattagttattcattcatcaaatgacaaaatctgttttgctcagttctaaataggaggcctcaaaacttttagaggatggtttaggaacttgagtatagtacactaaccaaagttcttggctatggtcttataccaattgaggattcttcagaagggcttcaaaaataggcaggtgtctatgacaggtctgtccatagctcaaattatttcaaaaaaattccttgcgttttccttttgttctgccatagaagatgattattttttttctccatgatgttgtcttgtttttctgttagagggctgtcatgtggtgtgctaaacttttagatagccagagattagctatctaaaagtttcagaatgactgaaatagttattttttctttctttctgtttttattatgtgtctttgcaaaggtttgttgagggaaaattaccaaataaagtttgaaatagtattagtacctttaaatgttttctttaaaatatcttaacgatagatagatagatgatagatagatagatagacagatagacatagagatatatggaatgcttcattacgcatactagacacttgttgattttttaaaaggaaatgaatttagaaagcaattttcctcgaaaccagtttttttcttctttggtaaaggataagtcattcttacaactctcaatgatgcaaggtgaaatttatccaattttaagtagggatgctaaataatgtagagaagacacaagcacttgttttggagacagaatatttgccctctgggcccagatgtgccatttaaaattgagtgttctttcattcatttattcattcttgcccttgtttggtaaagggtattgggaaagatctgtaattaaagataaaagtgtaaaaagaaagaaaaattgccttgaaaacaaaacaaaagtgccagcaacggggctaaaaagataacataatgttatatgcccttgctataaataggtcataatttttgtttcaagatttctagcagccaatgcaaaaaaggaaatcctggtgaaattacacaagtttaggatatcttccagaccacgaatcaaccagtcacaaagaatatgaatacttattttcttaatattaggaacagaaatctcccatgggtcctagtaaggagaacatggaaagtaagtgattacgtcaattgtagtatcttttaaaagcagtattgagttttataaggaagtcacttcttcttcagcctatacacttccataatttggagatgtttgggcttcctttaaggttcctttcagtttcaacatacgtgactctaagctggaacccgatgagatcagtgagttgttaaatgtgaacatgatcaaactgaattaaaaagctgttaagaaattagatatctcatcttcagtttttggactttatgatttttctttccattcctaatgttttttctatcacagaaaaaaagtctcatggtaactgcttttaattttgactattttctattcttccaagaaaatcatttattttaaacatacaacttatcttttttagcatattctgattgatgcaaatactcttgtataactttcaatagtcaatgaaatattggataaaatgtatttctaagaagatagccatatatgtgtactttttcaaaattgctgctttttgcctattattgtttgctcgtttgtcttttggttttgccttactataatagaagacttattagttatatttaactttcctcctttgaggaactaatcattatccaacttaattcataaacttcacagatggcatttcttcttaacttagaactatttttgtcttactattctgattctttcttctataagacagcctcatgaaacctaaacacccaacatggaaatattagatggcaaatatgttttccattttgtttggccttaattttattcaggtaaataattgggttgtgcttaacttacatggaatactgcagtttatatgatgtgtcataacatcaaagctaaattaaggaacaagggagagagttgtgcttttttccaaactagtacaacttataatgttatgctgttttttaaaattattgtcagtcttgtttctcttatagcacaaggtctctcttaattatgtaatttaaaaaatgtatccttctcttcaagaccagcctgactaacatggtgaaacgctgtctctactaaaaatacaaaaattagcctggtgtggtggcacacacctgtaatccgagctactcgggaggctggggcaggagaatcacttgaacccaggaggcagaggttgcagtgtgccaagatcacaccactgcactccagcctgggtgacagggtgagactccgtcttaaaaaaaaaaaaaaaaaaggtatccttctcaacatttctgagactatatctcttaaatttgttttgcagctctccaaggaccagttgtttctcaaataactggtccttggggagctcagtggattgcctgaaaaactctgattgagttggggaagatttctaacaggatggaatatttgagatttacataggaattttccaggtgaagaaggggaatatgccattagatctacaaagactgtaatccagtagttgggtactagaagtagagatgaaaatttcattggctgttaagttttcagcatcaataattagaagcacactgatacagcctgaaacaggtaacaaggacactcacatagagtggatcaaacaagatagaaatttacttctctttcctatcatgtctggaggaagataggccaacgagagcaggcatgtggctcatcaccttaaagatatctaccgcctcagattctttctatcttattatcaaccgtttttacatgaatgcgtgaagcttcctgaactgtctgtatattatggcagtaatagactataagcagaaattaatgatcatctctctttttttgttcacacaaatcagattttgaaactttaaggtttcttagggaatttatagttctacaaaacacttagaaatgctgccttcggttacggtatctccattaggttccaattctttggtgtcaggacaatttcttacgtgttttggagcccctctgctatatagcagactctcaaaaatatgtaataataaggggagaaagaaaagtaaggaatatgactttcatgtagatttgaagttgtaatttcattgatctcgaagagttggaaggatttaggtaatcttatgcagataatggtaattttaaagaaaaggtctcattatgtcatagtcactatgtggactaaataaaaggaaataaatgaaaaggttgtgttacagttatcattcaaaaacatccaaatgaaaaaagtattttttaaatcagatatgcatttattttggggtggattttggcattatgcacaagtgttctcttgaaaagcaattcataggaccctaactgaacttttggattataacagaggtaatgtcattctgccaaaacacactgaaattagcaaaagccagtacccttactaatttgattcttattaagggaatccaagtgattgaaaacctgagatgagatttaactatttccgtcatcaaattcataacataaaggggaagcataacattgccagttaggagagggtaaattcaatttggaattttccagtagtaggacaaaaaataataaactcattattctcttcagattattaccattattgctgctgttgttttgagtacaatgactgcttacttgtgctctctgacagtatataaccaattaggggatttgaaatatagggagtcatttttgaacaaggaaaaggcagcatagaatctatctatttgcatatcttcaaaaggatttatttttatagctagtttacccattgcctatttacatacatgagtttggaccaaataatgttctaaaatctatccaagtttttaaaaaattctgtttggaaatcaaattttgtactaattttgtcaattattgttgtaaaaatctgaaatgccagaccttttatttaaaatatcaacatgggtatgaaaaataataacatgggaagatggtatctatcatttgacgggctttcatcaaccctgtatgatacactccaatcctatcatgagctctttgaaaaggatttagtctctttttgtcagatgaggataaccccagacatttaaggagctgatgttttctcaattccagaaaaagaattggaactcaaatctgtgaggcacgaaagtcccgaagccctcattctccactgttacaaatttgcagaaatctgagtgatatgaaaaatatttatttttattgatgctttatacacatatccatattactttacatacaatgaatacttgtgtaaaattatttaaaataaggtgcttcatatgttcagtgttttgtttttgactaaataaaatatttattgaatgccatttaagagccctgctacatgttgggaatacagttgtaggcacaaaaaggcatgattcttacttttggggagtaaatggtctttagggatcatttggtttttgcaccataggtgagcagaacacccaaagcaatgagtcaaagtggatgatataatttttcttattcccaaatgcaaataaaatgtatcttcaataaagtagatctgtagtatttccaaggaaagtgttattttcattgaaaaacacataccatgctttctgtagactcttaaatatcaatcttcaaattaaaaaaaaggttttacttccactgccctccccaaccagcccatgaacatgtggcgcacacaccagcagaacacatacatacatagaatctgaaataaacctacatgtgaaatgaccaaatggtgcatctggattagagttttagacagatctgtgctattatttaatttgttagcataattatattttatgttttattttcttacacttaggaatttttaaactgtaaaaaccttatattatatcattacattattaccgacatacctcattacatttatcaactggtttttttttttcagaattttcaagagttgtagcacattcataagattttgtgcctgttattctgtcttgaatattggtgcaaattttgtattttcattgcaaaatgccagcctcttaagtaactgtaactcatcatatgacaggtggaataaaatggctaccagtaatgcagagttaagctaggaaatagtttagcttttagtgttaattttacttcaaggaaattagagcattttatacatttataaccatcagtcttggctgaaatacttaatggaggcatgataacatatcttgtacctttatagatgttgtagctcaaaattatgtttaaaagttgcttttccaattaggagatcctaacttcgttggcaaagaaataatacacggtaaaacaaacaaaccaccaatataggcattatgaaagaggaaaaacttaataattggcattgcaaatgggtaattatctaattatctacagaagaaaatgttaaatgacataataaacagaattagaaaaactgggcaagatacaaatattagcttttcaggtcagaccatagcacaaaaggagatagcaaagtaagatttcagtttgggattaaaacctcttaaaaaggattttaaaaagatcaattaaatttgggcttcaatttctccatgaaatgctacaatgtatgggattaaatatatacattattgatatgactagtttaaaactgttcatgacatcttacctgaagttgtatccctcctggaagacaagaatgtaacaaatattctgaaaaaacttcagaaagtatattattattggaattataattatttgatgaaattcaattagtgtttattaataatgagcttgacatagaatgcattatatagacggtcacccaagtgtctaatcttacacactaaaatatacatgctgggaaatgaagatagggaaaatataatgatggcagaacataacattaccaaaatataaattgtctctagagattattgtatcttccactgttccacagaaagaataattttgatattctattgcacattgatagtcatgggatctcttcaggaatttttttttcttatgataatgcttgtgttctcgtcttacaaaattttaagaaaatttcttgtgaaaatgtgctactctctaagacaggctactgtctaattgttgccaagcacaagctataactatgataatgagattggcttatttcctttgtgtttgtcattcagacctgttttaaaatcttgcagttttagatgtcaaatagtctgtgatgtaaaatcacctagatgacatgtttccacacttgtcatcaacatgaaataatcatatttcagcacagctcctctgtcatatgagaattatgtgccacagaatccagatcctggaaaactacaggaccctaatgtgtgtgttatcagattaaaacacctgaaaatttagaatttatgcataattagccatttcaaagacttcacagaatgaaaataatctactgggcaaaacataatatatatatatatgaaatcaaacattgaatgaacacatgctttgtgtcaggcattgctctaaatactttaaatatattctcatttaacctttcaaattctttatgggttgagtactattatcatttctatgttatagtttgtaaatagcttccagaaggtaaggtctaaagtcacattgctagtttttggttgaaagggactctgaacccaggcaagccaactccagggtttgcacactaatgtatagctatacttttaagaaaactatgattactagatatttcaattatatttcaaaggtcttaggtaagttaattgtagaattgggataatgtcttgggttcttggagtacactgcaatcaccatgttcagctctttaggataatatgacaaattctagcctgtgcacaactgtttctctgccgggtacattttcagctgtttctctccttaacctctgcaatagtaatccaatcaccctgagattcctcataggtattatagcacagcattaaacactagccagtttcaccagggctttacaattcttgttatgctctatctaggagaaaacagaaccagtttttttttcttttaacttttcatcactgatagaggcctggtctgaaagttttttatcatttgaacctacagaactggattctagaatttatagtgcctgccaagttgtgtgtaaccctcgtgctggttcttgggttctaattgctgctgcattcaacccaacctcctggcaccccatttggacattctacatggaacaatcaatttcccaccttagaatctaaattctgattattttaatccgtgttggctctccttgtccaggctccccctgcccatggttctgatgtcccaaaaggctttcatacagaatgctgctacgtagcaaaataacttttataatagttcttgacttggatctgctatttggctgtaggtctgtgaaccctaacattacctgcaacattatatgcatgttcataagcacatttttttttttctgagcagggcctagagttttaatttttttctttcaaaggtgtctgtaatccaataatacttaaaaccactgctactaacagatacaaagcaaaagagaagggtggtttcttgttttgacacctgtgttagtccattttgtgtggccataacaaaatagcacaaagtgagtaatttatgaagaacagaaatttactctctcaaaattctggaggctgtaagtccaagatcaagactccagcaggttcagtgtctctgacggctgctgtccatttccaagatggtacatccttgctgcatcctccagaggggaggaacactgggtcttcatgtggcaggaggctgaagggcaagaaatcctaatgctacatgaagcgttaatccccttaatcccatttacaaggggaggagccctcatggcctaaccagtttttaaagtccctacctcttaatacatcacattaaacattaagtttcaacatttaaatttggaattttgggtagtatatattcaaaccatagcaacccctgaattaaattatttaaacataaagcaatatgttcctgaaattactatttcacatgtttaatatgtgcatgtgactagtggctaacgtattgaacagcacagcttatagcaataagtgatgttgtgcaagtttaaaatatggtggcagagagtaatattgcaactgggcttttgattgtttgtgagaacccagtattaacagtcatatgaacagtagagtatgcctactaagaaggtatagttaaacattattgtacatgtttgagtctaagaaatgctagctgcatttgatctatatcaatgccatatgggtttttaaaaatcatgtattgaatgtgattttcaagtggttcaatgatgtaacagtgttggtagggtgatactttatagaaataaagtaaattgtgtaattgaattcagtaggaattcataagttctgaaaatgtggtaatagtctacaaaccttgaaataaagtgtaaaatatcacagctttaaacaatgctggaattggtaaatattgttatgaagacagtaacaaaacatactaaataattgataaagctataaaaacaaatatgaatatagtatgttataagtagtggttactagagagcagatgataatatacattatatttaaacatatctctatagagtcaacaaaataaaataaacattttggtaaaaattacgtaagcaacaaaatgaattagagtgtatctctgcctcattacaagtataacaataaatattttacaaacaactgttagaaatcatgtgataaaataatagacgttaaggaactgcaatattttcatccatattagtaaatcaggagcatcaggaaaaaagagaataagtgttaatcaaactgatagatcattggatatccttatgaaggttgtatttgcagcatcaggtagagttcagctcttcctgtgacgggtaaagtctttatctctatttttctcccaagtgttgaccttccaagatattattctgcaaatctcttagcaagcacatttctgacttgtacagcattgagcttaaatctgtattggaacaacatttcaaccgtatttgagtcatagattatgttagtaaaatgtttatgtttaaaatttttagggaaaagcaccattctacttctaattcacagtgtaggtgatgacttatatttgtaggaaaagtaaagctacagcgcggtgttttctctagtattgctctaccgtcagagagtattaccctattattgttctctttaaatacagggtaatatttggctgtgttctataatgccaacaaatacttcaccttaaagggcattttggaaaagttcttgtcaagattggttgacattattataatcaaattaaagttttccttgaataaaaacatcatatactgagagaaaagaaaaggatatttgacggataaatgttgcttccatcttgttaaagagtctttaccattccttttataaaaatctcagtattaagagtcatggtctctttagaacattgccttaaagttatctgtaacaataagcattcctatgaactattagttttaaatagagtgaaaagatgtttctttcaaataatttttctttgttgccaaattcccaaactttctttcagtcaaaaaaaaaaaaaaaaaaaaaaccacagggcaacacacacacagagacagagagggagaagagagacagagacagagagagagagcgagaattcacagagggactgaatgaatgtccaagatcttgatataacgcaagggaaattgaactgataatcttcacctgtttgtcctgtcagtttacaaaaatataggctttgagctcaggcaccatggattgggatcccatctctaccttttacttactgtcatttaaccactataggtctcagttttcacaccttttaaatgcagagaaagtagtaattccatcataaaggcaaagatcttatgccttatttatcttttcctagaggtaagtactctatctagcatataatatgcatgaaataaacagcagttaaataactgaataaagggccgggcgtggtggctcacgcctgtaatctcagcactttgggaagctgaggtgagtggatcacctgaggtcaggagttcgagaccagcctggccaacatggcgaaactctgtctctactaaaaatacaaaaattagttgggtgtggtagcgcatgcctgtaatcctagctactcagaaggctgagacaggagaatcacctgaacccaggaggaggaagttgcagtgagccaagatctcaccactgcactccagcctgggcaacagaacaagactctgtctcaaaaaaaaaaaaaaaaagttgaagaaaatattatggatatttatgaatataaatattcataataaaataaaatgtttatgaatgcaattgaataacataaccaacagatgctaggacaacagccaacaggtgactatttggtaataatgatagttaattatgcttccacttactaagttattcttgttaatttaagcatcgtttaaactacattttgtatgaaatgggtgtattattttatttcttacattctacttcaactggttatcttatatttatattgttgtgtttcagctagatatgctgttgtgttagaacatacactgttatacacgatatatctagaacctgtattttagcaaactttttgtttcagaaagataatagaacttttttcattattatacataaagtatgctttttttctcctgtgctaaaacctaaagattctgctttaattttggctaaattatttttttcccatcactatctatatttagagcttacttctgagttgtagttggaagaattaaatgtgggagagtatgttttgccaaacccaatcagaaggactgcctggactctgtacatgagcctgttgtgacctgattctcatgtattctcgacacaatgctgaaggtccaaagccctggcacttctagggagcaaatacctccagagttgagtaaacctgaatcaggaacactttctctgactgaattctacctcaacaatatgcatattcaaaaaagaaaaggtaacatccttggaaaatatgtgctgggaactgccatattcaaaatacttctaaaataaatggagagtttttttttttttttaaaccaggaaaaaaactcttgtgaagaattagtttctaagtttttggtttctaagtagtttctaagttttctttgtattttattgatctcaaatgttgttgggttttatacatcacgtaacttttgatgttacttacagaatactctaattctatcattagatgtgtttatttctgaaaagtgagtgattgttgaatagaatcccattagcaacattaatgttacaatttaaagacaataatttcttgtagaactatgacgaggatacaagttttgcaatgttaaacatttttggaggtgtacttcccttgagtgggcacagttttagtcattttgatctatttttaagcttcagtttgaaaaagtcatacctcatttgtccttataaatatttatgtcatcttataaccaaattaactcctagattttcatttgaaataactcactttggctgagtgcagtggctcacgcctgtaatcccagcactctgggaggcctaggtgggcagatagcttgagctcaggagttcaagactagcttggccaacatggtgaaacaccatctctcttgaaaatataaaaactatccaggcatggtggtgcatgcctgtaatcccagctactggggaggctgaggcacgagaatcacttgaaccctggaggtggaggttgcagcaagccaagattgtgccactgcactccagcctgggcaacagagcgagactctggctcacaaaacaaacaaaaaaacctcacttcaatagtatacactgcaaaagcataactataaaatggaataagactttatatgttttgcttgacattttatatgccttatatataactttttttacttaaatgagaatagaatacaatatttaaaccaatagcaaggatggactatatgtacaaatcttcactatgagcttcaaaggaatgtgtactaattggaaaaacagaaataaggctagacatagaggattctgttatgtctcctccgagtgactaaatggcttcacaatattacatatagaacctgcagatgtagcccattattgacaaatattatggttattttgatataaatattttgatattattttggttattatcattttggtatcatctttatggctcaaataagttttccaattttccttgaaacatctttaaccctccttaaacatccatttataagcaaagaagcatatcgtctcccattaccatgttggtccaccttcagaacattaaaaataactcattaatgtagtcttccacctaaagagttcttctctaattttctttaaaaagttctttaataagttgaattacttcaccagttaaattttaatgtatttgagggcgaaccccatattcttcttttttttagtatctattatgatcaatgaaatgtttctgtttcattgattatattagactttttgttcgtatggtgcctatttaaacactgtattaatagcagttaatatatattgaatggttaacatttcccaataacgttctggcatctgtagtaactgacttaattctcaccctaatcctttgagatcacacctattttacagacaagaaaaccaataagaaggattattaatttgcccaaaaccaatcagctattaagtggccatactttttttgaccccctagagtctggttccagggccccatgcttttcactgccttagtgtttctaaattcatcttcctaaatataggacaaaacctgaaccctcctgaaagagcagtataaagtacaaaggagagagaaaagattgagcaaagggaataaaactgcgagtatgccagttgagcaagccacacggtaatttaacataagccacctgaagccagggtgaaaatcaagggtggaagcacacacacttcttgtgatgtgacaggatgattcataccagtcacttttaaagcactgtgtaatgagcagagtccttagaaacatcttagcatcagatcaagatactgctattcctcatactgattgatctttactgatgttttagacattatattttaaaaattctgtgaaagtgattccacgagggcattaagattgtgcaaatccaaatatatagacttctgctgcctttattaaactgaaagaattttaggaagcctagagaaatgtgatgaaaatgatgatgttggtcatggtcatgatgaagaatcttgccagtttactagcatcaagtataaattacaatcttttgatgtcagtgatgttattttagagctcaggaaactggatcttggacaggccaaggggcacataaggtcaaagagcaagtaggtccctgaagctcaatcagcatctagacccttactcaaaaatctatactcttcatccttacactatagattttttctcaaatcggaattttgaaggaaaataactacatgagaaattaaccattatactctctagtttaggtatgtaattgataattttgattaaagacagatctacaagctatccagcaggtgggtggtaaggttaacattttataacagaagcagggacaaatattgaagtacttacctacttcacctggctctactggaagggagaagataccaagcaaaacaaaattatccttagaatgaagttctggtttatttcaacttgctattgttgttattgctggttttaacatgtgataacattagtttgtttgggctgctataattgaataccatagattaggcagcttaaacaatagaaatttgttttcacacggttgtagaggttagaagtcatgatcaagggctttggtttctggcaagggctctctttctggcttgtagatgtccgtcttcctatggcctcatatggcttttcctccatatgtgtgtgcacagaaagaaaaagagtgaattctctcttgtctgttcttataaggacgctaatactgttggatcagagtcccatcattatgacctcgtttaaccttcattacttctttagaggttccatccctgcgtatagtcacactgcgggttagggcttcaacatgtaaattttaagaggatacaaacattcagtccataacaatatgaaaacctcaacttgtctctaggtttatcagaggctctctaaaagctttgttaaacctcgtagcatggagtcacattgctatctatattctcgttgtaaatacacacatccagattcaagttgtcaattgcttccaccctttaccacctccaagctattcttggggccacattctctcgctttggctcccagagtttcaggcagaaaagagagtgctattggttgccacttctcaagccctccagtaacatctacattcaactttgcctcctcctccaccttgttatgaattgcaagaccccatgaaaatcaatggaacacatcccttagaaaaagaatggggagccctactctagaacttcactaatattttgaagagcaaattcttcaagggaatggtcaaaccaataatttctgcttctcagaaaatacttgtcacaatagaaattgaggtttgataatacagattctgtcctaaaatattatgattcctttggtgattaatgaaagtaaactatcacattaacattttgatgtgatataactcattaacatatagtcttatgaaaaaaattattgatttttacatagccatactaaatattaaactcactactataaaattagcttattgtttaattattccacaaaagaggaatatatatttcagatcattttccattttctaaaatagcccttttcacatatttgcataactgcaagtatgtcttcagcatccattgatttactgattttatatatttaaaggcaaattttttaggtatatttgaagagccattggactttctatgctttcagaaacagtagaatgcatattaattataataataatttatatcaatgctgaataataatattgaactttatattacaattatggttccaatatgtatttcataaatttctaaatcttaatacctaaatagaatgctatgaggcactggaatgtttaatacacaactaaattttctttcttttgaaaatttgtcaaatttctgtgactcaaatttgatagaagagaattctttgacctactggttcctatgattcacatacgaagggtgatacctatgggtatagagcaaatgcgtgttttatttataatagcaactttgttttagataaattcagtgaaataataaatgtatatgacttttttatgtgaatggttaaggaatgattttatgtttcttttattttacctctttaaaaaagaaatcatgtgtttgagagtttgtgcatttctatcttcttaaatattaacaacatttctggatatatggttatagaggtttgcataatatttagtcaaatcagatttatttatatgtactttagaagtattctttttaaacagtattcaactttctctgacatatgcagctgcagcaaaaaacgtttactgaaagataccttggaatcatttgtgtacagagtttaaaagttaatgttgtcttatttaccaaaataaaataagaaaataaagatttgatagggccagaatgttaattagactagaaaatgcaactttttattctgtaaatagatcagagtgtgttaaagcaatctgaaaatctgaagcataaatgtagaaaaaattttaaacttctttactctttgttaactcatcaagttgaaatgaaagttaagtgcatttaaaggcattttcagtagaaaacagcttttctttgggagctgctgggcaaacatcctttttttaatgaaatagatattgtatatatgataaaggtaaataaatacagataaagcacttagatgaaaaaaatagactgcaaacactgttatacattcacttgtaggttcttaagtcattttttttgttcttttgttctgtaattgattgctagcaccccctttaacccaccttaaagggcaagcaggaaattcatgttttcgttcatcagcccatccctctgaaaagcgttcgatattaaaacagttttcaaggagcaaaagcagaggaaagaagaggcccagctagactgtagcaaggttagaagatacacgcaagattgcctgccacacacatcgggtcttgttcctgtccagtatttgcatggagatatcaagttaattagggtaggactctgttcttcgctttctatgtgaccttttattatatctgtggctctctagttcatatggtgtcataaagctatgggaaagtctttctagtgtttgacacaaactgcaaaagaaataagcattgatatttccctttgcctgaaggtttttacagcagcaaaatactgcagaggcaaagttgatattgtggtagatttgctgtgggtgtaagaatgtttcttttgtctttcggctccccgcttcccccgatgatgatcaggtgcgacctagagagttgtggagaggaatggggtattggttggggagggggtgcgggttagttcaggaggaggttacatggcggaattcccacgaatgctggcgaaggatgaaaaagatgaagaaatcttgtttttctgaacgagaggattctctgcatgacttccccactgttggggtgatgagctttcaggctgagattttattaacaattcatatggagattgagggcagtggaggagcagattctcacataaacttgatctgtccatgaatgcagttctctgtttgccctgaccctgcatggcttaagacactgcctgtgaggccagtgtgccagacacaaagaaagaaatgaaaagcaagcacattccaggagtctgcacaaaggagcccggccgtttctagtcgtctccccagagaggatcttatctctgcacagccaaaaacctctaaaatgtttatttgtgtacttaaagttttaaaatccatgtggctgttcattaagcaacagtcaatagagaggttttgtgaggttttaaaatgttgttttctgaacttgttgaaactggaaaaatatttgcaagggtacattttctgaagtttagctttagaagtcactggccttgagttgtttttactttgtcaattggtaggtagcctgcaaaatgagtcctttccagctttgggagaggccagaacaacatcttaaatcttgatttgacttcgtaatacatcctgacactgcaagctctgaaacttgtggcagagagttaatgcatgagacaaaactgacctgggatcacaagtggacatcctcacgctcatgatcacagaccacagtgttacattagaaaaactacgggagaagcaagtgcagagaaaagtttgagtgagaagaaagagtgagagaaactaggaacttttattataatgtttttacaattattggcagttcactatctctagaagcattataacaggataatgacaagctctcacaagacatttctctgtaacttaatataataggttttattgtttgacaaatgcattgtctgaaagtatgacatctttaggttcaggggataaaaactcgatatacataattctgctgctcaaatacatgtttccacagatacttaaaattcagaaaatccagatacacaggctttttaattttgcatatgtgtttagctgttcaaattacttcaaacttttatggttcattaattaaataaccagtagaggaatgtagacaaatgccattaattatgataggttttgttcctttcattttatagtggttttatttccatgaaattaactgttgtacttaggctaattgtcagtaattggtgacaaaatcacttcattgtttttctatagcatgatactaatgaggatatttgcaatattggcccaaccatgtgtgtattttaccttctgtgtttagtcagtggtagataatatcaaatgcaactttttaagagaaccatgagataaaacatttctattaataattaaacaagtcttttaaacagcctgtcataaattaattttaaaacatcgagattgaaggaagcttttattttaggtttagttggtttcatgaaatatcaactaattttcctgatttgaattgaattgttttggaatcatctatgcaatatcgcaattacaaatctcaactgcttagccacatgtatttttattattctatttgtgtaggcaatgctaaaattagcattgctaaacatgcttttgtgaggtatcacagagctgagtgggattgcctttcttttcacacctgatggttaaattctcataatatatagcaatattacttattcttgttttctaacagtattttcctgtttcattttgccacatgaaaatgtttttcaaaacattgtatttcaaatgaatatatatgaaacagttgagatcatgaaagcttggttttatgtatttttttcaacattaaaaaaatatacttccatgtaagtaatgggttataaagagaaaaagcagtgggagagtattccattttgtgaagtgagatttaatgccaatggcagaaaatattgcaacactacttatcccattaaaacaatcacagccaatactgctttgctcacttcgttccttaaaagaattcttctcaatagattcccctatgatttttatgaattcgtaagttacaaaagttttctagtactttgaagtacagtctttttgcttctttttcttattctaagatgcttttaccaatcaagtgccattttacagtttatagcccactctgtttgttttaaatgcaaccataatgtataccttagagctgagtgtctcccaatcatcctgaaaaaagtttttacaaagcaattagaaaaataattgcctattaaaaggtgaagattggtttgagtagggagagcagaaactgaactctgaaattgaaagcattcattgttagaggaaacatatgcaccaaatccaaaattaaagaaaactcacaaaatacgtatcttggcaaggggaattgtttgaattttctaaagctgtcagtccattttctctactttttttccggtaaagaaaaacttcaaatggaaagcttcaccttttgtacaaagttgaaatgttttattattgcagaattgttctacactgtacaaaaccagaacaattcaatagcttccggggggccaggggatggggaaacaaatgagaatctttccatcattctagaatacccatagcagagcaaaaataagtataaaaatctatggtcatttccttgaaaaaaagaatcttttgattacagcagttatttgaatacccattcaggctcttttgtgacatgtaataagtgctcttctcccaaatgaaaaatactcttagggaacaaaaatcaaacataaactacgttcagatgctgcatttcaataggtgaccccataggattaagcaaaggttatttttcttttttgcatgtgctctaaaaaataaattccccagagttaaattttgtttgtttgtttttcatcttactggtgtatttccaatatgttttcttgctttttgtcagtttcaaatatatagaatgtgaaaaataaacaaggcgggaactgacttcaagttttaagagtgataaagtattgtgaaagttacttagagaagatgatttttctctgatttatcctgccatattatagactctggagaatacaataatatggaggtttttttctctttcttgagtattctaactgttcaaggaaaatactagaaagaagtaggactctggtaatactatgagccatatccatgggcatctaaatcctgtagaaaaaaataataaatacagtttgcttctcacttaatcatacttgacaaccatatagacactgctggggccatcatgagtagcaggcggtatgtttgactgttttggccccagaagtctttataattgtaatcagtttcttcatcagtccatgctgtgccaatacccctaactagccatagtgtcattttaaaaattaaaaataacccacattcaataacatcaacaacaacaaccacccctcagcataaactatgttctctgtgtgaactcacagtacggagcagttgcatccaacccctgggctctgatttacttggcacacttggggttaatcaaattcccccactgtgaggtgcacacacatttagaggactataacacactctaatgctacctaactctgctgtcatttttaatattttcatgagttttttttaagtgatgtgcatagcagaaatagcctgactttttcttactgctaaatagagtgcccaccaactaaagcaaacaacaataaattaaataaaaaatgatcagatgtagaacatatttattccaagatagttttagtttctgttgcccaaataagtttcacattctatgaaacttgccttttcccaggggttaagctcctgcagcacttgagatagtgagcaatggcttcattaaaaaacataaagcataacaaaacgatgtggtaaaccttggggtgcttttgtttttacttattttagaatgtactaacaattttgtatgcctcacaatagaggcatccatgtataaagacttgtaactactcttattatattcacattttctggggccttaatttcatggtgaacaatatcaatctgtaactggggcaaatttacatgacatcacatacaaggcccagcaggtcaaaggtggatgaaacaggttcactgctgcatgccatgtgtcttacctggacaggcagccatcagctcctgcttcaggtgaccactgtctgcaggtaaaaccaaactctgtacattttgctcttagtgccttatgaccagttgttttcactcataaataatgtttgaattgtaagctcttttgctctggaatccagaagcaaccagtcactaatgatcattttgcaaactacctagtcatctaccagctaagaaaataatggcctctcactctcttttgtgtgtgtgtgtgtgtgtgtgtgtgtgtgtgtgtgtgtgtgtgtgttagagctgttagcattcatcaacaaccttagttgtccctaccaacataggcttcatcagaaacttttctttttttttttttagtagcaaagataggctacttaagattttatctccaagtatgaacatagaaaatataaaatattcaagctctaaatcatactttggatataccttctaattctcactttgaactacctgtgataagacgtgacatttatgttttgtcatattattcaacatataatttaaaaataatttaaaatcacatctaaaattttaaaagaacttaggcactaatatgttttgtagtcttacattattatttaaaataataaaagagtaaaattttatagagtatatttgtaggtacatatttttccttgaagggttacatgcaatggaaagaagatagattaagaaagaacagtcacctatatgtaattaaatttcaaaatgatatagaaaaaatttactggaatgaagaaaaaaatctgccttttagacaactacatggaaggtttatttttattttgtaatacggacttttgttcccggataacttgtaacaagctcaagatgtggagtattaaatgaattattacaacatatagcctagaagtaggaccgcattgtaaaccatcaaaggtataacacactaaaacaggccatgtgattgtggttaacgcactcatagcgagtgcaagcaaaccttaaccttctggatttttacatgttatgttttactctttggtttacttcttcctgtgatcaatacccgggcaaagccagagctcttcaggagaaggttgagattataacaatgtcagcttttgcttttagcggagtgatgaggttatcaataatgcattggagatcttgggaacctttgacatacacatatcacagctgccccacgtttatcgtaggacttgcaggtctgagctgagttgtcacctcatctgtgtttgagccagccattgatgcagtcagtctcaagtaatcttgggcacctagggaaagctgttgagattatttaactgaaacattgcatttgaggaagttatttaggagtgagaatacatctatgaaatggcttttattaagaagcttgttcaatattcctttaataactttttgtctccctagctcccttctaatgtttataagtcttgttgtttctgtgacaagtttattcatatcctaacagcttgtctggcagcagggttcgtgttttttacttgagctttctggtcacggtggtggctgagagtaatggagggggaataagtgggtgtggaaatgcaaagctgtctcttgttacattttatcgatctcattctggtgtcattcaattaagacagaaatgtgatggatagtctctgcccagattcctgggttgctctccatcccttgcagatacagcttttgtgttttattttgggggaagggatggggaaagggcacgggcaagtgagagaaatcaaatatgctatgtgatctgaattacaaatcagtgtctctctaaggatgctccaaaatgtcaaacatgccatgtttatattttcacatacacagagtacttctgttgatgtatgagatgggttactagaatttaagttggggttaattattgttgatttattttcaaagacctgtgagctaacatcactcttctaccagctcaagataattaaaaatgagccacatagaaaaatacttgagtccaactcatgccatttttgaagtttgcaaatgagaaattattttctcattttttttttatgagactgtgattctaagttgacctttctgcaaatagactttcaggctgataaaatgaaaatagtaggtatttttttttttagtttataaacaattcattctaattgttgcctatgttatcaagaagtgtactattgtgagtaaatttcagaatttaggactgtgtgaattctgatccttacccttgatgatgtattttcccttagctatatcactacctttgtttgctaccagtgttataatgagggttgtaggaattcatggatgtgagaggctctaaaagtaacagttcatgtatgcaaagttttttttaaaaagacattaaaatcgctactgcaagcacatataataaaagcaggatatgttcaacaaactcccttgcccttctcaaaacaatgccagattcaaattgagcattcagaattttctaatcgaggttatggcttctgataattaatccatactaaaagggagtatggaataaaaatataagcaggagttttaacattagatcaatatgttaatgtccaggctcccctatatactcagtatatgaccttgggaaacatgcatacagcctgtagtttaaccttaatttcattatctgaaaaataaatagcattgctttgagaattaggagactcagaatatgaaaatgattgctccatgcttatcctgtgtacttggcccacgggagacatccaacacgtttagttttattctgaatccccctttatggttttgacactgagtaatttggtcctataataagcttgctcagtcatttgggaaaggaatgtaagcaaagaaaaataatacacttgggtcctaccactgtgagtcaaaaatattccagatcctaattcacagaagctaatttaccaatctgtgtgattttttttagtgattttattaaaaaaactaattgtcattaaaaagttatcctaaaattttgtttatggaaggcactccgtgtgttttgtcttaatccaaatttatcagtgattttaaactatcatgctttcatcctaaaattaaagagaagctgctggttaaagcagttgtttactaattttacaaaaattatagggcacttggaaatgatttaggtgggaatttaactgataacccacattgtaacccactcaatagtgtagaaaaacacaaaatcttatgctgctggtatatgtcttgtaggtattgttaaaaactatacatatatatgtgaggtgggacctggctatctttatttttactgtttccttctgaggttgtaaatttttaaattggatgtttaaaaaaatcatcttcatgagacaaggcttaccagatatacatcaaagtataattgatatctatttaaggaaaatacatccataagacgtaggtagtaagtaaaaagtttttctacatgatccaaacataagacataattagagcatgtctgggaaaaaaaaggatgtatcctaaatattgcacatgacttttttcaatatatacttggtgtgtgctaagactgcttaatgcatgctttatgaaaacactaccaacactttggttgaagatgtaatgagaacaaatttctacactcacataatcattgtacactcagtaagcattactgcataatgaacatatttgtgtgcttgtgttgggaattaatgcaaaccattttattcatttcacaaagggtatgaatagttctccttgatgtgctaggataatgttataacttttcccagatagggtaggaattgcagtggtatgtttggtcattctcttatcctttgagatagttcaggtctaaatctgggtgtggggtgcttcttcactctcttggatccaagaaggtgctactgaaaagcaactttccaagttgtactacattccacagctaactgatggaattttaaatatttcataaggtagacttaaaaaaatcacaagtaactatgatttacagaatttatagaaacagaggctctagtttggggtcatacctaatacactaagtttcagtgttcaattccaggagaatacataaccaaatcatggtgacaatattgcctccccttaaactcttaaagaactcttttcgtggcaatttacaagatagttaagcaccagttgtcaatgatatatgtttttctttttaaaaattctttgctgcctgtagttaatattaaaaactttgttgttgtttgcgttctatttctttataggctttctttccaattagaatgtaagctttgtaaagtaaaaggcaattggagatgataaatgaaggttgaagtaatcatgctgaccatacttagtgcgctggagaaacagaaggttcctatattcgccatttttattttctgttcatcaaagaggatttaaaggaagatgccatcccttagaccctggcagttccttctcttcaacgtttaaacctccactttacattattgaactaacaagatgttctaggcattctattgcaggcaaggtatgaacaatttcaaatttatcaacaatcaaaatcatcaacaagatgatgttaagtttcataatcactctgcgcctatctttgtgtttgcaagattctgactggtatctacctccattggtttctctgtctttgtcttaatatctttcctgcatggctttctggctatagcagcatggtttgaaatactccctcagtagtccactaccatttatctcaaatagattgttcttttgaaacgtcaaagtattttttaataccttttttgttacagttacaacctaagacaacttcaagttgatattctccaaatgagactctgattcaatgaaatctgttctctctattagctcattttctctcaatctctatctctcttgcttttcacactttactcatctcttcctctctaattgtattggaaactctttagaatcctaacattggagttttggatatggcgggaatcttagtggtcacagacttcatctctgtgctttcacagatgaaggtcccaaggctcagaaaacctatgggagctcaaatctaagaggaagtctaggaaaggtctttgccctgtggaggcctctaggtgtcttactgagggtcaaccctatcatctggtcttagagtttgctgggcagagttccttgtcttatttatctttctgcccacagtgcctggcaccctggaggaggctaacgtatgcttgttaaaatagtcagaaaactttatgccatatctgaagatgtttttaacatatgatgagttaaatttcatcttcccaaatgcagatgctaattatgcgttctgagcatgagaaggaatttgaatgttttataactatatgttgataattttctctttatagagatctgttactccagaggaagaatttggggtcctgtttttctgtttctcctcagatcatttctagaaattagtattagcattaatattctcataatttttatattagaagaaggtacctccaagcttgttttctgagtaagatcctttttgagaataactgggtgtctgctacataaatttgacaagctattttggtggtgaaagtttaaacaatactctgctaagaatagaagatataccctcaaatcacacattgaaaaaggtagtccagatgaaacctagaaattcttcatgttgatcaaccttctcactatattcccaccgtagcattttatctttcctctcatcaaaatctgattaatctcttatgggctttttgttttgttgtgttttgttttcagtcattaatgagtataatgtcagccttttggctatcacttgaattacttagttgaatatttttttttttttgagacggagtctcgctctgtcgcccaggccggactgcggactgcagtggcgcaatctcggctcactgcaagctccgcctcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgcgtgggataacaggcgtagagccaccgcgcccgtgccattatattaaatatggacccaaatttgtctctggcccccaagcacagcaagttttctaaaagattgctttgtcccagattgaattacgagcgtgggacagggcattggaataatctgggcaagtgggccattgagaataggggtaaagcaacacagccatgctactttcacctgtcacttgggaacaataattttggagtgtttacccataactaaagatgtctggaaaatatagacatgcacttctttgcttgtttcctgtcatgttatattgtaaagctcactgttttgagctaagccataaaaatcctcagctgggtccaagtgttccacgactgttgaatttggtcaggaagcttatttggtcattgtactcaagggtgataaaagtccttgaggattaactctcacataatcaagtttacaggaaaatcaacaatagaaaaaagaaaacaaccatggataaatgaaggatgtatatatttgttagctgatcaaaacattttctttccagtagaatagtgaattcaggaaatcatattagtgcttatatgaccattacagattataaaatcaaaataaattgtatacattaatcctaatgattatcaccagataactatcacctgaatttccagtcaagtgaggaggaatcaggagtctccaacatggttggcgggaaactcctttcaaatggactctgccgtcttgtcccttttttatcctcatgcgaattatcattgcttatgagtaaaataagtcaacggaatgcttggtatcgttcaaaacagataaaggtaactaagcaaaatatcatcacaaaagaacaagctagttagcaaaagaaagcatgccgcttatcagcatagatgtctgttcttgtcctctttgtttatcgatctgtctggttttattttagcaagtaacagtttatctagcaaagtttcaaatgcaagtaaaaaaaaactgtgggattagagtacctgtaattttgcttccagacttcacaaatataagaaaaagtccccaaacaactctacgattttgcaaactttctatattttggaagataggttttctgattttcttttatcagcaaaaactaatcaaagttgtcttaggtgagcactatgctcagtagagagtgatgtgagtgtacaaaagaccactttttaccttaagcagtttgcaatacagctaggtagaaagcatcttgaaatggagggaagactaagaattttaagtcagttctgaatgctaaaaaagtgatacaaatcaatcctcttcagaacttcaaaatagaattgggcatttttttttctacgtagcccagagcaatgagagaaagatatttggaggaaatgtgatttgagaattgttctaaaagaaagttagagacagacaaaccaacagagaaaaaaacatcccagagaactttgtatctctgctcccaatctcaggaccgtggagacgtactcatggatggagaaaatggacccacagaagattgcctcaggacatcacaggggttatctagagcaaaaaaaaaaggactaacattcattgcatgttctctggttgactttaatcagtggtttcatgatccaaatgaaattacatgtctcaatgaataaatatgtagctataatacaaaacaataggggcacttttgtattttgggcaggtgggtgagtgaaagtatgtagggaaacattattttcacatcttgtatacattcttgggaggtacctatctgccaacaccctttagatcttttttgatgtagactaaaacattatacattcaaaatgggagagagatgtataaattgtcataagaagtaatgacatgtgtgaaacaggcctcatattttcccactcatctactcctgaaatcctgctcctttccaatttcctgtctcagtaaatggtaccaacattcacccacccagtaactccagtgtaaaggcaaggtgtgatagatttctctttttttctgacactcacattctttctatcctcaagtcttgccaactttactttcaactctgttccagtacagtcaattccccatacccccagaactaccgctttttctgaagccactgtcatctgctacaatagccctctaactgatatttctgttttcattcttctccccctagagttaattttgctcacaccagttaaggtgatttttcaaaactgtaaattagataaagcttttctatagtctctcattagaagaaattttaactgcttaccctcgactgcttgagcctacattttgaagctgctgcgtatgtgtctggcttcatttcctaccactctcccttgcatatcatgtcctaaagacactggccttgaagatgttcctctaacgtgccttaatccttctaacctcagagactttacacttactctatctgcctgggacactcagccttcatatgggtttctctttgttacattcaggctaccactaaagcatctcttcctcagaaagacgttatccagcctcccaaccattacttccaactcattactctcatctcattatcctcatttgtttagcatcatggtacttgtcaatacctggactcacattatatatttctgtatttgtttgttgtccttttcctaacataagtccaataatagcaaaggcattgtctcttttacttaaccccaggatctagaagaattcagggcacaaaagaagtatttgataagtatttgttgaatgaatttattaaggaaagtgggacatagtttgcaagactttatctgaaggagtgaaaagttattttgtagccaggaggacctggattataatctcattttagacacatgctttccttctggacttggagaaatcactaaacaccccagttttatcctataaaaaatggaaattacctataaggctggtttgcagagggaattagagataataaacattatcaacacaatagttggccaataggagatgtttactgatagaataataatacaatagtgaatataagtgtaataaccccaggaggctgagacatgagaatctcttgaacctgggaagtggaggttgcagtgagtcaagatcgcgccactgcacttcagcttaggtgacagatcgagactccatcacacacacacaaaaagagtaataactcagtgccccgaattgtagccaggatacttcaccaaagaaacataaaatataaacacccaccccccaactcttcaactcattatcagtgacttctatcagactcttgaatatgcacccttgggaaatggagtaagaaccatagcttaaatcgtttaaactcatatgggacaaaacgatgaaaatatgcaagagggaacaatcttacattggaaaagaaatcaagccaatgacccaatatatctttttattatttcttgggagaacctgtatgtttaattcatggaattcttcactgtttctatgttgaaatacacttatgtgaaaattgcactcctattaataaaataggactttaaaaagcccaaggattttagtatcgaaatgtttctgtgcaatatattaacattcattgactatgtgaatccccacctgtacttcgtgtaaattaccaaaggtgccctttcctctgtgcacatgacacgtgtgcccttgccggtgtaattggactcatgcttagggcttagtgagaagagcctgggctatatttcaatctcactcaccaccctggccaatctccctttcacagggctcagtccaaacaaccatatgcaacatcctgtaaatgttagataatgaatacaaagacagaataagattccaaatagagtgaactgaagatagacaaacctcagctatgcctttcttccatcggaaattttgaacagcatgtagaataaaagagacatgtagtttctctgacagaaaaagcaattacaagcatgtcacatttaaatgtggatcactgattattattgacccaaactctaaaaaagcactattgtccaagtagcatgcttgtcaatattttaagcctaaaaactaatttgacaaagttgtagtaagcttagggtaggaaagggaggagttcatcaggaactgagtaatccctgctttttagagaatacctttggttttaaacttaattctaatgattttactgagtatcctctcctctgttggacatttcgagttgtagaaaaatgtatgcaagcagttttggaccttatggaagcaacacttaggagcaccatatcagtgtatgagtcactgtaaaacagaacacagaaatacagaagccatgacaacaaagaaagcaggtccaaggaggaaaaacctacatatcggcaggtggatcagaaaagttgcatgggaaaagtggactattgcattggaagcctgtaaagggcaggaccactctgtcatcttaactagcttggtaagcagatcctgggtttctgtattaaagctggtcctttgaatgaatgagagcactaatattttcagctggaggaaaacaacatgaataaaagtaaaaatggaagagtgtagggcctttttagggaaagtagacaatccactttggcaggagtgcagggtgtatacatggaaagatggggtgtgagttgagattggaaagatacgaaagtgttcacctgtagactaggttctaggggagtgtgttgtttttctattttcctattgttttccagataatatatttcttttgaagtcttttgaccataatcaagcctataatctatgaagaatgaattgccatatgtatgtagaaggtatcatttgagtcaaggagtgtgagaatgatatgtaagaggatgttcttatgtaatatgtaagagaagcaataaggacttaatgtgagacaaaagtgaatataatgaagatgaagttttggcatgacttaggaagtgtttgggtgaaacaacaacaaaaaaggaagcagaagggttaaagacaactgacattttgtgcctgagtaaatggaaaaatggtgtcgagttaacagattaggtaaagctaagaggttttcctagaactctggaaatttattaaatattttttcttaacgaaaagtgtaaactggcccataatgtaagcaaattttgactgagattcatggtagattcttagctcttttataattatttaagtaacattaactcttgtttattcattaagctccaagtcatcttatgtagtcatatatttgtgtatatattcctgtcttatcttatgtaatgcaatcagatttgatttgcaaatgtaaatgaactcatgtatttaatcaagaataaagacataacactgaataacagcccttaatgctggtatttgaatatctttctctttcagagattttgtatacatataccccttttaaatgacctcacattgctgatttttaaaatttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctaattttttttgtatttttagtagagacggggtttcaccgtgttagccaggatggtctcgatctcctgacctcgtgatccgcccgcctcggcctcccaaagtgctgggattacaggcgtgagccaccgcgcccggccaaaattttttattttgagataattttaggcttacagaaaagttacaagatagtgtacacagtttttatatacacttcaccttgctttcctaatgttaacatatgatgtaactgcaatccagtgaacaaaactaagaaattaatgttggttctgctaattgactttaatcctgtttctcaatcacttttataaaaatgaaacatatataaaaatacaaaactagctggtgtggtggtgcttgcctgtgatcccagctatttgggaggctgaggcaggagaatcgcttgaacccgggaggcagaggttgcagtgagctgagatagcaccattgcactccagcctgggcaacaagagcaaaacaccatctcaaacaaacaaacaaacaaaaaacataaatacagagaaaaataatatagtctactatttatgggcttggaatgctattttaaactttcagacaatgagaactaacatgacggattgtactctaaattgttagctaattactattaacacaacctacctcaaatgatcttagcactctgtaacagtctccttttgtgctatttattttaaattccaacaactttgaccattatagctgatgtaaatgttttaagtaatagattgcaaaacaaacaaaaagaaagctaaaaaatctgagaaaatgtattgctggatgtagaacagcaagtgtagtagaggctggggatactatcaagaaaatggtaatgaagatagtaaaaacagatcattggcaattaggaattgatgcaaattctttgacattattaagggaaatagtcatgtccctggaggctggaaagagtggccaacaattctgcaaggaataggaaaggaaatttaggtttggggaggactcgtacgttcctcgaatagaaaattctggagatgctgagtttccggcctggcatcaacccactcttgttggatttccagccttattttactatccacccttgttaaattccctcatccacccaattgctcaggccagaaacccagatgtcatacttgacctctctttctgtaattaccccaatctcattgatcaacaagtgctgttacttttacctcacaaatatatttttaaaccatcccattctgtttatctccattgctaccaccctagaatgcgacactcttctctcacagcagaactattgcaataacaccccaaatgttcttcttcagtttttaatccttctctttctctatcctctttcccatagggcaatcagattgatatttttaactcatagatctgataatgtcattcttttcttaaaaccttccgaagtcttttcattgcacacaaattgaacttttaaaagaggtgcaaatgtcctgtattaactggctgttggtcatccctcttgatacggtttgtctgtgtccccacccaactcgcaccttgaattgtagtttccatgatccccacgtgttgtggaggggaccaggtgaagataattgaatcatggggccagttccccccatcctgttctcctaatagtgagttggttttcacgggatctgatggttttataaggggcttcccctttggcggggctctcattcttctctctcctgagccatgtgaagaagaacgtgtttgcttccccttccgccacgattgtaagttttctgagacttcccagccctgcagaactgtgagtcaattaaacctctttcctttataaattacccattcttgggtatatctttattggcagtgtgagagcagactaatatacctctcaactcatcactccttttgcctagatgggatctgctgcaggcaagatattcccggcctcagaagctgaggggagaaccttctgttcttccccaccttcggcttgcattcctccttcagcatcttcttaaggacagtttctactgcacagtgatcaaagttgcagaggggtgaagtgtggatatccaggaacccccattttactgttactgtctttactgcactttccactatccagggagggtagtttatgccctttgggtgcttttgggtgcgtatcagaggaacccactgggaacattcgactgtacttcctatgtgttgggtaatagagtttcctctcattgtgtgtcatcctcagctcacctttttagggatctattccacacaactttctcccttatgatgtccagtatccttccaggtgttctgttagagagcttcttttcatgcttgggaacacaaatatggctcacaggctatattcatctatttttgcactgacgaattctgggaatttaagcagattatcaacattgtaggaagctcttcttgaatcgaaggctgaagcagttagctaatccaagtgtgacatttacattgtccaacaggattcaaagtcaattccactctgtcttcaaacttcagctccccaagtggtcctactgaaatctctttcattaaaattgagtggaaaggcaggcccaatgctccccaaagaaatcttcctcagaaaaccctctcacgtctcttcatttcaggccttatatagtttcaatgtgttcacagccacctactttgaaattcctactttgccacttaatacctcctatataatggtactccaattaaacacttttaatgtaatgcactgatatatacccaaaataaataaaatcttatataaagtgacaactttaactctgattttaaattagacttatcaaattgaacaccaaaagagcatttcagtatgtaattattggtacagatgacccatgtcaaaaaacttttaaattaaagccaaagtatctaatgcacttagaaaagtggaccatcgcggggcgcggtgactcacgcccgtaatcccagcactttgggaggccgaggcaggtagatcacgaggtcacgagtttgagacccacctggccaacatgctgaaaccctgtctctactaaaaatacaaaaattagccgggcgtggtaactcacgcctgtaatcccagcactttgggaggctgaggcgggtggatcacgaggtcaggagtttgagacctgcctggccaacatgctgaaaccctgtctctactaaaaatacaaaaattagccgggcggggtggcatgcgcctgtaatcctagctactcaggaggctgaggcaggagaattgcttgaatccaggaggcagaggttgcagtgagctgagattgcaccacggcactccagcctggacgacagagcaagactctgtctcaaaaaaaaaaaaaaaaaagaaaagaaaagtgggccatcaatattaagtacaaaattctacccttaagtgtattaagcattctttgtagctttattttcatcttctacatgattaaacataaatttccaagaaggggtacatctgtaaattagactttgtaaaggagcaagatacttgtttcgggagaagttcagtaaagggaagccaccgttaaaaatgtcaactattgtatatccatggtaagtttgaaacatgttgcttttaatcttgtgttctaatagccagaatttacagtgctgcaacaatttgtttttaagtggctggaaaaatgtagtgaaacttgttattaagtatcttatttagcagaaacaccttgtaatttgtcttaatagttgtgttattaatttcttatcctgcttgggccacagcctattcagaatgatctgaactgcctatccaatctttagagcatttaatgaatacattttatcttcccaaaagagatctaaacagttaacttaaaaatttttcttaaaaacataaattatattataattgaatattcttggttgttaagtagaaaatagtatcatgtctaatcgtaacataaagaagcagcatacatgtatgctactcaattcgtttagttgctagtatactgaaactacttgagtcaatccttttcatgtataatatgatgcccttaaattttgtggttgaatacttagacaaaacatagaattaaaggaaataatatcattggtgaattattttgccgtataagtaggtaaactcagaggacacacctgttcttgactgagaatgttaggtatatatttgctaccagaatcacatacctcaaccaatagccaaattgacctgttagcattaacctataggaaggaaatggtttcatttgctcttgagaaaaaaatcataaaccagtgtccgaagtatgcaaatttttcagttaagcaaaatgagaagaccagattattcaccaagtaatgccacaaggattgtttatgatattgttaataattattgcctaatatattgggttgcaattgatggtcctcaaatctaaggagattttaaaaaatgttatatcccacatctcatttctgagagatggtggtacctcgggtgtctaatgccttgggaataagatcctagcctctcctaatatgctgagtgcctttctgcctttggtccctcacacaagctgttccatctagtgcagaaacctggtgtgttctgattcccataacggggtcattctcattttaaaaactcatttcacgcattgccttctgttgccttctgaagaccttttctcctggcctttcctgaccattctgtctatgcaagaactctttctcttcttcattctcattattctctatcatagcatataatcctctgatcatttaaaataatccatattgcgtttttagaagcttgaacattgctaaatagatatatagaaaatatatgttgaatgaacaaatttccttcaaacccaggatagcataaaggcaattaaaaaatgttagttcggccgggagcagaggttcctgcctgtaatcccagaactttggaaggccaaggtgggtggatcactcgaggccgggagttcgagaccagcctggccaacatggcgaaaccctgtctctacaaatgtacaaaaattaacctggtgcggtggtgggcacctgtaatcccagctactcgggagactgaggcatgagaattgcttggacctgagaggtggaggttgccgctagctgagatttggcactgggcaacagagtgagactctgtctaaaaataacaataatatgttacttgaatgaatgattggattttagaccaaaggactatttgatgtaaaatgttgtcaatgtctatactagtttatgagttacttcagaaatgtcttttgagagcaaggcctctaataaaacatcatatcccccaaagaacagttgccaatttattgcaagtttttatagcttattatatttatctttcaaaccatatatatataaacatatggttgttatctgactgtctggaagaaataatgctctctagaaatattgtcatgttccaactttcattcaatgttttttaaagtaaaatatgcttagagggcaatagttttccatttctagaacaagtttcacaattatatgtataaattgaagtgtattggcttttgatagcaaaagctataatactacaaatgtctaaattgtattttgacattattaaatataaattgagaagtgtgaggcagtgcactgggctcaagatttgaacttgaggctttgctttaaagaacaatataaactaagatagattttttttcctaaaatcacagtgacatgtattttcttggattagtgaacagtgtggctcatagatggggttttacttttagtccaaagcaacaatgaaagcatataaagttttcattgcctatttaggatatattataagcatattcagcatggggctataattttgtgacataaaatattatttataaagtcttgacatttaaaaatagttttaaacactttctttaaaaaaaacattaactcaagctcattacttttaccaaaatgtagtatagctaatggaaaagtaatacaaaattatgttaattagattgttttaaaaatcccttcaacatggaaaagtatcatgttttatgatttgatatatgaaactgagcatctgtgaacaaatttaattttaaaaagaaaagtaaatcatatttagccctctttttttcaaatgttagagaaaaataaaaaagctgaggaaatacagctagtgatttctgatcttcctttaggaaatcctgacattccagagaaacttggatagactctgaaggattaacccatttctgacttttcaggaagtttatctttcatttaaaaggatatctgatggggtgggatacaaaacttaaaataaagaatatgttaaatgccatctcagggatgcaagtttaacagcggtggtattgggctttagaaacatataaaaacatgacattaacataaaaaaattacaaaaaaatattaaaatgagcatataagtgttttttgtttgtttgtttgcttgcctgtgtataaacacgaaagtggtacatctctcatttaagttatggcccatgtacttgaaacaatttttttgctttctaagtgattgtataatgaatggcctaagctaacatttactttagcattcactctgtcctagtctatccgtgtgtcagctgagttactgtcagaggcttgcttggcttgtctatctctgacctctgcattctgaatttgctctgatgaagttttgtggcctagagcatgatttctgcaagtcatctgtgagtgtggcgcctgctcagtctaaggactagagtctgatagatcagagagaggcaagaatagactcagatgccgtcagttttggaggccaatgaaaagaaggaaacaaaactgaacagcagctgtgttgaaggctgtgcaaggccatcagaaattgggttcttgaggtggattggaggagaacagcctctggatgtctgctgggcagtgacgatgtgtctggaggctttgacattggattcattaggcattgctaatgtacacaaaaaatgtagcaaaaatgatgcctgtttctgggtgagaacatctggagcaccatagaagatgtgggagtaccttcacgtctcaggcattatccataggcttcgcttgaaaaaagttcagtttacttcttatcactagaaagagagtttcactaataatagttattataataaacagattattaaaagatgacagagaaatgtgacattataaggttttgcagaaagaataaaatattaaagcaaaatttgaaattgtttttctaagtggataaaacttttccaaactccaaaatttcaggatcatatgatttgcattaaatgacatagatttttttaataaaaccaccaaattatttaatttaaatttgaattattcctcatctatggaaggagcatactgcattttaaataaggaatatatttcaatattataactcagagagctataaattgtgattttcttgaagacattcattacatgttggagaaaatcatgagactgtaaattgaaatgtttaaaactgatgtgaaaaaggaaaaaatccttatttctaaaataaagtgagggaggaatgggagacggtgaaagtatataaagcgtaagaatgaatatgttccggagatctattttacagcatggcaactagttaataataacgtattgtattttgtactcaaaaaattttacaagaatagatcttaaaagttctcaccacaaaaataagtatgtgaggtgatttaatcattgtacaatgcatttgtatatatcaaaacatgagactgtatactataaatgtataccatttttaaatttgtcattctatcttaataaagctgggaaaaaataaaataaagggaaaataaatcattgaaccaccattagtgttggtatacagtggattatctgtgctttctaataatttacatatatgaagattatcttacgtttagtgcttaaaaagaatttaaaatagtgattctattatgtgtaaatggagtatacagtgggcatatttcttttgtttactgggatatgctttgtgcaagaaaaaatctagaagcagtaatcttggtcattttgatgtaaagtaagagtaatccaaataaagtcattttgctgagagatgagaggaagctggtattttaaataaaggatttcttatgctaatttcaaggtagaagttttggtgtgtgctaattttgcttgaaatatcaaaatggctatgtcatattagattaaaaatagaattctttctcctatggtttttattgtttaaaaaggattttttaaaatgcagcttaaatgaagagagtactctccatttttggttggatcctacattgcaatactcatttaggcatatttgctttaaatgaccaggtacactaattaaaaagaaaacaatttaccaggagctgtatcaagtacagccctgcaaacggtataagctttttccgagaatccatattgtccttggacttggctgttgtattatactttaaacggaattgattgtatggttgtaatgaaagtagcagattgatttttatccagtgttacaaagagtaaatagaaaaatgttcctgtcttgacctgcattcgtaaccaatgggatttgctggctttagacccaatctttaataagagataacatgcaaatgtaataaaactggcttcgaagtttaaggatcttttcaatgctcatcaaagatgtttgttgaggcatttaaatgtgttgtattgattagatcacaatcacctaggaaatgttactttctttaaatgttattcataatttattatgtaattagcattcatagagttgtgcctttatacacatattaagattattgaagtgcgggttatgacacaatggtataccttttaattgtccttaaaattgaattgtcttttattgttatttaagcaaatgatgatggtttaatgactgattatttgtgagtaaatttttacattgcaaaatattagagaaaggtgtaattggcttactatagcaggatattgtagcagtgtttcttgaagggtctattcctgctgaattcagagttattgcattatttattaaaaactgaaatacttgtttccaatagtgaactcagtcttttttctccaccttttcttggtaatttagaagttaaccaaatatgcgtgttatagttacattttagattctaatttttaggacttcatgagcctctattcctgttcatcattttgtaaacagaactcaagcccacaaaacaaggaatttaaactataaagtgcagttgataaatttgctttgctataaatgaagggatgcaaaaaaaaaaagtaacaattcatttgtaagcaacagtttcttcacacattatgtgactttttttggatttgttttatgttttgggtaaaacagtttagtataatgatgcctaaatgagacaaaacaaaataaattaaaaaacaaaacaaaaacaaaaactaacacatttgactgccgatgtttctcagttgtagcttccaagagctctctattcttcccagcccacttgataccctgcaggttgtggcagacaattcacaggaaaagcttagacatcgagcttgcacgcttcttgactccattttaaaccttttgttcacaccagggtggcattttttcacaccgcatgtggcagttttgactcctatccaacttgtcttataaaatcaaagtctgtgatttttacattcacggggctgcttcctgaaccgctactactgtttgtgtctttcctagtgattggtgcagaagtttatagcaaaatgtgttttagggagagggaggaagaagaatgcaatatgaaaaatgttctgggcctgaaacacaggaaataaattttgaataaaacagaggttgactctgaaaagatcatacccgaaataaaatacactggcctctatttctattattttttgcagcactatgctgggtgttcaggtaaattctttatggaaacaatacaatgacatcattttcaggttgcatgatgttatttttaaaaagctgtcatgtaattgcaaaacaaagtcttatcctcagagccgtacagttattttcttatataatattttataatattcagtgagtgcaaatgaattttacttttagataaaaccatttggtatgctccacttaactatgaacaaaacaaaacctattattttaaaaatctatactataaaccacacatttaaacaatttcaataacaacatcatcattcggaaacttttcttctttcccctatgtttaattaaaaatatcacttcagtcatttatactttctaaatataagttgtacagctatttcaaataaattacatgaagaggatagtcataaaataacaacagaagtgaaaaattttaccaaataccaaagtaggtaaattggctttcttctgtaattattaggaagacataaaactatagataggaaatctctgcagacaatctgacagtaatcgctatataaatctttatatttttcctttgaaattcttattttgttaaaatatcatcttttagttgtgttagcaaaaacataacgaaagaatattctaaaatatttgcaaggcatatgtttaattcagttatttttttgtgtagggaggacagaggaggatttctgctttcatcaacaaatagaaaatcataattatattattttttatatttttgcaagttatagaataagcactcttatttttaaattactactttttaaacattaacaattcattcaccaagaaatcagtcaatagaagtaaatctttatgaagtaataagtatttgtgaacagtggtaaacttcaagataaatattatgacgtatttaatttagcttttagctacaaaaccaacttaatgaaatcatttcagctaattcaaattgtataattggtatatcaaaataaccaaattattgtatttaagaaaaaaataacaaatagttgtagattatagtcttattcctccttccagggaatacctaattaaattaagtgcatttgaattattcattacaatatttgaaatatgaaatggatccaataaattgagaaagacttcaatttagaatttagattttttttttaaactttctggacaagaacatagggaaatagcattttgttgtaagtcttgtaacagtaggcatactagcagacagaacaactgtacactttccctttcacagatagaaaactatttcaactacaatttctataaagtattagggaagaaaatacaaacaattttcaagaataactaaatccaaatggttaatgtaagtaaaaatctatttaaaacaaatgaattgcaataaatgttatagtctgggatttctttttattatgcacagatatttatcaagtacaagtttttgcccctcttttagttaatttaaaaatttgacctcataagaaatagaaaggaaaatattttttgtatttgcatatacaaattttataaagatcaaataaaatccttgtcattaaaagcaaaacaaacaattgaaagcaagtgaaatattcaaataaacatatacgtatttaacccaagtttaatattaagccctcttataaaactaaacggcatctagagatctcacaaagcatttgaaactaaaaatatgaaaaacaaagaaaatcatctaaagaaaggtaagtttatgaaataaaatttacctacttttgcagctgttgtatttgttgaaaaaaagtatgactttatttcatgtgcatgccaaagaatgtagaaatactgtatatttagttcatcatttctcattatctagtatagaaaacccacaacttttattactttaaatttcttattttctaccctccccgcctatgccctcgatgtcttcagagtctcttctggccagcatatcttctgcttgaggtggatcaaaataaagcccccaaacagacacacacaaaataaccaccatccagctgaggagaaatagtttttctgcctttgccctatccttatgtgttaataaaatcagctcatacattctgccacaaaattcagcttggaagtaatcctctgctacttagagctggatgaaaagagtactcattgtgaattatgtttcatctgtcacaataaccttctttattctgtcagggacctcccctttgcctgtggcaattagagaaaataggtatgcgttgaagtatgaaatagtgggttcttaaaatgaaacaaaacaaaacagaaactgatgacacatacagacagtacttgctaagcaatatactgcagattagtagaggaggcattttaaagtcattctgattttacaagaacacagtaaaagaatgctttttagaatgagcaggtgttatagttgctattagttattgtcaacattagttattgatgacaagctgtgaattgtaattgtactaaaaatgaaatgtgaaaatctttttatattgtgtactttctaattaaatcatgccataagatatatatcataaatatatagtatttatttaacatatgaaatcgccatgattttatatgcctttcacagatcataatgaatttatgtgcttttgagtctattttaatgctccagaataacatttttgcaaattttttaatgggcaaaaacaaagaaaaactttcccttgaaacagagcttatcagacaattttgtttaatttaaaatcaatgtgattatttgatttacttactcttacaaatcactgaaattacctggaggcagttcaagttcacctttctggaataaacctgttaaatgatagacaccatctcattatctccttgaaagaacacctcaactttttggcttcataggttacagtcaaagttatactatctctagttacaaatgaattaatctagaagatcttaaaaagcttaaaaggaaaacaaacatagttgacagaaaagaaaatgctccttctaataccaaaagaaagtcactgctgacgaagtaactgaaacggtcatcgtaacagttggataaagacatataaataatttaagctaacacgaaattcataaagtctgaagaaaaaattcttgaggctaaaaggaaaaccttttggcccactgcacaggttgggcacaaaagtgcttgctaagctatctatttcacacatgcaacgacagaaggttcgatattcattcgatcgatgagtgaaaaggcacaatggcaaaatcagacagacttcttttcaaatacagatctccaatgtccccctccagtctgcagatgcacggctggtggtgtggctcagacggagcaagggttacatcaaggctattctctggaccgtgcaaacagtctagaccaatgacctgcagcatcatgtcctttgaagaagaggcaagttcggtcatgatgaagaaaaatcaaggcgtaccccttttaacaatagggagcagctcgaggctgcaaagaggtaagcagggtgagaagaaaacggcatctgcttccatggttacaggccaactatgagaaccttgcttttcaaaggagtctgttctcaggctccctcacagggtatgtcatgcattataagcaaaggcaggttgagctgaaatccgcatagttatttcagagtaaaatgatacggagcacatggctggcagaaaaaacagtcacatgactgttaagaaccagacttgggctatttcagaaaagattttttttttttcttatatcagttaaagaaagacagtaaatttgtataaaacaaacaaccatgataaacatgattttcatttctcaggcttttatgtgagcagaggtcaagggtcaagacacccctccactccaatggcaggaccatacagcttattgttaatatagctttattatggatatcattttaaaatattttcctcttttgggcggaccataacatagaatttgtgttcttgtgaaatttctctctctgacctgattctctttgatgtgctccccaggattttctgtgttttagatctcatgttcatttccgttgttagatctcatgcggagaggtagaaggtttggtgagaaacttccttgttgtgtggttactcctctaagatagcgcgagcttgcctctgcctcgtgaaatctgcttatggataattcaaatctgcagcaaaatcattcgcctctgacaatcgtcctgtttctaattcatgcctttgtagtttattcgatgtgtaatacatcaatgagtctatagattctaatatcaatgtttttttcttttctgcaagataaagttgaatttcataatatgatacactagcagctaatgttatctgaataaaaatttgacaagcatgaaatgtaacatattctgtattattaaggaaagaccatagtatatagtaaccacacaaaatgcacacatatataaaattaacatggataagacattcctctgacaatgtaccacaactcaatattagaagaattaatattgggttatgttctaactatgcacaattaactacagatgttccatgcagtgtatcctttgagcaatttttgtttgcaagtatattgttaaaattagggagtgaaaaaggaaagaatctttcaaaggacaaggcatgaaaacaactttcattaaatttatttttcagaatttatgtattttaatataaatgggtaccatatagttttgtgtgtagatattcatttcaaatactgaccttgtaggaaaatatccttatagcttcgcaaaagcaatgaagtgttggtgatcatggtagaaacaattttacgctttcaattaagaaaccagagaaatatttgctggtatgtttctcatatagatgccttgatttgagttgggttcatgggcaaacatatgcttattgtttggtttctttgaatgtgttgaggtacattagtttctattcttgcatggtgagaataacttaaggtctaaaaaaagtgagctattggaatgtcactattatagtataataatctatacactagtataagcactgaatgtattatcttaaagtagccatgttctatttgctttaaataatttacatactaccaaaacaattcaacatcagagtttctttgatgtaacaacggatcacactttctcccaaaggtcaagtggcaaatatttctccaatgaaaaatctacctgtcagttctccaaaggaaaacaaaacaaaacaaaaacaaatacacgaaggtttatacattgcatgataatttgtgagttgtgattaaacggaattgtgtctattacctgaaatctgttgcaaaatagatagttggattcttgttattttttcagttagcatttagcctactcctgcttttttgtttttcaaaaacatgttcagtgttaggaatatttacatgtgaccataaattagatgaacttgctaagtgtggacatgtttaaacacttagaaacattctaatagagtcaaattggtggttcataaaatgctattatttaaacatttaacaaccaggtaaaaatatttaatattgagtatttagtgggaaatgacagcttcttgcctttaaaaaattctctatatctgagttatcaaatagctgtgtattatgtacatcctgcatatagtttgcaaaacctccactcctaacatgtgttagatttaaatattcctttaaattacattttagattaattattgagttttgccctcctcacttcaaaatttgtttaaaaaaggaaaactaaacttggccttgcctaatggagcatttatccttaaacgtgaaaaaagagtctgaaatgtttcagtgacttagtgtcccgatagtgctctgaatatagtatatgctcaataaatacctctctaataaatgaatacaactatggttgcaccaatgaaacaattttcagaataatccagtctcatgaaaatcaggaaatagtcccttctatttattcatatatcgtttctaacctttttcgtatgaccgttctatatgcatgaatccttcttgtcagtaatttgctattagtaaatgactactttgtgtccagtatgactagaagtgtgtgcctacagccacatttcccaaacaaggtcctgtgaagcattattattctgaaacatgttggaaggtattctgagggaaaaaaatcaaagagtcaaataaatgtgagaaagatgctatgttaaacaatggaaattaggtttcttatgtacaatagattttaggacatttaaaagactaatgtatatagtgcatacctaagaagggtgtatagttgacatcatttcacagaactatttaatcaacttttttcagaaaatacttagtaatgtaatatgacctaatttcacagatgtgctcaagctggcttaagccagattgaataaaccaattttaactatctcttcttatattccattttcagtgacatcattttcttagcttgaaatcagttgtggcaggagtatttgcaccatggaaatcagcaaatgctataaatcagggctttttttctttttccttttttgagactggttgttgagcatttaccagcacagcattgcctcattttgtctctgaatccatttttgtaggtaagctgtgcactaaaaggtcagtaagttcagaggctttctattcatcagactgtctaaaatacaaaacaatttaaagcaaattgtgaacattagacataaaagaaagggatagcattaaaaaatattggacactcaatttttcttttaagatttagcggttatatcaggatttcaaagagtttatgtttctgatttctttaaattacctggataaacatctatgtttattcatttatcccttttctatcaaaacatttacatacactggtatgtaattgtctaatcatatttaagtgagttctcaacatgaaagctctgaaaatctccagacatcctttaaaagtgtctctaactcagacccacttcatacgaactttgagttcgtataatgctgagatgaagcatctttaatcaggatatacactttattgcatatcatgtaatttacggcattttatcagacatgtttacctgcctgacatcttgggtgagatttttaggagaaaaacaaaaatggaaaatctatgaatagagaatttgaaaaacacattttaagtgataaatcaattaattcccaactaatcttttacctactaaatttctgtgaataggttaacaagtaaaatctgtaaatataggtagcgtataagtatagatattggctaaataaaagatgtaaaatcatgaatggattcttccttggccttattgcttgaagccatgagttctatggtgacatgttttgaagggcctctggaatctactttgtgacagtatatgagatgatttatatgagggttctaatttaccttcccaaacccaggaacccaaagcactaggcacttcagtttacagagccctcaaattaattaatccgagtgtctattttgagccaagttttgtgttatttatcagaaactaaaacatgactaatacatggtttctgtcgttgtggagcccacagtcaaatgtgagaagaaagcagctgaaatgtgttatcacaagagaaaattttctgaatataacagaatatatatatatttgatctaaagtgatatatctatcaaatttaaagtgataaatatatgtgtgtgtgtgtgtgtgtgtgtatatatatatatatatatatatatatatatttaactcccagaattcttctggtttaatcccagaatctcatatactttttggattctactctcatcacataataggtattggtacatcacagagagctccatattcacaaaacattaatgaatagtacaaccaagatggcaatgatatgatccttaatatagtcttgagtgaggagtaagtacaggttgcgttacagaatcttgctgtccatcctgtttgtaaacatagggaagaatttcacataacgtcaagattctcaaaggatacttcactattaaagataaatacaagcaattctaaacccagtgaaaattctcacagacattcagcttagataatactgtatgcctgtgtgtttatgtatgaaatacatatttgaatactcattggataagatgttctttgtatttggaaaaaaatcttttggacatactaacattatacttctgaaaactctgaagccaatataaagttgtaaaaggctttacttttcattatatcaaccacgctggaaattcatacacaattttatcactggaaaattttcttctctgtgccataaaacctggaactcttctttcaaacagcacctcccaaatttgaaaacgtattactgtaaaatatttatatatgaaaggtttttaaatgaattattgaatgtcagatatttaataaaaatacttttgctatttgatagataaatttataagcactattatctttcaattttagataaaataattttatatatttttaaagaacatatctcacatatctctgctcttgataacaaatagtgttttttttttaagaatttctatctagaaaatttaattcatttttctgggcctagttcaactattctctcttttgtatgtctcttctcactggactatcttctctttctatctttcccccttatatatactcatctgctcttcacttctgttccgcttatatttttgctaaggtaggaacaaataatggtaataaataggtggcaaagggaaaattttaaaatatatacagaagatctttacattggaatgctgtagtaattgagtctaaaactcagctctgaactttgaaccacttttttaaaaatgctgtgtttgaaccttaaaaaatgtaaaataaaaacaatctccctcccttctgaaaggggaaatgaccttcttactcctgtccattcttttatctgagcaatgaggggtgaatgtgtttataaaaagccatgtttaggctctatattgccctgctttccaaaaattattgtttgtttttactaacataagatcacccaaagcaatttcctttaattagcatgtcataaccttcctatttttgttgagtatcaaatccatttgacttagccatggtgtgtctctgtgtatgtgcagaccccctaatgttaacatgtgttaaagtaagcatcgctcaatactttgtttttacagatggatgtcaactattgtgcttgctacattactttgtggcctcttttgtattctttttttctcaaatgattgactccatcttcatttacttccaccaggctgttcaattttgcttccattaaaaagaggctcaatcctttaaatttctttttttctttgagggccacatccatggacctaaaatatgtttttttaaattcatattcattatcatatattttatataaatcatattatcagttaataatatatattgagtattctttataggatattatttattgctttgttaattatacttatttaatatagaaatagttatattaatactcagtattaagtaagaataattctatgtgatagtgttactactttatatatatatatacacatatatcaatatgtatggtgtgatggttcttctattgctatatactatacatactgctatacatatgtatacatgatgaaatatacagttttctatatatactgtcaaatattgtcaaatatatttagtcaaatacatatagtttgactatatatagttatattcatatataggatatatgaatatataaatatagaatatatttattcatatatatcctatatataagaatatatataactatatgtaagccaaatatatataaaagtaacaaatatattttactatatatttgaatatataaatgtatttgaatatatatgtatttgaatatataaatttatgcaaaataaaaacataaataaaatatatatagtcaaatatgtatatatataagaataacatttctatgtgatggatcttctattgctgtctgtctatctagtcaaatatatatcatcatgatatatatatttgaaggcagataggttctctagttttataccagttaagcagttaactttagtaactctaagtgagagtaactcttcaagtgaaactttgaaagagtaacagctcacaggagtgtaagtgtttctccttgaattttacagtgctcctccctcttctttgggataaaggattggagagggtgattctttctgcctcttttcgtcctcctttaaatgaattattatctttttactccagcattccaggactcagggtgtactttttaacaacacacctaaaagttgttttgttttaccaattcttttttaaaaaccccaaatcatccagaaagcagttgctcctctttcatcctgtaatgaacctgcagagtaacctggggatattgttaatactcaattaagattcaggcatctggggtggagtctgagaatctgcatttccaataagaccccaggaggtgatgatgatgctggcctattggttgaggttagaatgtgagagttagaagactttgcttcaagttttcgctttgtcccaattctgatcttaacctagagacttaacctccctgatcctgttccttatctataaaatgggtggaatcatgtttcttctgcctgcctacccatagaattgttctgtacttcaaattaaattaaggaggaaagcactttataacaaaagaacagaagagaaggtaatgcagcaggatatttcgccttatttcttgaagagtatattttataccagtaacctaatttcctttagagtttgcccagttagcctaaaatgatgacccctgttttaaagttatcttcagtagttctttatcctcttttactctcctctttttgttcatttattcattcatcagacacttattgtgtagctactatgcacaatacattgtgccagctgctgtggttgcaattgactctttccatttacttctacttttttctcattctttcaaatactttgatttattgatttcactctgtgctccatgtctcccatatcttttacttctgccttcagtgggatgttgaaatcactaatttgaaggttgcattcgtctctttgaatcaattgtatttaatttcacaaatatttactgattccccattatatggcagaatctctacaaaaagaatacagaattgaagaacagtacttttttttaggaaaaaaaagtttatatcctatttgggaaataagatttttaataatttttcaatgaactatagtaccaggcaggagatttttggtgtcataagaaacactttaaaggaggaagtcacagctgacttgaagggtttgaaaaagacttcttaaaagatggctaaattgtgacagaaatagatgagaggaagaagaggatagatattacaggtggaacaaattataccttcccctctctttgctttcattcatggtgagtgacttgggaaaatggtctggtgtaggcaaaaaggtcttaaaagtatatgagggaaagctggaagctcttattggagtcacactgtgatagccttggatggaagctatgggagtctgtacttaatttggggggcattaagaagtctttgaaagttaatgttactgttgaccttcctgccatgcattcaaagtcaacctttaattcaattctgtggaatttaaatgtaagtcaactgtcgggctctgggtttgtacagagcagattggcaacctccaggtagtcttttgccagttttcatcaaggcagcatatcataatggacacaatatagtggactgcatgaggacgcccggctgctaatcctggttcactaacttgctagccttttgaccttagagaaggcattcatctgtctgagtcttcagttctttcttataatgatgggaataacaaaatgcctgttttcaaagtttatgatgagagataaatatgaaagaaaaataaattttgaaaatgtaaactttgaaagagcaacagctcactggagtataccggtttctccttgaattttgtagtgcgcctccctattctttgggataaacgattggagagggtgattatttctgcctcttttcctcctcctttaaatgaattattatcttttcactccatcattccaggactcagggcgtactttttgagaacacacataaaagttgttttgttttaccagctctccttcaaaacccccaaatcatccagaaagctgttgctcctctttcatcctgtcatgaatttttgttcatgggaggttatattaactacattgtcattctgaccttagcttaaatatcaccacttaagatatccaccacccctgggcacagccacagtgtccctcatggaacctctcaccatctttttattttccttatggaattgccttcctcatttatttgcttgtatattgcatgtctctttagccaataagattttattagttcattatgtggcagacactgtcacaggaactgggaaaatgtgagtgggtgtgtccttaaagaaacagacacataaatattgatactaataatgatctatttacctatgtgtataaatgccagtaagtaaaaagtgctataaagaaaaataaagcaagctgaaggattagagactgaaggttattatgcctttttttttttttttttttttggtcagaggttcagggcatggttccttgattaggtgctatttactcaaagaccaagaggaagtaagagagtgtgccaagcctgtacctagagagaaagtggtccaagcacagggaattgtgagtgcaaaagctttaaggtggagtcatgtgtggtatgttgaaagacaaggtaggaggccagggtggctagagtgcagtgagccagcagacagcagtagacactgaggccagagggttagaggacagggcctgggcaccatcaaataagctttggagttcctgttagggtcggagatctcactcagtgtgacatggggagcctctccggaggctttgggcagaagagtggtatcatcccactcaagtcacgtcggctgccatgtggtgatgaggctattaggtggctagtgtcaaagaagggagaagcagcgttatatcggaatgggctcctaccaactcagcagaagccatgtgtgcatctcttcctgaaccatgccctcatgtcacttgaaattagccacggcgaaggtaagtccatgtggaaatctgcaaatactatagaggatttcttctccctcccttgtcccttccccttctcgtctttcctgcatttcttcctttcttcttcttcttcttcctcctcctccagttccttcttttctctttttttttacaacattatatatacttatttattgtttataagcaaagttgttgataaacacttaccagcacatctcagaagagacttttagaagtgtattgcaaccatttatgtaaaagatggtggtggcttagactagcatggtaacaaaggaggtgataggaagtggtgagattctgcaaggaatcttcaaaggaagcacggacaggttttactgaatgactaagaaaacggtggagaaaacattcctcgacaaaatagtagagaaaataatgagtgaagcctggcttccaggttttcatcttagtatctaaaagaatagttatcgtggattaagatggaaatggcttcaataaatgagcagtttgtgaaatgagtgttaaaaacctgatttcagacatataaagattgacatcttaaggtgtagccaagtggagatattgagtagaaagttggatatatgagcttcgtactcaggaaaggagtctggattggagatatcaatttgggaagtatctgcaaggagaatagtatgattctgttctccctaatttaaatgggggctgattgcatatcagaacagagaggcaatgccaccatacttccactgcatcttttgcagactgctgagtcaggtgtttttttgatgctttttataattttaatataatttgagcaaccaaatgaaagttgctatggattgattgaacccttactttttctgcaattcattttcatagttatgcttcttgcttcctggaaccaatcagctacagcatcacttctcaaaatgtggtctcagtactgcctacatcagattaaataggtgcattgtaaaatgtagatttctgcattccagtgtcagacctatttaatcttaatattagtccagggacccgaaaatatccattttacaaaacaaatacgcattgtctttattatgcaaataacaatttggcccctcctgatgtaatgtttaaatataaagtttaatatctatcgttttgtaaggattcccatggcaaaaaaaaaaaattgtttatatcatttatatatttaaacctgcctgtacatattctaggttgttcagattaaaatagatttaatttcagtcatatagatttcaatcttagttaaataggaaaaccaaatttaatcatcttttttttttttttttgaggaaaagtgtaattttagggcatactgtagatatactgttcaaaacaggaaacctgagttttcaactgtaggtattggattgctatggtaatttaaatagcaaatatttctgattttctcatgttttgggtgacagaatcgtgttgcatttcccagctctcgtgatttagatggtatagaaaagtaattgtgaccaagtgtgcctggggccagagtatttaatttccagtgttccttcatcttacttgtgtctttctccacatttgaggtggaagctgccctgttatcctgcttagctaagatgctacagtcagcaaagcttccctgctaacctgtaatgaacgtttaatgtgagggagaaatactttgtgattttaaactggttggtactccagcataatctaaagcatcctgactgattgtgactttctctagcaaaaatgaactgctctaacctgagttatctcctatttaacatgctgacagcgggaattgatctaaggtaattcattgccccaacaaattagggatttttttgtcaatattttgacctttgacaaatgagagataggtaggaggtaaaggtctcttcttttacaaatttgctactaattaggttgtttcaaaaacaaaaacaaaccaagaaacaaatgttaccgatcgatttctgcaaaggtagagacttttattaacaatcaggtatgaaaccaaatagcttgttctgaataatctggagggtgtctctgttccttgtctttttaggtatgccatccagcactttgtagaaaaggttcactgcagagcaaatgcaactgtattctagtagcaggagcaatgagccttctagtagtaccaggtgaaggaccctccttatatgtccaggagtgggtagcaattcaaatagattttagatcaaaggtaccacttcaaagatgttagactcacaaccttttcctggggttattttactttgttcccacagtggggagattacccagtgtttcttgccaatcacatatcttcatcatcatttttctcatcaatgaaaaattatttgtaactgtcttgtaaattaccaagctcccatgggtagtttcacagtgcaatatttggagacttgaagcatttgccacaggtgcccctagagtataaactactgattaggaaatggtagatcttaaccaatgtaaagagtggatctctaattagatttctttaaatcttagctaacttcttctagtgtgtacattaaagaaaaaccaaggtactgtgaaatctctctactggagcattttaaagtaaagtataggcactaacagaattaattacagatttttgtttattttcccctatgttctactaggactacaaaaaccataaaactcaccagaatcttacattattttattcaacaaatgtagaagtattgcttgatcaagtaatgtggtgcttgatttttaacaatttactgtagactttgttatcaatatttaactagtttacttcaatattaaacagatcaataaccatttgttatttaaacaaatgtttaaccacaaacatacctatatgtatatggatgtgtgtgtttgtgtatgtatgtataattgagctgcttatatatcatgtagttttttaaacaaaaaaatagataatagcatcttaaaattaaatcttgagacattgggttataagtttcaattttgcttttctttctgcgtattcatggtctgtagaggagactagacttccctaatgttttagtttccaaatattttgccaagtatgaatgaactaggtcaacgaaggaaaacattctttctgaagcctacattaatattctactgtttgaaaaactgggctaacccttcaatcattttgttaatatttgtagcttctcacagagttgtaaaacctcataagtaaacataggtttttcaaatctttacctcattttaaattcttttagttactgttgtgaataaagaatttctggatggctaatatcagctaataagattagtaaggaatgaattgtaaatagagcatataaaattacttattttcaaatacttcttaaaaacttgaaatagtgtctctagtattataattttatacatttgactttttatgatatatttaatggtaacatttaaaataaaactgttttttaaaagtagcattttactagcccaatgactgaaaaaaagtttgtaaatttatagattttaaacaaattgaatggtgctagtttttctattcacttttgtctctaaaatatttttggtattttgtaaacagcaataaaaatagcaagagtaaaatttgacttcatggaaacttaactgtgactggacctcttttaataatttttattaattttgactcctgtgaattttgatgtttggaggttatatatttccaaacttaaaaaacagacctacaataaattagattgattattcctagtgaagtactttactaatattattgatattattgtgtagtagttattagggagtctaagaggaagactatttttattatagggaggatggtttcaactgacaggttttaaactaaaatgtttaagcattttagacattctattttaataagtatgttttagttttaatttttttaagaataaatgtgaaatgaatgatttggatataggttagtttatggaaatttttgatgatgactatgtattgattacttttcatttcaggttattgattattaaaatggcattataaagagatagctccaaaataacagtgtcttaattacttgaaagacatgttgttttaatattgcactgtaacataccataccatatttggtgattttttttctctattccagttttgtatgctactgtagggcatagaatgtgagtagcacccctagaactcaaagtatatttttatgtgaagctgaaatgtttttaacttgactcagccagttaataatttttggatttggcaagcttcagtacggtcctatttttgagaaaagccaacaaaagtatttatcttctaattcaatgtccttttttcccttaaagagatttttgtgtgcaaatgcttataaatgtattgttattacagtaacactaacatattctatttctttctacggtgctaaaaataattaacatttatggtacatttaaacttttgtcagtcagaagatctagttattaaaccaaatgaaataggtataacaataccttctgtattggagttagattatctctgaaagtaatacacacatcagatgttatatggtaccaccgctacctcaaaaccatgcatcctaatatgtttatttataataaaaattttaaatcagtcatacattttcttctgaaatgcatacatagcatatgcaatggactggtggaaatactgtaccatttctcattacttattagaatgacttaaaatattggttttggctaaacaactaatcagtattttagtggaacagatttacaacctttcctgacagtaaaatacactttttgtatataacatttcttacccaaagacagttggcacagtagtaaacttaataatcacctccagaaataaaacatggaaaaacaatgttaaattaaaaacaattggcaactttagatatacgtatatgcttgtgtgtatgttaatgtgtgtatattatacacacagagtttatacaggcatataataatataccattatgtattatatatatatataacatagacatataatatatatttaaataaattatataagtatatataagtaaattatataaatacatataaatatgtaaacataattatatagatatataattataaaggcaatagattctaaaactcaaaacagacacatataaagagaaagttactaatcatttcctcctgtcatcctgaggcagccaatgtcagagtgtggtgtgtgtttctttacctcactcatgagcttctccaagctcagaaagcacagatgcacgtttgtacatctcttttgttagaaagagagatgtggttttgtttctgtggtttgtttttatacagaaactatcaaacacattgctcttcattttgttttttatagataccccttcaaattaatatacagaatattcatattaaggcatgctatttttaatttaaggaaataaaaatctggatattcattgtctttcttttatcatagccatagtaaaaagtaccaatattgtcatggactgcaaatctcagggatattttaactccagatctggtaatcgcatgaaaatgactctgatgtctatgggaaagcaggaaaccaagatttacaaagtgaattgcaatttggtagacaatgttcttttactgatctacttgttatctagtgctatctatctccaaaaatacctgatcctcatggtagaatacatgcttcactatgatataatggttgtagttttcagacaccgtatttggtgaaaaaaatcacattataaaaccatacgtcagtagaaaggaatgagttagggaatagatttgctaagcttctaccaatggtataaaggcggatgcaggattttctttagattaagactaggtataatgaagagagcaaaaataagttaagccatggattaatccaagtgaatacagttcaaggaaaataaacatgatacaatcatatgtaagagtaaataatattcctcaatgaaaacattataacaattttgtttagaatgccataggccatcagaaagctgtatatatatatatgtattatatattgtatacactcatctattacatatttaacatgtattacatacatattaatgtttattatatattcatatttcacgtagtatactgatatagtatacctaccatactgttaggtgcatctgactttttccatcttaaattttgcatgcacaaagtatatttcttgttcaaaatttaaatcctaacaataatatagcaaaggtagatcatgcttttgagaagctttttaaattaacaagtgtttaaaagtctttgtatatatgtctgttacatgtgtgtgctatgtgtgtgtgtgtgtgtgtgtgtgtgtgtgtgtgtgtgtgtttagcattgagcctaagttccaagcaaccagtgtgggtcaggcagatttagttcagctggaacgtaaggagaaaattgacaagaatgattcaattcaatctatcaacattgattaaatgcttactatacactaggtactcttctaaacgttcaggtcatagtagtgatcacaaaaagtcccaagcaaacatggttcttatattctacaggtggtgctgggggcacatagagaggaggaagacattaagccaaaaaccaaacaaataaaaagcatcatactgtttttgacagtgtcaaatagtgtgaagaaaaataaagttggttgggtgtctatggggagtgtttcttctatttttggttgcagatgattttttgcagttggtagcatctgagaagagacctgcaagaagtgaagaagtatgctaccaggcatagcccgggaaagggcagcccgaggcagggaaaagagccagtgaggttttcaaggagagcagagtgtggcatatttgagttataccaaagacaataaaatggtgaaataaggccatgaaaggccttgttggccatatcaacaatattggattgtttttcctaagtcagttgggaagcccttggaggcgtttgatcagtgacgtctcagttcatatcatagataagtgaatatgcatattttaagagttcactctgcggccgggcgtgatggctcacgcctgttatcccagtactttgcgaggccaggtgggcagatcacgaggtcaagagattgagaccatcctggccaacatggcaaaaccccatctctactaaaaatacaaaaattagccaggcgtggtgacccacgcctgttatctcagttactcgggagactgaggcaggagaatcgcttaaacctgggaggcggactttgcagtgagccgagatcacaccactgcactcccgcctggtgacagagtgagactgtgtcacaaaaaaaaaaaaaaagagagagagttctctctgctacataaaaactagcctgagaggaaactgggaaattggttcaacgcttatggcagtactttggaagagtgaacttgtagacactaggtgcttcaaaacagaatgatattaataacataatatttgatttataatttatctacttctcacaacagaatagaataatatgtgtagagctttaaagcaatactagcatacagtaagttccatggaaattctaactattaactttatcctctgtatcatcataatcaccatcatcattatccaaatccttaatagatgctcttgggaaaaaggtcattttaaatgatattacaaatatgaccctcttttcctcactaaagtcaagcataagttaaaggatttgaggatgtgccctattacagagttgtttaagaattttacgtgtaacatccaatgtttttttcatccttaagttgttgcatgagttataattaaacctaatttaaaaaaacagctaaactaaattggcattgtttctatttacattttaaaaattaaatcctaatcaaacttttcctcttcatttatatgaaaattttgtctccaaatgtgtacatttattttcagctgacttttcccagcctgttcctcttagatagaaatgtcttctctgtactattgtttttatatgatttttttcaatgctcaaccctacttgatatacatacatatacacaaccatgtacaacattcactgtactctttgaaattcatggcttagcacatgaaaagtagcatattaaactttaaaataatacaaatatatttggttatccttgaaaaatataaacattcgcaaaaaatatcaccagccgcacatacatatattcatataaaataatgtatattaataaaaaacttatataggcaatgatacaatcattaagtgttagcttggaagtagatggtatcagaaaattagaaaatagttcttgtgtaagttattcttctactaattggttcttagtttcctgaggactgctttcttaaaaacagatttacatggtatgcagatcagttttgtgtagtgtttttgttttgtggttactattattttgtttgttttatgtgtgtattttttaaagtctgacagagtgataaatggtgctagttttaacttgagcttcaaatactgattgatattttttaaacatacacctttgatacaataacaaaacaaataaaaacagagcgttaagtcaaatggagaaactagcacagataaaatgttctagttttctgatctatgcctggcaaataaatgtatgtacttagggaaatttggtgtgttttcctatgtgatacataaactggataattttaatatattccccattttggacattatattagagtgagaaaaacagaaaatatatttaaaatcataaaaagtattagtaaagttctgaaattaaaataactccatgagtatttttttaagaaaatattttcaatttagtgataaatgagtttgtatatatacggccaaatccaaaatagtctaaagctaagattgaggcctgtctcagctaaattacataaaatcaaatgataaaagttgacacttaactcatcttggactttggatgtaaaacatatgttgctgatgttagtttgacatgtgtcaaacaccttcaaaatgtatgtatgaatatttatattcttcatacatacctgtttatgggataatattgaaattaaataacattcttagaaaattaatgtgacaatatccaaacagaattgagatctcagacacaaaacatctgagtttaggcctatttgccattgacctattactaaagtgcttctgaaaaatgtcctcacagaaggttgtttggcctttcatcctgctccaaagtgggtgagcatagctcagctgatgtctacaaactgtcagattctatgagcagagatcgtgtttttccttctaacagtataagttgccgttgtttaatcttttgatgtggctctggaagagaatatggtcattggtactcactctagggaagaaaaagagcagttgggggtggagggaggaggatgcagattgaaagacgtaaaatagtggcaaaagacagtgttccttctccagaggtgaagacctgagtcccagctgggagacatgtatcagtttctgtgcctgggaacttcacatctttggcacctatcttgtgctcagtgtaagtccagcattaagatatatgtatttttcctactgcatagcatctaaatggaaaccagtcatatcattaactggttaattaacagataacaaagaagccaaattaaaaaacaaaaataaaaattctgcctttattagactaattgagaggccccaggttttcaccatgcatggttgctttagaacctaactccccaggaagatgtggctccattctgctaggaagcagtctagagcagcactatgcaaagtggggtccatgggccaggcccttctgagaacagtttgatacccattagaaaacatggaagtacaaaaatagagagtaagcctttagaaaatttcatagaaaatcaacccaacatttgtctgttgattcaagtaataaaatatgaatgttttaatgtcagtttttacatttagtttctctagttatccacttttactgtaaattggaaaacattacttcatgatttaggaaaaaaatagtctggcttagaccacagttagtttgagaagcactggggtagcacttttagagtttcaacacagatcaatataagacaagtgtgatcaatggcaaaagtattttcaatcccttgaaacatcaaggcaacaatgaggttgcataattatatccctaaagaaatttacatctttattaataagctttgtcctctctcttttcttaagtattcatgtaaaaacattctgaatgcaaaaaatcatatttaaacactaaatagaatgtcagtagaattgcatttgtatgtgttaaaatcctattgtcattttactataaacttcttctctccttgctgttattgcctaacttctacagggcatttgtatgtggccttcttaaaacatttactggaaagaaacttaataaaaataaatttatcaatccaagatgtgatttctcatgagaatcttgaatatctgcatttagaaattatatatatggtcatttatagaaaaaaggaaagatctccttaaaaactggaataagaaaatgatttatatagtcatgctaacaaaatatcttattttagcaaccacctgtctatcactcttaccagtgaaaattattcataaaatagctgctccttataactaggggtaagagatatgcaaacaagactgcttttaatcttgaaaagcatgcaaaacaaaatttaaacatagacatcaaaagagaaaaactgttctccaatttgtcaccaagtcattgctccctatattaagtccagcaattcacgaaaccctcactcattgtttgcagtgccctgtagcaagctggaagtgtctttatatgtattattaaattgccgttactgccatctagtgggaagaaatactccctgtcactatgtcagggattgtacataaagccctaaagttctaagtgtaaagggaaagccacagtttgtgtgaatcgcagagagcaaaatggcaaactgaagacacaatctcatgacaatagagacataatagacatctattcaccgaataagttaaagaggtatgtaggacgaaaagaaagggtgtggggaatgcatgcattcacgagaattcattttgtgtacacccaaaattacatctaaagtattatttcttattgaacacaggttacctgaaccaggacattttattacatgtagacttattttgtctttaccttttgaatgtagatggattgttttgcatgtgcttattaagtcttaaaaatgaagacagcttagatctgttcttaaaaggtaaggttcatacgaaacactgtaacgagggaatcttgttacaatgcagattcagactccccgggggtctgcatttctagcagctcttaggtgataccatgctcctgtttatagtcagatcatactttaggcagttacaggcttcgagtgggttaccaaagggaaggagtccagaaatgaagcaaactcccccacagagtatatttcaccgcttgttatcttgttgttataatgtaatagactagttcattcaatggcctatacagtcaaattgccaaattcatttcttgagtttgttacttaactatgtaggtaaacttggacaagatatttcacatctctatgacttagtttcatcatctgtaaaataaaataaatcataactaaatatatctaaatagacatacataaataactatctcatggttcttatgggaaataaatgagctaaaatctcaggatgagccatatgaaattgtcctctttatagatgaaaaataaacatccacaattttatatagttaaaactaagtatgtaaattatttagtataatatgtagcacctagtgaacaataaatgttagtatcagcaacaattgtcactgggtaaattcatagacacatgaatgtactaacaccctaaaaagtttctttcaatgaagaaaattttgacatcaaatacacattatgcagtagcacatataaaccacgaggacataaaaaaaaaacaaagactctggataaaattaataatatgataaacctgttctggggaaaataggccatgaaagtatctattgttttctaaattattagagcaagcatacttcatgtttttgaattctttgtcgttcttacgctgtaaacatttttacatgatttcaagctatgttacattccttagttgtatggtgaatcataaaatgtgtgataaattatttatatttataaagttttgcctcaaataatagcatttagcactgtgctttgatgaagggacattcatttgtatgaaaagcagttctgcttcttttgagtacatttagtcactttgcttaaatgaatagatatttcctaattttgaccctcaggttttaaactttgcttgaagtgtactgatttttgctcttgtgaagtattgttggtgaactacagagaagcatgtaacatactataaaactataaactttaaaattatgagttagaatctggttggtattaacttaaattgatgttaatggttacatatacaggctatcaactgagatatattgtaattctttctaaggagtccttctttttctaaaatttgaaatcttttcaaccttttgatgtatataaaatatttgttataaacctgttttataatgaaagtaatttttattaccacgtagtttagagactaaacttgtaagtttcaaggttagtggaagaaagaatttaagccactataatctattccacatgggcaacaaagtacatttaaggaataaaactattagactatatttattgaatgatgaaactcaagctggtgttatataaagtgatgaaggaattactgaattctctttttttcgttttttgagatggagtctcgctctgtggcccaggctggagtgcagtggcactatcttggctcactgcaacccctgcctcctgggttcaagtgattctcctgcctcagcctcccgtgtagctggtattacaggtgcccaccaccatgcctggctaatttttgttaaattctcttttccaaagatgcgatactattattctgttgcagcaacaaaaactgggtatacacacaaaataattgaaaacatgatatttatacatctaggctcatgtcagcattattcacaacaggcaaaagatggaagcaatccagatgttcattggaaaaataaaatatggtgtgtacagacactggaatgttattcagctgtaaaaaggcatgatattctgatacatgctatggcatcaaagatcattgagaacattatgctaagtaatataagtcagacacgggaaaacacatgttttgtgattttaattatataaggaatctaggataattaaatacataaaagcacaaagtagatcagtggctaccaggaactgagaagaggaggaaatgaggagttaatatttaataggtacagagtctcagtgtgagatgatgaaaaagttctatagttggactggtgatggctgcgctttacacttaaaatgactaaaatgatacattctatactgttttgtatattcatttcagtacaataagaataatttataaaagacgctaatgagctcctagtcatcatatgacacaaaggtgtcttttaggaaccatgaaattaatttaaaaaaaaagtctactctcatacctacacagctattttccgtctgttatggtaagaaacagaagttaaggttgttaacaaaaataatttggaaagcaagacaggagatcaactgtttgcatcactttaggcgaagttaattgacactcaatgtctgtctttgtcttttcaggctgctaaaacaaaacatcgtaaattgtctggtgagggcctacattctggttcatagatggcatcttttcactgtgttctcacattggtggaaaggaagaactctggtttcttcacttccttataagggcaccaatcttattcacgagggcttcaccctcgaaataatcacgtcctcaaaacccccaccttctaatattctaataccatcacgtgagggcttaggtttcaacataagaattcggtggtggtggggttggggggagagggaaacaaacattcagaccatatcaatgctttatttttctctttttaaatctggccattgtgagaattacaggagaattaaaggcatctgtcatcatcccagacacatagtaagttcttaatatgggtggttattgttattttttctgatgttgttattgcttgaactttcaagatgtagggacaaaagttttatataaataacaagaagttcaactaaacactgtattgtacatcctgtaaatatgtagaatatggaggcacaaaaatgagctttaggaccaaaatacaaatatgttaaaatagtttagactcaagtgttaatgctagatggtcagtcctgaactttgccaccctactattatcagagaagtgaaaaataataatttttttttcttttttcttttttttttttttttttgagacggacttttgcttttgttgcccaggctggagggcaacggtgcaatctcgactcaccacaacctccatctccgaggttcaagcgattctcctgccttagcctcccaagtagctgggattacaggcacctaccaccgggcccggctaattttgtattttgagtatagacggggtttctccatgttggtcaggctggtctcaaactcccgacctcaagtgacccacccgcctcagtctcccaaagtgctgggactgcagacgtgagccaccatgcctggcctctaagaataaataataatcttaccaactattctatataagcatttttggcccactgaacactgtgatatgtaacttcattgcaccttcacatcaaccccaccaaaatatacgtaacaataggctaactttaaaattcccaactaaaacaaaaattgtgaccagtaaattacaaagttaataagagacacagtcaaggttgaacaccaggtcttctgactctaagtcaaactctctctttattccctgttgtgtatcataggttgctgtagaccaagtattgaaaatcttgtgttttcttcattttgcattcttagtttatgggattattcagaaaaaattaggagagaatacagtaattcaaaatctacagattttttaagacacagatttttggacatcagtgttcaaatcaatagaaagtcatgcttcccttcagcagcctttattttgacaattttaaggggcaggtacactaaatttctgctgattagatggaatgaatcctatccttaaatcataaagagtgttaatgaatctggtagcaaaagttgattgcagacttcttacaatgacaccatgggatgacaactgtgttaacacaattttgaatatctcattaaacattttttctctgcatgtatatttttcctttttttttttttttagacgagtcttgctctgtcgcccaggctgagtgcagtggcacaatctcagctcactgcaagctccgcctcccgcattcacgccattctccagcctcagcctctcgagtagctgggactataggcgcccgtcaccacacccggctaattttttgtattttttagtagaaatggggtttcaccgtgttagccaggatggtctcgatttcctgacctcgtgatccacccccctcggcctcccaaagtgctgggattacaggcgtgagtcaccgcgcccggccttcttcatacaaatttgttcatgtaatatattaattgcctgcctaccttcctattacaggtttcttaaactttggtagattctcttttgtttctgttcaccaaggtccttcttcatacgaatttgttcatgtaatatattaattgcctgcctaccttcctattacaggtttcttaaactttggtagattctcttttgtttctgttcaccaaggttttgccagaccaagctacaggcagatttttaccattaacagctccttctaaagttattcacgtttggtcagtactctgggctgaaattccaaccatcagtactctttcactttgaaaaataagcttgtttgactttatttggaaacatataactggattgctgtgctggatgctagtgagcaatggtttaaggaccccgtttattgtaggaaagtttattacattttgttttcatactgctttacagggttggaattttttgcagcattggtatatagacaacatgtcatttgttttagttgctacatgacaccttaaagtttattttttctccaaaggaaatggcaactgtattctttaaaaacacctatgtaaaaatgaaataactaaacttgtttttagagtattctatattctagatggataatgccggaaaaaaaaagatgcatgtgtacagcaaaacttgttttatgaaacaactccatgggccaggaaaaattagttgcctaagaaagatgtatagttaactgaaaattaaacacatattgtctttgaaatttataagacatttaaagcatccatttaacttatcggtggtctccatatctgtatagttgatgccagaaagagagaataaaagattacctagagaaatggactttaggtaagattttaagatatgaaacatatgaacaaaatttagttttccagatgatttgtataaaatactgccagataatttgctaattatatggcactggggacaataacaaggattaatgaaaatgttctaactcaacagatttttaaataatatttttcttatacaaataataaagatttattgtaaaaaatagaaaatatagataagaaagagggaaattattcataatttctgctttttaatataaactatgcacatttcagtatatcaacatccatacatttttctatgcatatatacactattgcatacttgaattagtccatattgtacacagtcttttaaaattcacacctttaacataaatattgaaaatacctttttcatgtcataatagtttttgagaaattgagtatcattttaaaataaaagcaatgtccttattgtggaaaagcctagctcctccctgttgattttcacaaaaaatctatgtttggaaatgatagaaaacaacattgtatcatagtgttgtttttctagcaataccacataagctcctggtgtacaatctaggcacttgtgggtgtaacctttgagcatggcttcatgtgtttaagccttagggcctcgagcacgtcctagaacaagtatggagaaatgacattgggtatgctaaggggctgagaccatggtgaggtgtagaatatagaagggctcaggagtaggtctggctcagaagtcagtgtatggggtctaggaagcagctcaatgtaggaaggatgtccttgaacaaaaaggtcaaaaattggataaacacgaattctctgaatgagcacgcatccataaactttaggataacaaaaggccaggctgcaagagactgtgaaatggatatggatcacaataatcaattaaaaaatctttgacatacattaattccactaatatttattaagcataggatagttttatacaccattcccagcttaagacagcttataacatacacaatatggtgagatgattgttaagtaataaaaggcaatatgtaattcatatggtccaagaataagtgctatagggatttgtttattggaaggtttgcttctgacttttgcaaagtagaaatttataatgataatagcggccgatattggcaagtattttataggccttatttttatgttcacaacaacatgtgcataaattattattttcaggaacacagtgcctatggtggttacagtcttggagccagactgtctgagtttgaatctcagccacttactttgtggcttttggcaatttatttaactctctatttttcagttttctcatctatagaaaagaaataatggtagtatctatttgatttagtgattgtaaatactaaatgtgtttatatataatacttataaatagctctacaaatgttagttattgttattaattttattttcgtggtatagaaatgaaggtttggataattaaggtgatatacctaagttatgcaggtagtaaatgttggagccaagggtgaatacagctctctcttacctgaacctgagttcttaatgtagccactttgatgtctcaaactttaagcatgacaagagtgagtcaaagatagtttggattttgattatggatgactggaatcattcgtgaaatagggaagtgactaggagaggttgtttttattgctattgttggataaaggaaaggtcagatttaagatgtcttgaattggaactggtgaggaggcattcagggtgaaatatgtagctgtgagatagaaatcctggaccagaactctgtggagagttggagtggaagctgagattagggtagtatctatgttaagttaataataagattggcagggagataatattttaagaagcaacatatataaaaagaaggactacgtcgagaagtcatagcattattaaccatggggaagagaagctattaaagaactcagaagcagaattgatagggtccaaccagagtcagtgatagcctgtcagcatgcaagatgaagtccaagaactccactaacaacagggtggaactctcaactatgtgagtagagaggaaagatttttctatttttttgatcatgaaattgcttatgaggtacaggccccaggtgttatgaagaatatgacttggttcgtttggggcactgaaggtactgggggaggcgctacttttagagcgctcaaatatgccacgatttcatttcattttgctttctccaggcctgtgacatactaaggcagtttttacttaggcatcgatatcattttcaatttggatcatttcaaaagaaagagaaggacttctatgtgtgtgtgttatatgttttttggcttttcttagtcaagtatttccgaggatattctaccattccttctttttaatttcctgtttttgtttgtttatcaaatgcaccagacaatttatctttcccagaagttttaatttttgttcctatctacataggaaagagctgggaaacagagttttttttttcatatttagattgacattaaaggtatggcaggttctgtttggggagcaattttatgataaataaaactaaattgtgctcctagaagttcatagtgctgatcaaatgacacttatatgttggtctttctttaaaaatttgttacagaaaataataaaaattctaataaaattaattctacttctaattaaagtctagaaataaatccactatgattattttgtcagctttagctgaggaataacaaaatgaaataggataattagctggagcatggattttctgaaatagaggacagtaaactacagttttggagagaaatatctaaatctgaagcacaaaaagaagcaacaaagttgttggaagttctgttctaagcaactatgaatttttttgtagttgctctgctgatttctagggtatttctctatagctaatacttggaaagatacttcctcattgatatgtgtttcctaaaggcatcattggaagttgcttcctatttgtctgatgggttcaggttggtatgttgaatccagtgatgctggaattcaggggcctaaagttcaaggcagactttaggtccccaagattagaaatggattatctgtttgtgtagtctggaatttcatatttcaagttgtatttgaaaattcattcctctgttgcattatatgacttttggctcttggatcattcaaaactctgtcatcgtcttggtcctttgtgtcaatttgtttggttataggttttcacaaaacatggagtagctatgctgcacaattgagatttttcatttattctacatctttcctcagccagcacatgattatgtgattggttcaatagtaggtcctcaccaagactcttcacattttatgttgcctccactagtgtcatatcagtgtggctttagtatcagccaaattcagatccaggattttgttgctgaaaacttaaatttagaatcacatggtgtatatttaaaggaactcttagattctccttttaaggaaagatgtctgaaaattttaaacataggtgtctgtcattgttatggtttggaatttatactatggctgaaaatatcattaaatattggatgggtatgatagcagtattgtcacatctttagctcttttttggttatatatatatttatataggttatatatatatatttatataggttatatatatgtgtgtgtatttttggggacatcttgagttctgggacagcctgctttggtgaaaagagccccaattttggtgtcagactgagtgtgagtgtaggctacattcagttctatccctgctattttccaacggtagacactttagttaaacttattttctctgagcttcagtttctcaactaaaaatgggggtgctacattgtcaggctgctaaaagtttccaatgaggaaatgctaggaaaaccatcatagtatttagtagagtggaatcgtaataaataccagctgcctctcttctctctgccttattccaaattatgtacaccaggatgatttttaatgcaaatgaataccaaattttagctatcatccaattcttccacgatcattcaatccctgtttagttcatagaatcataacagcttggacttgaaagtgacttaaatagcatctagtgtaatctttcacctaaaaggcatggagtcttccagattatggttgaatatttcccatactgagaactctacttcacaaagcaacccactataatttttaaacttgatcttcaataatagcttaaaatcaattcctgtaattatcaaaaccttttgcatatctaaaaccatctatattaccatgctttaaatattcacatgtgaagacttcccactatcttctgttgtgtctcatgtgataaatttttcagatccttcaccactctactaattttcacttttaaagtagtgtgttttaaaataagttggacatttttccctgtaaaatacgattgtttcttgctttcctaattctaataaaggcattcaccttctcctggccacacaagaaagtacagttagaatgtacccatgccaatgtttcttctatacatcttttgaaataaaagtccctaacttggatataatattatactttatatcaataaggtgaacagaaaagaacttggaaagcacccccattcatgctttcacaagtggatattatgtactagcattttagaaggcacattaaaatagtcaagaatttatttcagcattcagcagttcgtgaatccagcagctccagaccacaaactgctcagggctctgacaaaggggttggggaagacttttacagggtgaatgtagaagcaaggcaaataaaatatttgatttgttaaagtacagcagtagccttatttggatcattccagtgggaatccctagtcagaggtatgattgacttaaaatatgaccatttacactgagtggggttttgacttgcttacataggaatcaagggcgctggagccacctcaccccgctggcctcccagttaattttttaacaagagaaaacaaaatgaaaagatattacttttgctaaagaacaaaatgtctatttgggaaaccaagaaaaataacacagtattatcttctctaatatagtgcttctcaaactacttgtggtgaaggaaagtttaaaaagaaattttaatatctgtacagactaatacttttgggaaatacaaaaaaaaacgaattactagaaaaagttatgtttaagatacaaatctctatttgttgttttaatccacaaattattacttttttattattttaagtttagaatcttgaaaaagcttctaaattcttaatttgtatacttactttgtcccagataggtaatgaatagtttgctgagaggcaccactctcagtccacactcagggtaacactgtattagtgcacataaaaataaggtacaactgaatcaaaaaaaaggatcttgtagatgctagagatacaacagtgaacagaccaaaggtcccagagtagagaatgacagatactaaacaaagtaaaatacatagctatagaatttataaccatgcaatggttataaattccatagaagaaaaaataaagcaggcaaaaaggataggaataacatatcgagggttgcaagaaaaatttaaggctatttcttttgattcatggtataagtttttttttttttctacaagcgaacgtctaatcacttatctgtgatggtgattacatgaggttagctcttgtaatcaactattttgtaaatgataaaattaggttttctgaggagaaaatagccttttattcacaagggtaatttttatttttaatatgttaattttaatattttaaaatagattaatatgtttctgattttggctactatttgttttaagatattttacctatggtcataaatgaaattgggctataaattttttattgtgttcttcttattggttttactataaaagctgtattacccttgtaaagaaaattggatggcattccatctttttaaaaaaatctgtgaggcggtttatgaaaaatagagtttgtatgtattctttgaagagaatgatgaaatctacctataaagttgggtaaattgatgagtgttatcattcagttcgctatttctctctttaattggtatcaaatctataatactttctatctactgaggcttctattttaatgtctgtattattagtttccaatatgtctaattttaaaaatcagcctatttttattcatatctgctattataagctcttttaaaaatggatattattaagcatacttatttttagtctttgttaggttgttacatcaaataaattcaaagtaaattaaagtgacaattttggggctgttgcttgtcttttctatctatactaggtcacttgtttaggtacttaggtttacaagcttattctgagtgaaaaggcaagttagaagactttcctcccctccttactcactgtcggcatttttgcagttgcctagcccagaccctccccacatttgagttgaagccacttcatcccaattgcagaagctgttgggttgcctggttcaatttctgactaaaatttatctgtatttaagcccctgtccttttataaagctaactccccaaatagcttcagctgtgagtattttgttttgcttatttctcttgttcaacctctcactcaacaagggagctctacctcaacctctggtttcaagcaaacagcatgaatgtctctggtcccccaaatcatgtggaagatactttgtttcctccttttaccacaggaggctgaagttttggccacctgtgttcactgtgggcttagccctgcagctccacttgccgatttgcatttctctgctgattttcagtcattgagttttcattctgttcttaagcctggatttgtcttttggatttttttattcttatactttatttacattgccatgtgtttgaagtggaaataatattttaaattatgaatgctgtaccatcttgactggaattctccttttgtacaaatgaaatctataaatgttttcttaaaaaggactgtttaattgggatctcctaaagtatagcttctttaagtaaaaaaattgtatatttaaccggatggtaagtgggactttgcctggtgaaccagaatttttagtaagcctccaaatctgaaacaatgttatgggtgcccacacattctaaagacattactagatcctcagattggacaccagagaaagaaacctggctgtttcatcttgtttgttttagagttaaaaatatataatttattttcaaagtaattataagaaaaacaatgatcacttctcaactattacaaaaaattatgacagggtttcagaaaaggtgttttttttttttaattgagatagtgtgtgacattttagagttagattttaaatggatacgaacagaatgtaggaatcaacaggaaaatgtaagcagctgcaccaaacataatctctatttcttttgaagtcattgcccacaagaactcacaaaaactaccccatgagaagtggcaccaacacgggttacaactgcactaattaaataagattctctctatgccttaagttctccatctctctgctgtaaccatgacccagcataatgagtagggagaaggaactcaagctgtgaattgtgggaagatgtgactatgcacacctttccctctttctctgttactgcagttcctaagcccgtcaagcccagcagaagagataaaggtattagactggtctgtaaatttcaatgcctaaaaatatccaccaagctgtagatcttcccaagatatttttcaggaacgaagcatgtaaacttacatgagtgaaagacagtggtaaaaaaaaaaaaaaacagtctattttgggctttggctcctacctaaatctagcttgttcaataaacctgttcattaagttttatgttaaaccatattcgtgcatttttccttgccattatacttaataatgcaactttaaaaatcttaaaataaatgaatacttgatttgaaatgttcatgtgtgtacagactttttgattgaagcaaaaaatatttaatgaaatcaaaccttccagactttaaattgcaacccaattcacatgaatacaaatgagcttaaaaataatattgcatatgtataaaaaatcaaataagggaaatataaatcaacagctatgcttgtatcggtttaattttaaggcatgatacaagaattactctgctgcggctcattaacacactactaaaaagcaaatcatatcttttctccattttatgtaacattttattttgcctgattatgtgttctcataaaataggccttcatgacttatataaatgtggaaagaagttatttctgagaaatgttattggcaataaggaattggcttaggtaaactattttagaattggtaagagcctatatggagatcaaatgtattaccatgtaaattcatataccatatacatttcatttcatagctttgctgttattgttgtttcttatgtatatagcccaatacatattttactcacattctccagttgtctgatatcttcgtcagatttttttctcgggtctgtctttaagatttagataaattgaatgttattagcggtactcgttcaattagaatgtttttatgaaacccataaaacattacactgctagagtaaatgattcagcatatgattcaaaccaaactaaatttcccttcaacccaaaataatctctaagtcatagtggtctatacagaatttagtcatattttgatatttataaatattaatcataaatataatatttagagttagtactgaaatcatatttagtaatgataagaatctacttgcttattttgagattaatcactgtagctcctattgtcaaatatctaccgacataaataaaaataaacatgagtttgaacatgttaaatgcacaaagatcatctgaaagtaccaggttgagtaagaaatgattaaagacatgaatgaatatttatattttatagaactttaatttcataataagaagaaagaactaggtatagttgtattatttggcctttataatgaatagtttttcttaatatcatttacatgtaatatgaagatattctgggatgttgaacagtcttccagataggtaaaaggaagggattcaaaagaaaatttgaatacatatttcatatttatctttttgtgagcttcgtaataaaccacacaaagctttcatctggaatacttattactaaaacttgcactgtagctgtagattgacattaacagggaaaaataaatataacccatttcccaagacactaaaatatgctaaatgaagtaaaaaatgtaaagtaattttgaaaacttaaattgatattgaaatgtgagttagttttatcttagtcaacatcattgttattgaagaaaggcagattttattcaccggaattatttattttagtttagattaaaagctgctttctgacatatgagttgactcctgtatctacttttctgagatactattggctgaaacatgttgattaaattttgtagtaacttaattacaagattcagagatagtaaagcttttaatgtaggttataattttataatatgaactgacatttctctagtgctctgcagttttcaaaatgctttcataagcattatctctttccatttctacaacaattttgcagtaggaaataatagtatccctcttttagagatggaaaagttaaagtttcagagagaataaatcacttagctactagatggctgaatcagaactcaagcatgtgaagagaggtagtatatagcatatcttaagaatcttcgtatcaagattaacagccttggagacaaaaggtctttgtttaaattcatactttaccctttggttgttgcgcgctcttgggcaactgagaaatctgattgggtctcagttttttaatctgtttaatgggatagcaaagttcattattgggtattgtgataagtaaatgagttgacacctagaacgtacttagactgtaccttgtatatttttagtggatgcccagtaaaaatccattgattgttgttgattagtaccaattcaaacgtgaagttgcagattgcagttatttgatgttttggtctgaattgttgtctttagtgagagacatctaacttaaaatagcttaagaaaaaaaaaagggtgacttattagaccactgagttgggaaaagttgctatactttcatacattcaaaggaaaacctgaatcttggattaaatggcactgaagactcagttcttccccaatctatatctctgttcatttcttctttctgctgtctctgcttcttcatggcctagcctcgttatcttctaccatagataggctttgtccagagtgttcatttttccatcccagggaagggctctgattggctatgcttaaaatttgcactggctctttatttccaaaagtattgttagagaaaatggggatatggatgtcatatggatatctctgtgtctaagggattggtatgttaccagaagcaattgaaacaacatggcttttggagaaaaactgaaaaaccagaaacaagatgataatgaaaaagatacaaagtagtatattctatctgactttctgcaaatcagaaagaaaaactgttaaaaactaagaaaacttggttttgaactgagttttgagatcagttttaagaattaagtcttaaaactaagaacacttagtttggaaaacctttgaatataaagctgccctataaggttttcagaggattagtgttccctcatgccaccatcaggctagcaccaggcagaggtatctagtgttgcctgacagtgatgtgcaggggagaatattgctacaacaacagacagaaaggatggtgatggtctgatttcaaaaacagatcagtgtaactatgtagctacttagtcaatagcaaatttcctagacattcttatgttttgctaagatggcagtagaagcttgactctgacagttgctccaaatgaagtaataaacctaacattctagttaccttgtcattcatctgtcttcaaggtggaatacatatatcacctttgagtgagcattcatattgttaaaatattgaaatgtcatccaatgccataattttcaaagcatgaaatttaaataaaatcctttgcccaacctctcaaatacctctgtggtctctggatgacactgtgcaaaccacaaacctatagaaatttcaggggaggttgaattaaagaactatcgaattaaagggttgatttgcagtaattaacatttcactttctgaaaaccccatatatttaacaacactattataataagttaacatgtgcttcagcttctttctcactctacaactggtttaatgcttaaacatttcttctctatacttggtatgatttcctccttttcttgcattatataagttctgcacttgttttcaatgtccaaacttgaactcatcacctgtccccaaaacctgtcttccttttattatgtctagctcagtagttgcgcaaatttgaagcctggataacacccttgaactttttctcaacccatgaattcatctttagtcagtcagttgactctaattcttaaatagctcttaattctatctatttatgtctaacatgatgcctccattgcacttttagcattaagtttaatttcttgacttgaacttctaggtcttttgtaattggttcttgttctgaatctgaagtccttcaagatgcaattcaaatagtgttaaaatattgcataggttgtttacataatttcacagaaacttctgacaaagaatatcctcaacatcatgcaggtagaagcatcataaaataccactatatgattaatctataagggttcatgaaacaatttagttaaaatatgcctattttcacatacttagataaattcattaattaatttttatgtcactatcttgcctggtataaagtaggaatttggtttccccccaaaagaataagataatgaatataatatatagctgtaaaatgaatatacaattgggacctggttagtgttacttctttttatggtcatccccacttactatagctgacaaacactggcacttgcttctgtttcttttcacagttaatattcattactgctttgtaatataggactttccaataaaacgttttcaaatagaaactatcctggaatgctcatatgttttttgttttcttttcatatatacaagagccaacaagtgcagtcattgtagatacttttgatcattgcagatggtcaaaatgatttttcaataatttagaataatctattcatttcctgaattagggaggctagtaatatcagctatgtttattaagcgctggagtcagttctattttcttgtaaagtttaggtataatgatcattaagaatcaccatattctcctgaatttcccccagtctttatatagacttttattttattattatatgtatttattttgagacagtgtcttgctctgtcatccagactggagtgcagtgatgcaatcacaatccacagcagccttgacctccatggctcaagtgatccccctactttagcctgctgagtagctgggaatacaggtgcacaccaccatatccagctaatttttaattattttgtagagatagggtctcactatcttgctcaggctgatctcaaattcctgggctcaagtgatcttcctgcctaggcctcctaaagtgctgggattacaggtgttggccaccatgcctggctgaatgaatttttaacgtaaatgtataaaacatgaatctcctctgaactttcaactgttgattccctggaaaatgaaggttgttgattaaatgcggtagtaacatatgtatgaataaaacatactgtatctgttggtgctatataggaccttgagagcacaagatttttcctaactattcattcttcacttttttagctttgttgcttaatatctattagtacttatttgatattttaaagcttaaggggactgagaaatgtattgttaaaaataatttaaattaaatgtaacaaaagatattttattatttctgatcttatgcaacagattttattggaggtggaatgaagtttgttggtaaccaataagatctatttcaaaatgtatagtatgaaatattttaaagaaaaaagaaggaaaaccagaaaagaaaaattaaaaaaaaaaaacaatgtcttggatatattattttttattttttgagatggagtttcactcttgtcactgaggctggagtgcaatggcgggatctcagcccagtccaacctccgcctcccaggttcaagccattctcctgcctcagcctcccaagtagctgggattacaggcatgcgccaccatgtccagctagtttttattttcttttgttttcagtagagacaggattttgccaagttggtcaggctggtctctaactcctgacttcaggtgatccacccacctcacctcccaaagtgctgggattacaagcatgacccaccacgcctggcctatcgtgggtattgttattagtggaactttcctttcttcaaagtatattgcaataactactaattttctccatgtatctagcaaagataaccccaataaaaggtattaaattataaagtaaaacctagctattggaaagaatttaaaaatagaaaattaaagctacccataattgtattacctaggaataaacaagattggattccattcattctagccctttaaaagtaaatatgtgcatgttgtcttagtttgggctgctataaaaaattaacatacactggatggattatacaacagagttgtatttctcaaagttcttgagcctgggacatctgatatcaaggtgtcagcgtggctaggttctggtgagggccatctccttgctgtatactcatggcagagaacagagaaagaaaaagcaagctctctcttgtcttttcataaaagcactaatcccactcgtgaaggtttcacggtcatgatgaaattacctttaaaggtctcaaatcctaatattacattgggaattagcatttcaaaatatgaatttttgtgggacacaagccttcagtccatagcattttttcattgcccacaccccaaatttatgttctcacatgccaaaggcattccttcaatctttacagccctgacgtgccagtgttacctctaaaatttaaagttcagagtatttaaaaatcatctaaatcagatatggctgagactcaagatactattcatctagaagcaaggaggaaaaattggggtatatattagccttttgatcttaacatagttacatgaatgttgatcattgtccaatattctattataatggctatataattgaatatttattgctctatcattctttattttataattctccaattgctgaatatattaagtttatttaagtttttactattataaataacactttgatgaacacatatgcatgtaaagtctatatttatacttccttaacatggattattaatacctggaaggaaaattactatttcagaggtaaagttttatcaatatcttcacttctggaaaacaccagtgtatgtggtgagaagggatcaaattgctaccctggtataattaatatgatatatttaggttttcattttcatttatatttcttatgtcacaaaaaacagaccttaattattatgtaggtactatacgagtgaaatgcatgtgttgttggtataaagagatcttggagctaagataattggctagaagtattgtcttcttgattggagcttgcatgattcatttcagatggttaaagtgtttataactgctttgaaagtttacataagagattagcttcatttaatttgttctagagtttctcagagtatcttcactactttcttttcttttcttttcttttttttttttttttacaagtttctgttgtatctctattgatatggtttggatctgtgtccccaaccaaatctcatcttgaattctaatccccatatgtccaggcagggacctgtaatccccatgtgtcgagggagggaagtgattggattatggaggcagttccccccatgctgttctcatgacagtgagtgagtttcatgagatctgatggatttaaaggtggcagtttttcctgtgcttacacttcacttctttcgcctgctgccatgtaagacatgcctgcttcgccttccgccatgattgtaagtttcctgaggcttccccagccatgtggaactgtgagtcaattaaacctcttttctttataaattaccacgtctgaggcatttctttatagcagtgcaaaaacggactaatacatctactaaatagaacacttatataaataagttcaattaaaaatatagtaatagtgttataggtagatagataggcttgaatggggaaggggagggttctccccccaccttcacccactagaaatgtcaagggatggttcggcagttattacattgcctgtctaaaagtgatacattgacagccagtgccagggataggccattttctgagggtccacacctgttaacattaaagtgtcagttaaagacaggcctcgggggaaacaacttgctgggcatgcatattaagagacagaaatgacgaagtatgatcttccaggtaccctccactggaaaaaggaagaaagccttagatgggcatgctaacaactccctaaacacactgcatgtgctcaattcccaagggtaaggaaggcactgtgcatgcgggaagcccaccctaagggaagaatcatgggaaagaggtgagcctataaagtcccaggatcaaggttaaagcttctcctttgttctcccttttaccttcaggcacccacttgcatctcttctgggggttctttcctttctttcctgttctaaggctttttaaataaacttccatttcttctctgaaagttgcctctgtctcttttcctgctttatgcccctcagttgaattatttcttctgaggaggcaagaattgaagttgctgcagacacatatggattcaacgtggtaaccttggagtaacttggatctcttccactgataaaaataacatggctggtagcacatttgtttttaaggtttagaagagttttgatgatgtcacttaataagaggatagaactgatcaattttgtacataacaagtcataatgttgaataactgtatttggaaagaaggcaaaaatccagaatttccacttcctgaattggtactatttgtctttccatttaagggttgatttgatcacagatcagggattcttaattgttggtcaagaatggttaaactcatctgttttttctagtgggtgtcatgattatttaacaaataaattaacttgccaatgatgtacatttaaaaaaaaaaaatacctgggttctgggattggaagagtgatcctggtatgtttgtgaagacacaggagagtggttatgggtagagcagaggaagcaaaaggagtactaatagaagagaaaataagaaaggtaacaggaggaagttttgtcaagcctactggctttaaggaatggacttttattctgaatgaactagtacaccattagaagttttgagcagagaagtggcatgtaatttccatcttttttttttttttttttttttttttaatttttaagacagagtctcgctctgtcgcccaggctggagtgtggtggcgcgatctcggctcactgcaagctccgcctcccgggttcacgccattctcctgcctcagcctcccgagtagctgggactacaggcgcccaccaccgcgcccggctaattttttgtattttttagtagagacggggtttcaccgtgttagccaggatggtctctgtctcctgacctcgtgatctgcctgcctcggcccccgaaagtgctgagattacaggcgtgagccaccgcgcccggccgtaatttccatcttaaaagcattagcttagctgctaagttgagaatatgcggtcggaaagcagggcagttttagtaagacatgttggaaatctgcttttcaacatgtaagatggtgatgtattgacccaggttgttagcagtgcaggtgttgaaaagcaagaaataaattttggagatagagccaaagtttttactagtggatgaggtggggttaggtatgactgcaaactttttagcctgagtaactgggaatatagagttgcagttatctaagttgaggattgatatggtttggctgtgccccacccacatctcaacttgaattttatgtcccagaattgctatgtgttgtgggagtgacccagtgtgaggtaattgaatcgtgggggccggtctttcccgtgctattctcctggtagtgactaagtctcacgagatctgatgggtttatcagagtttgctgcttttgcttcttcctcatttttctcttgcccctgccatgtaagaagtgtcctttgccttctgccatgattttgaggcctccccagccacgtggaactgtgagtctagttaaacctctttttcttccccatctcaggtctttatcagcagaatgaaaagagattaatacaagggtgaacgcagtaatgcaggcttaagggctgtggagaatcacaaaccatatctgggcatgttagggtatctggcaatttttagtaggcatttacttggagtgtggaatttaggagaggagtccctgctggagatatatacttggattttgtcagcttgtagagtgcattgaaagctacaaactgaagctattaatattaccatcattagattcaagaaatagtaaatacatggactcataaaaaatattttttgtatagtaatactgtctcagcaagtagacagttggagaaaacaagtttagattttgtgtcatcattatagagtcccataatctgacatggatttatagttaaatatttatgtgaagcacctattaaaaacaatggtaagatttattagaatgatataatttaggtcattcaaggttgccttgttcccctgtaccatctgttttcattttaaggtgtatataaactctaatgatataattttcaaactttatttattttagttttgctttcttgtctttccaatgtgcaacacattcctatttgtgatatccctcagtccaggtgaaagtgtgtggataaagatcttcccaactcacatgcccaacctccttccccacttccaccctaaccctcacctctttaatagccctttctctactgaaaatatcactgataaagtgactagctattttactattgcagttctcaaacaaaaagcacagtatggtggagagaacctttagcttcatggtgttttgatccgtaaatttaatctacatttttgtatgtgcatttacgagtgcttcatgaatgtctcctttttcattattaggtgctataggttgaacatagaatattaggactagcatataagccttgtattatttagttagtttgcagttgtgaccttatttctcgagtgctttcagatatacttcttcattagatgctcataaaagccatgtgaggtaggcaggatgtgggaaccccatatataccttaaaaaactgaggctccaagtgttttggtcccgctgaaggtacagagtttcatgacaaaatgagaacccaggtcttttgtatctaataaatatatatgtaggtgtgtgtatagtggaaatatacacatgcacatttgtgaatgtatatatatttcaatatatgcctatgtgagtgtgtctcctcataacaagacagatggtaatatatatagtgaaatgtgccagaggaaaaaaaatatattgttatctgtttatgtaagaatgctaaaatgtttgcaactgtctacaaagaaagaaattgttaatgtttttaattaacattcaaacaatttaaattttcattgtgtgattagttttaatagcttattttatattacttgagaatctaatacatatacctattaagtcattaaattcaaaatgactattcagaagatgcatatttaataaaataaaataaccaagtttgacaggttattttaaaacacttacagaccaagatttccaaaggtgtgtttaaaaagtaatagatggcatcaactttaactgtcagcaaagtcagtccttatggagttgcctaagaaatgtgattcatttgaaagtcatatttgataattctagggtaatattcaatctaaatttaaatttcatttacattaagtgaaagctcaaatttttatttttgtttttaattctgtggtataactctctcctttttggaaactaccacttggcttaagagttaatcatgattttgagagcactcttagttctgagatggaaagtaatatagtagtaccttcttctaaagagttttttttatgagtgaattgaatgtcattgaaggacagcagtggacatagttgagaaaaggaataaagacaaagattggttcacaaatttaatctaatgctaatgagacttcttatttagtttgtgtaaataaaataatacatgtaattagtgctgagcagcatatggaacccattgggaatgtgtatttctatgtgtatttcaagggcaccagagtcattttgtttacaagtacataaactgtaatgtaactttccactacaggcggcaacatcttaaaatatttcacacatatctgtttcctgatgtattttaataatcttcttccccaaatattaaatttgaattctactcaactttcagttggactctactcttaagtaatattaaaatgtttcatgccctttttttttgagatggagtcttgctctgttgcccaggctggagtgcagtggtatgatcttggctccttgcaaattctgcttaatgggttcaagtgagtctccggcctcagcctcccgtgtagctaggattacagactcacgctaccacacctggctagtttttgtatttttagtagagacagggtttcgccatgttggccatgctggtctagaactcctgacctcaggcgatccacccatcttggcctcccaaagtgctaagggattacaggtgtgagccaccgctcccggcctgtttcataccattttatttattatatctgtaaatgaacttatgctagtttcatgcctgaccctccatatgcattcaacagaagcttgcatacatgatgagagaatgaattcctataaacattgaacattcttctgtaaaaacttcttgatcttgcaggttattataacactggtatttcaaaagacactggctctagttagttttggacgtcaggtttttagctcctagggcaccatattcctctcattcctaattttttctgtttcattgatattttactgtactatgtttatccatttgtgaaatatgaattaaacattaacttttgatatgatttgatcaacatacttactaatagatgtcaattggaagtgaagataacacacttttgattgtagaggaatgtgatagtcattggttgactgagtggaggatttgagttataataaaaaaaagattactatcttttatttagaagacagattccttgggaagcagaggcaggtggatcacgagatcaggagatcaagaccatcctggctaacacagcgaaaccccttctctactaaaaatacaaaaaattagccgggcgtggtggcgggcgcctgtagtcccagctacgcgggaggctgaggcaggagaatggcgtgaaccctggaggcggagcttgcagtgagccgagatggcgccactgcactccggcctgggcagcagagcgagactctgtttcaaaaaaataaaaaagaatcagtgcttccacatttctcactgtgtcatgtaaaggtaatccccactaagagtcgtgtaagtagctaactcactaaagtgcatgcaatctgttgttgaacctcaaattttaaggaagcaagagatagtcctttgactcctcagccgtgtggggtgtgtgtgtgtgtgtgtgtgtgtgtgtgtgtgtgtgtgtgtgtttaagcacatataggtgatgagtattagaagggggaaatcttgcaaagccacaccacatcacaataaaaaatgtgctattcttctgagttgactctaatggtagggtatagatcccggggagtcttggaagaacatctttatgatttaagatgtcagaggttttctgagtaaaggaaatgttccagatcatcattctcttcctttttctattgagctcatcattctcttcctttttctattgagctcatcattctcctttctctattgagctcgttaaaagagtagttccccgcctttctataagatcacgttaatataatcagagactccacttccaacaggatgatgaaaatatatgtttatttgttttaagctggatttctaatgtttgcataaatgagtaaccttgaggaaaatagcattactattcattctcctttttcttcttattatttttttctgttttgaaagctggaaataagcctcagacatagccttcccttctaggttttcttaaatggctgtatgttagcacatctttatctacaaaagtagatttaggaaattaataacccaattaacattgtaaattaaaggtggtaacacacttgttcaaatctggattgattctaagtctcagacacttaaatttagagattttggcaagaaccaccaagtggctgaaataaatgaagaaaacaggaacagtgccaattagaacactggaagaaacccagaattcagtcatttaatgaagtgtttaatattgcagagcatgttattgtgatatattttatgtcaaagtgctaaatatatttgatcatttcaaatgatctctgccaccattttataaagtgttcatgtttggaacactcatttcaccatacatatttgtaggttctgtaaaatttgaagccattaattaagattgctaattttaaatgaagtatttttcccagcttattatactttctaatctaaacctcatataaactaagaaatagacccaactccaaaataatatatttagaaagccagtatatttagaatccaaatatatgtttattgaactaaatttgacattaatttatgaacaaatttgtgaatatgtgaaatatccagttttttaaagttttattttatttagaattttcacataattgtacatatttatgaggtacagtgtgatatttcaatgcatgtatacattgtataaggatcaaatcaaagtaattagcatatccattactttaaacatttgttgtttctttgtagtgataacattaaaatcctttcttgaaatatacaatacattactactagctatagtcactcaactgtgtgatagaacacccgaaattattgttcctaagtgtaactttgtaccctttgaccaatctcttcctatctccccatgctttcccctccctagcctctggtaaccattatgccactttctgcttttatgagatcaactattttagattcctcatatgagcgaggtcatgtggtgcttgtctttctgtacctgtgtaatttcatttgttataatatcctccagattcatccatgttgccacaaatgacaggattttattctgctttatggatgaatagtattgcattatgtatatttacatatttttttcttcattcattcataattggtcacttaggttgattttatatcttggcttttgtgaatagtgctgcaataaaaatggaagtgcagaatctccttgacatattgatttcctttcctttgactatatatacccagtaatgagatcgctgaatcatttgatagttttctttttaagtttttgaggaatctccatgttgttttccatagtggctgtactcagttacattcttaccaacagtgtgtaacagtttccccttctccacattctcatcaaatttgttaatttttatcttattgattacagccattcgaagtgggttgaggtaaatactttattgtggttttgatttgcattttcctgatgattagtgatgttgagctatatatatatataatgtttatatattatatatatttatgtatattatatataatatttatatattatatatatttatgtatattatatataatatttatatattatatatatttatgtatattatatataatatttatatattatatatatttatgtatattatatataatatttatatattatatgtatttatgtatattatatataatatttatatattatatgtatttatgtatattatatataatacttatatattacatataatatttatgtatattatatataatatttatatattatatatatttatgtatattatagataacctagaaagatatatattatatatatttatatattatataatatttatatgaatattattatataatatatataatcttatataaaatatattatatataatatttacatataatatatattatatgtaaatattatatattatatataatataatacatttattatatattatatatataatataattatatattatatataatatataatataattatatattatatataatatataattattatatatgatatataatatataatataatataatatataatataatatataaattgtatataataatttatatataatatataatatatattaatatattatatataatatataaatataaattatttatatattttccgattgtatgtcttcttttgggaaatgtctagtcaggtcttttgcctatttttaatagggttttgttgttgttgttgtcgtttttcctttttttttctgttgagttgttcgagttgctcatattttggaaattagcacttgtcagatacgtagtttgcaaatactttctcccattctgtaggttgtttcttcactctattgtttccttagctgtgcagaagtttttagtttgatgtaatagaatttgtctatttgtgcttttatttgtgcatttgaggtcttattcaaaaaattattgtccagaccaatgtcatgggagcttttccttagttttcacctggtagtttaatagttgggatcttacatttgccttcaatccattttcatttgatttttctaaatggtgaaagatgaggtctagtttcaccccactgtctgcatgtggatatttagttttccagagccatttattgaagagactgtcctttccctgatgtgtattttttggtgccattgtagaaaatcagttggctgtaaatgtatggatttatttctgggttttctgttttgttccattgttgtatgtatctatttctatgccagtaccatactgttttggttaccataactttgtagtgctttttgaagtcaggtagtgtgatgaaatatccaggtttagaaggaagtaaaaagtagaacacaggatattatggactgggaaggttaggagaaagggaatgatagaaaatttttaaagactataaaaatacaactagacagcaggaataagtcctagggttctataccacaataagatgactatagttatcaataatatattatataattttaaatagcaaaaaggaggaatgttcccaacaaaatgataaatgcttgagatgttgtatatgctaattaccctgatctgatcattatacactctatgtatgtacacatctctatatacctaataaatatgtacaattatgttatttttaaaaataaaatacaataataaaaaatcacatgtagcccataaatatatataattattatgtattgataaaaaattttaaataaaaaaatggtattcactatttctaggtcttaaaaaattttttaaatctttaattttatagaaaacccaacaaaatatttcttcaaaaaatttgaaatgactatttaatatataggtacaaaatatctgatatataattcatgagaacaccagacaccagtttgacttataatttgtctttcatattcttttttttttttttttttttttttttttgagatggagtctcgctctgtcacccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcatattcttaattctataacaattacaacaattcatggtatgttgttattaaagtgagttttatagaggaaggctgttacaatatctcatttttaacccatgtattatatatagttatcgttttaatagtaactgaaaataggaaagtttagatacataagtaaatatgtgcacacacacatgcatacatttataaactgccttttcttaagtgagaatttcacattttcaaaaaaataattgtgtatgtaagagttttgtttttaccttactgtcaagagagttcgatcattatcatctggacaatgggctaaaatgtaggagttgttctgtcttataatatcagaaaaataaaggacctattttatttcatagatgaattaaaacacaaaaatatattaatatagtagcataattttaccaggggcctgttactttctgaattggagtatctaaaggaaatttggggtactgtgttctatttacaaatgactagcaagactgattccgggatgaatgaccctcctttattcatgtgctctgtataaaggagaattttgtcattaataataatgattgtaatactgtgtgttgaatgtaaaccatcactactttacacattaaaacctatcctaatttaattaataaaattagccatcgctgcatcttcaacaaaaaattataaaattcttatctggattgattaaatttagttgagcccttaatcctgatcattctgcttgtttttgataaataatttgaaaataaattcaaattcattcaaattacaccttgatttcaagtaggaatagtttaatagtgttccaaaaaaaggaatgttaaactattgaggtattcttgacaactcttagagctgatgataagaaggttcatagataggaaggcaggaatgacttattattaagtcatctgagtaaatctgtcattgaaacctaacatagcatagtacaactttgagcaaatcaagactctgctgaatgccctcagttgtaaaataatagtgttgtactttacaatcactgactgagccccattttagttctttcataattatttttggaaatagtgattttcattttgttaaaaaaacactattggcatgtataacaaataatttataatatcttccccaaaagctctcacattaacccaaggaaggcattgaacatgcaaataaaatataattcaaagtctgtgttaaatcttgagactcaaagctcctatgtcccaaatgtgttgggtctgtgacacatggattgtcaaattcagaatcagagtaatgttttgtacaactagtagctccagcactgttccctgtggtctctggatggaagaggcagtcaaacagatgggtcctaatagccttctaagacgtgaatcaaggagcctcatcagcaaggctgatggttgccttttacattatccttgtgatgaacaaaacccttgggcctgactggcagcttcttctttacctcccttcacttcaaggctttccaggatacaattcccaaaagccctgaatgtactcttccgcagagggaaggctgtagaagtctttgcaagcttcatacagagaaatacaaaaggtgtgatgccattaactggtcctttctaaagcattaggaatttagtgaaactctcaaacacaaaactgaaaagccatttgaacaaatctcatatacttgtagataagctttttttatttaaagcatacaaattcaaatctttcaagcagaaaattcagtcaagtgagatccattggtggtttgagttcaaagtcagtgagcaaatggaaatcattgcggcatctctctcatttccctagtggacattagaccactcaaaatgtgtcacataatttacagccccttggtagtaattgaatatacacgttgagagtgcactggcagaacacttaagaaagattgaatgcaggaggaccagcttacgttatttttggctctactctggtttttgcttttaatgttttttcttgagattaatttcaattgggttgttccatcctattcaaacaaatgctttgagagaagagatgaacagcagcatcaaataaattgtgatatttagtttcagagacatcaggtgttgtaatcaaataagacagaaggacaaagtaaaatctgtgatttgccataaatgaatttaagctgtaagaatagcagaattgagaggtagattagcaatatgacttttgaactattatctaaatgtagggtgagattttcaagatttattttaatatataacatttttgctaatatttaggaaaacaaagaattttgtagttaaaagtgtgaaacattaaaattatctgtctttaaatattaattattctaaatctctcttttgtgtatctgttactagacacttttaattcttagacacatattttatgaagagttattcttaaaatggtatgctttgtttgccagtcaacatggaatctccctaggtataacctttaatatttaagagaatacagatcaaaatagtagagatttcaacttgattttataaagacgtccaagtattctgaacttataataggaaaatgagtcctgatagaaattgtcatttgaaaatttccttccttctcctctttctcctcctccttcttcctcagagcgagtatgtggtatccactgtgtacacgcacacaacataaaaaaatggaggtccgtggtacaatatgtgcatgtgtgtttgtatgtgtgtgtgcatatatgtatacacacacgtatatatatatatacacagaggtatatatatacacacacatatatatacactaaaatttcatatatattaaatataaattatattaaatatacaacatatatattaatctttacaatctgttacactcttcctttgagtgcccagattaactggctactaacatttactttaatatattgctttttattgagacaaaaacagtggaaaaaaagtaattaatcacaaactacttataaagttaatattttcccatgctgaagataaatgagaacatgtgcaagcaacttaatagcaatacaaatctatgtgagtattcacaaggaagaatttctctctcagatattttgtctggatttcaacttgctaagtagactatatacctaaaaaaatttttttaaggcacgacatttctttttctgctatttaatatgtaaataattgcatattaagaaataattttttgcttttgcagataaaaggatgaaaacacagactcttagctatccaaagcaatcttatcatattcatatatttatttgctatatctaaacatacatacatatttacctattaactttatcttacttccaatttacttttgtttttctcctgatatcttagcccctttatctttaaaatcttaatattgttttcttctaaatcagtctggtgtttttttcccctttcctcaagtttttttttttttttttttttttgagacggagtctcactgttgcccaggctggagtgcagtggcgcgatcttggctcactgtaacctccacctcccgggttccagagattctcctgcctcagcctcccgagtagctgagattacaggtgtctgccaccatgcctggttaagttttttgtttgtttgtttttttgtttgtctttagtagagacggggtttcaccatgttggacaagctggtctcaaactcctgacctcgtgatctgcccacctcagcctcacatagctcctcaaatgtttttaatacttgttaacctgtcaccaaaccaaaaactgtctttcatttcatatgtgacgtaccatcattttaaatcttttatatgtattactttgctttccataacaaattggtgtttatatggtagatagaagtcattgttcatgacattcgtcatttagtattaagagcatctttatgcgtgctgtgtataattcataatagttaaaaccaattcataatagtaaaaaactggaacatttctcagaaaaagtaatatcaccctcctttttaaaacaaagctaaatcctgttaattttcccttggtgagaaatagcaccacacattacagcctttaatggcttaaataaacatgtataatgcacagtataaatttgaaaagtagtcaaaatcctctctatcctccatctttgaacaaactgtgctgcctcatttgcagagatttgcagtaaaaatcaaagatggcttacatttttacactatgtcaatatttctttctctgtttcctgttacttacatcagaatgatgggctcttttcgtaaagcagtgactgaaggccaaaagggaacttacaaaagggcattatacaaattctaaatataaaactccccaaaaagggaaaatgatgttcagatacaataaaaataaattatagaataaaaatgagaaaagttatagtcgttttttgtacaataatacagtgtataaaggctaacgtcagtaatgtcaactttgttgaatggaaaatcctgaactggcagttgactctatttctgtcaaatcctgcttttatgttatgtcactctctgattactcagacctttctctatcctactatgaaactgaatgattctcagaaaggaaccaggacattctatcacttaatgccaaacacgttaaaacgaaagctatgaacaggcttcccaacattttgtagggttaaaaaagaaaaaagaaaaaaaaacttcaattaactcaaattgaatatgttcacaaatctcaaatgcacaaatgaacattttttataacaggtttattctaataagtcaaatccatccctcatacagatatctccatgctttatgaataatagaatgatgtgaaaatataaagtagggttcatgaaggtgaagctgaatgcaactagaaaagcaactaccaaaataaaaatacggaacacagtggtagatagacattactatggcaacctccgatccttactaagaagttagtgatcattgagatctttctgataacctgattgcttttgttttctcattcacctggacaataaatacttactgagtagatatctctctcgattatagcgactgactacctagtcatggttccatgctctcagggagattacagtcttgtaatggtaaacgcattttcaaaataacaagaaattcacctccgggctaaaattattttttagctattgattattgtttttatagttcattctaagtagaggggacaaggttattatcatataatgtgacttgtattaagattgctaaaagcaggggggctgatttcattcaaagaactgtgggagagaatgcctcactctcaacttagtgacatgacttttgttttcattacatttaaatacagctttgttttcctatggcggtaacccataacagtatgaagcacagacagtgcattattcaggtttaatttgggcatggttgaactgctgggagtgactatcaattacactggtattttaacatttgtatgaagaattatgtgccaaaatattctaaaatttaaaatttcatagagaaactgcttgaataagtgttccatatactcactcactctgaattttttggcatctgaatgtgtagaaagtttgcaggtgaacatgtgcttgtcaatacattgtcactgacctcctcccattcatgttgctggtcattggcaatttcttcttctggatgctggaattttttcactgagtcctatgagaagctattaaggggccagagacccaatgtattcggtctactacccactgtcccatgtttttcatccctatcagtgtaagtgatctgtcctgagagcaccgtcatctattaagcgaaatgcagatccccgggactccaagtaaaggacattcaggcataattgaggtgaaatatatggttatggacagagactctttgaaattttactgaatattttggattcctaaatggttaccttcaagacactgtgagtagcatatacatgtgtgtgcttgtacatttgtacaagcacatgaacacggaggtaacataaatgcatttcatcccagaaaaacaaggataataataatgataagtcagaaaactaaaagctaagtaaatactttcaataatgaacttctaatatttcaagcactgtttattaattaactttatcttcaacagcaaccttgtgttaggtaatagcattaccattctgtagaggagtaaactgagcgcagcaagattaagttatatgtgcaaggataaatagggagtaatggaagagccggagtttgaatctgaataatccaacttcaaagtgttaatcaccactccaggctgcctctcagccagttgaacctcataaaattcaagactataataagtggtcaaaaacctaagacgaaactctgcttacatggttatttaatatttgattgacaatgaaaaataattttaatgcataaagtcatgttgaatgtaactacaatattaaagatcataaagagtaaagtaagtaaaatagaaaaatcaaaataaaataaaaataattatgtttaagaaagaggattatgctgggtgcagtgactcacgcctctaatcccagcactttgggaggctgaggtgggtggatcacttgaggtcaggagttcaagaccagcctggccaacatggtgaaaccttatctctagtaaaaatacaaaattagctgggcatggtggcatgtgcctgtaatcccagctactagggaggctgaggcaggagaatcacttgaacccaggaggtggaaagcggaggttgcggtgagccgagattgcgccactgtactccaacctgggcaatagagtgagattccatctttaaaaaaaaaaaaaaaaaggattataataaattcagctacaaaagaaggaactaactgggtaaagtttaacagaggaaggaaatttcaagatactaaaagctcatcaggtaaacaattttctatctcaagaacaaatgataccagtgcacaggaatgacagaaagaataacaagatactaaattggctataatcagagacctgaaagtcaaatgccaaagccacaaagagtggaattcaagccagagccctaaagaaaaaatagcgtaacgagagagagccagcaaaaagcaaaatgaaaaagacgcaactcttgtcatagcacacacatgcaccgaaacaaaacaaaacaaaatgcaggaaaaacagtaaaaaattatctagctgtaaaaattacttggctgtacagcctcaattgtttgctccctgatttagaaattatcatatttgccaaaagtttgaatggaaatatacttttacttagcaaaacttccattattaaaaaaaaaaaaaaaaaaaaaaaaaaaaagctggccgggtgcggtggctcacgcctataatcccaacactttgggaggccaaggcaggtggatcacctgaggtcaggagtttgagaccagcctggccaacgtggcgaaaccccatctctactaaaaatacaaaaattagccgggggtggtggtgggcacctgtaatcccagctactctggaggctgaggctggagaatcacttgaacctggggggcggaggttgcagtgagccgaggtcacgccacttcactccagcctgggtgcaagagtgaaactctgtcccctgccaccccctggccaaaaaaaagccaaggtaaagagtacaacatttaagaagaaactttctgtaaacattgtaagaaatctatttaagaactaacagttgatatgcaaattgcaatttagagatcctgaatgaactaattaattaacaaactctcatttgttaagctgaagttaagtgatatgcttaatgaaaaccacagttatactgaagaggggaactctgtgtttaagtcttttcattaaaccagacagagcctaatcaatgaatatgtgtaacattgctgtataggtctgattacatgtttccttgtttttctaaaatgcttaacattttattctgatcttatactttaacaattgaacagcaagatgggctgtctataattcaaatttaattgtctttaaatcctaatctctaaacagtctgttaaatagaatgccattgattaagtgatctacaattaaatcagtgacataaaatccatatcagaatttaaggatttaaccaggagttctctaataagtttatgtcaaatataattcttaacaaatgctttctgtatacttttaagttatctcaaaatcttgaatttgaaatctttaaacatttacaggttccaggcatgagaattttcctgggggatgggggagggagaacaggaacctgggtgagtaaataatatgatgctccaggtttgtttctcctcagctgacatttatctctttggcatgatgaagggtagatcaacgttgactgtaaaaacaaacacgattagcactaacgcagcatatgttaacactgctgcagcctaatgatgaatgagctgtaagcgatcccaacacctgttcttgatgatgatgcgtgatacccaaccccagtggagtaatgagagcgaagacacagcggtgcacatctcaccgattacagtggtttatggaggcgttctggtagcattctcactttctgtctctccatctcttctctgattattctatattcgttcattcattcataacttcagaattggctttaagctatagaaatccacatgtgaggtcttacatgtattagccacatgagacgtattaggttacccaagtcctaagcaactggagaatatgtttttataccagaataattctttctaaaacaccattgttaagttagcctacttggttctaacgttgattgacattatcaagcatctcaactcgattggctctaaatttggcaatgcctgaagagagtttgataatctcaaaacagaatacctgaacttgtgtgatggtgtcttttatatttaatacacaaaatactgaacataagtatgaatattatgtaaagtgacaaattacgaacaatggagttctgatattatccttcggtcttgtttcagcaaggaataaatgatattcctatctgccgcttctacgtcatttaatgttctctgttattttatatatggtgccaatgtcccatatgatgtttctattactatgactatataatgtgaattacttcttctattcttaattttatttctggttatcctcttccttactgcttcaaaactttgttgttgataaaattttctttcctgttctgaatataattcctttacctgtgtttagatcatccttacctggaaggacttgtgtatgcattatttcttcccattttgaagcttttactcttactttccagctgacacttttgctctatttccaaatttgtcagagccttccattcttaaagaacattgtgtttctaattcttgtcttattttttgatgttcttcttcttattagcaatttctcaaacaaatggccaaattcattgctcttatgtcctcatattttttctttttaactcattgaaattattaaagaaatgtcaatatttcagattattaaacatttactcttgcaaaatttgtgaccattggcttttattatattttcttatagttttgcttaatatttattttaatgatcaaataataagttctaaaaataaggacaatatttgttttatttttcaatatttgttttatttttattttttaaagacctatgaagtagatgataaaagtgtaggttctggagctagattctgtaagttcaataccttgtattgccatatactagctgaatgatcatggggaagtttcttaatccttatgatgtggattgtctcatttgtaaaatggcaaataacaggccaggcatggtggctcatgcctgtaatcccagcattttgggaggctgagatgggcggatcatatgaggtcaggaattcaagaccagcctggacaacgtggtgaaaccccgtctctactaaaaatattacaaaaattagccaggcatggtggcaggagcctgtaatcccagctactcaggatgctgaggcaggagaattgcttgaacccacaaggcagaggttgcagtgagccaagatcatgccactgcactccagcctgagttacagagagagacgagactagttcaccaaaaaaaaaaaaaaaaaaaaaaaaacgacaaataacaacgtatagttcatagagatattatgaggaaaaataaattaatatatgtaaagagcgttgtgtagagagtaacacatagtaggtgtcctatgtattttagctaatgttgttatttagctcttgttattggtaccacctctgtaatccttgaaactagcactgtgcccgatatatattaatttttgaccaatattttgtggaggagtgagtgaaatgaattaatgaatcctgcatttaacacaactgatcattatacatttttagaacaattgtgtcttttgacttccacactaataatagatattactggttaaaacataacctttgcaaaacaaaatttcatttctaactcttctatgttagtcagtagaaaaactactctgcaagtcacatccagggaaaaaggaagatatttaagaatggctgaagataaagttactgtgacaattgcctcctcttccattcttataacgttgaaaagcattctcccaatggcagccaaaataatcatttaaaaatataagtcaaacagacttctaactttgcttaagccctcttgtagcttcctattgtaataagaagagaacccaaattccatccatcctgtccagtcaggccctgcttatcctggccctgcctattactctggatctatttgaaaccataagtttcagctggcatgcagcagaaaatcacagtggcctctgtgatttgaagaggccaaacttcatttctgccctggacacttgctattcttgcctataatgctttttttttttccccttggatttggatttggctgacatcttcttgtcattcagtttctgttgaaatgtgctttcctcaaagtcctccttgatccaccacctcccccattctattatgcattgttcctgcttgattttcttcgtatcactcgtatcactgtctgacattatcatttcaatgtgtttgtttatttgcttctcattatctgtctttttcactagaatgcaagttccatgatgaaaggagccttcagtgtctgattcattattttggcccactgcttagtacattatatgttattattaattatctgttaataaattaataaattaggctagaggcaatgcccttattacaaagagccttctttgtcatgttgtagaagtggaattgtattccaaaagtaacagaagccatcatagatggaaagttgaggctgggcacagtggctcacgcctgtaatcccagcactttgggaggcaaaggtgggtggatcatgaggtcaggagttcaagaccagcctgaccaacatggtgaaaccccatctctactacaaaatacaaaaattagcccggtgtggtggcacgtacctgtaatctcagctactcaggaggctgagtcaggagaatcgcttgaacctgggaggtggaggttgcagtgaaccaagattgcaccactgcactccagcctaggtgacaaaacaagactccatctcaaaaaaaaaaaaagttgaagattggcttatgcatgtatgaaaactttacaccagacaaagggtttgagttgaagaacaggtcaatttatggagaagggagaggtacattccggggggggggggtcttagagtgacaggatgctcaaagatgccataaggggtgatgtgtgttctggacatggtgaatgagtagctgaatctgcctattgcataagattcttttaagctagtagtggtagaaagattgaaatggcggaaaggagttacaatatcggctattctttctgggcaaagtgatttggaattgtcctccaacaagcatttgttttttgaaaagttattccactgaaagttgacataatgaaaatcataagaaaaatcatctatgggtgtaccaaagtcctagcggttctttagagcccagcttaagaactccatccttcatataaccctccccaataagaatgctgcaagaatgtccaactctttcattttatatgaatccagattcgagaacgtactgatatccccaagatcacagatgattaatctagggttaacagctgtaacatatatgttcagagtataatattcttaaacagaatcccccaaaacttgtcagcattcaaattaaaacacacataccacacacatacacacaaactctcatgtcccattgaaaacttctcactaaaacatacatcaagtttccaaaccacttcactggtggttttgagtcatatcaagaaccagatgccctctcagtaaaaaaacccaatgaacatcttattcataatggagatataggggtactagcaatggtccaggcatgtctgtcaaaataaagtgtctttcccctttaaatatctttgtaaggaataataaatagttctcctaataacaaatattggccatggaaagttgttagggaccacccacactatgtaaataaatattgtaaaactagcatcaatgtttgtttttgtaattttaaaaattttattggaacatctgtggaatataaagtaacaaaaggctcaaaagattttccattttaattaagggagaaaagatgcacaaaaacttcattcacaagcaaagggatgtgtatatatttatgatgtgtaaaggaatttcttgacaatgaatatctacttgtccttgcacaaaaatgattgtgcaaactttaatagcatgaagataatatcttttctttctagtgtttagtgcagttcttcctttcttcaattcccatatgtaggtaagtacaaaaacaaacaatagaaccaagcacatgttttaaattttctaagtgtattagatctttcatcttatttggtctttacacaaggaatactgtagaaccctgtctgcaagaacctgaaaattcctccatgtgacatggtgacctcccaggaaaagcacacctagccgaccctggataacttttgcttttgtctatttttatttgtgatttctaagtaacatgtaatttaagcaaagggactattcacgttaaatggaaaaaaaaaaaaccccacttgaaaagccctagtgtagaaggagaagaactagagcagtttcttgttgcatttgggatctggtctggccagcctttccactgaaggttgcgtgatcttgggcacgtcttggaacctgtctttccctctgacggtgctctctcagagagctgctaggggcggtaaatggctacgatatcaaattgagctaaggcagtctaccaggtgggtctttataaatcttgacacttttaaccatttcatcagacttttatttttgtaaggcagatgactgtaaagaaaatgaaggtagggattgtatctgcctttttctagtatgtgtctaacagagtagatacttagacatttcctgagtgaactcatgaatgaacaaaggcaatagcatttgacatggaaagttgggaacagatataaaatcctggatttaaaatgtcagtgagggttgaatatcctactgtggcttgaagacgccttactgctatgtcacatgcccatattccagtgccaagaggctaagagacttccaccttttgagttttggcagtggcaagaaggatccgctggggaaaatgagtcgagaagaacttccttcaggagctattgtggtagggctcttcatctgcctattacatatctgtagggaaagagcaactattttgatcaatcaggacaatggtataaagttttcctctgtctgaaaaaatatgttaggcctttctgtgttcatgaagagagctttccatctagcagataatattcacagtcaaatatagtttaaaatataccaattcacagaggagattcatctgtcttttgtggccctggtgagtgcgtcataattatataagcacacaaaacttcttctttgataatgatttgcttcctggcctttccctggaagtagaatttcatgcagcctcttggaatttgttctcctgttctccatttgttcagcctcacttgtaactgagagagtaaacatcttccataaaccccaatgtttatgactgactagtcctcccaacttgcttgtcagttgtattgattttatactccaggcaaccaaaccaatcatatcttaaggccttgctttaacaatataacaccagataaaactgcttctgaggacttgtggtttttaatctctaagataggcatgaggcttgaacgtatagaatatgttactttcaccttcttgcaagtttcatcagcaatggtacacagtacactagatacatctaaattatacccgtcttaggttgtatgttgctgctgctcaatgttacaatataattacatttctgttttcttctttttccaaccacatttaactgtttgggagttaaactcattattcacaggccattccaaatgcttttggaaaaacaaaattcttctccctaataacagtatatattcatagtaccagatttaacaaccattcatggctggcatcatcattattcaccttttatacatgaggcaagggggactcaggaagtttagaagtctgtactacatttttctgataatgaatatttgctatggaaaattattaggggccacacacactgtgtgaccaaatattacaaaacaagtaacaaagtttatattcacaatttattttattttattggaataactgtggaaaacaaagtaacagaagattaaaaatagaacctagcagagcaaaaaccagaccctgtttctcgcctctagagagcattccagagtgtctaaagaatgtccctgtcttctcactgtccctgaacaacctttccctgataactgaccagctcgccctcattttcaaagagctaactctgtcaaccaagggaaaaagatctttcagtataattttctacactgaccacctgtctctttccatatttagacataatttgtgctgctaaataaggttgccccctagccatacagactaaactctgaatttcaagcagatactttgtttataactgccttaagtcattagttctcaggatgagaaaactagttattttaagtaccaaaaatttggtagcagaccagagagaatttttcctctttatttaacgcccatgggcaaaacctcaggatgctgccatttgaatgcactgccatcgagtcagggccttcaccagaggcgcttttgtggctctccaccagatgaagtcaggcactccaacactctaaccacggtccgcagatggtggcctgccaccaccacatctgagctcccaggatttaaaggactcaactatgttccattcctgcccttttgtgggtttcctccttcaccacctctgagaaagccacagtgtccagaagaaggaggcagtccagcatcaacagtcagagccctctgcagcctctctcaccatctcctctccactctacccctcagtctgtaggtcaagaatacagaatgaatgggaaaaaaaaatctcccactagaccaaaccccgtctgtgattttggctttctacatgctgttaaatttttgcagaaaatgttcttttctcttattctatttcccctctttctaccctgtattaggacttgtttgagtgtctttccaagtggggatccaacatacacacgtctgtatttgagtgtatattgtacatgtgtacacacacttacagacacacatatatacaaaaacataaatgtgtgtatatatgtatatgtgcacatatacacacaaatatgtatacaaatgcatgtgtgtgtatatacatacacatatatataatacacactcaaatataaaagtatacagtcattgattttgttaggataacagctatttttagactcctattctgaaggctaacttgtggttaatgtcattttttgtccaatgacagaattacaacagcctgcccatttagtttagtgtcattccagaatgtttattttgggaatcatattatcctgacttcactctggtaatgtgaaagtttaacaataactctgctacattaattgtgttatttatttttttaacacgtcagagctagaactggaaggtttaaatggctaagagacaataaagagaggatgtgataaccatttctaggtgcatccctatgttaatctccaattagagagactgcgtaacatgaacagggacccaggacatgtacctacaaaaaataaggtacattagttagagttaaagtctgggttttctacctattaggaagaggtaaggaaataaaaggcccttaatatatttattctacataattcagatgtagtctaaaatagttgcaattagtgtgagaacaaagaatattatccttaaaaattctgaaggagagacagaataaatgcataggtctattctaagcacaaaattggaaaaatttgaatactgtactgtgattaggcttgataaatgctaagatgattaaaatacagttctcaccctgagagagtgcacgtgctggtttgggggaaaaaagtaatgagtaaataattacaatccagccatatgacccaaattcttgaaaatattgaacaagagccattaactctctcgggaaggttataggatattttccagaaaggagttatatttaaccttcctgaaagtatgtgtgtcaacagaggaagagcaagggcagctccctgcagaagacattccttcctctatagactacagaattagaagtgtctcctgaaaagacactttccttatgcgtgccactcagaggagccattttgctccagccttcaactcctcattgctagtaatttcaaatacttttcctggaattttgtggttctctcagtgattactttcatattgttttctcttttctgtcccatttctgctttgtttagcaagtaccagtaccagtaatagcttactttatagcaatttattttcacaaaaacccgtcagagactttaatagctatgtatatgtcctctatctttgtattcatggcttctagtcattttcaagataattgcattgatccagttattgagctgtgtgcattcaggagaacatgtactttaaccccaacctaattaataaaagctgcttttggtgatactgtgtgatggagaccatagagacatggttttgttgtagtattgttgaatcagaagttctcgtgaacatgtataatacctctccggggataacgttggttccaccagcatctgtaagaggaatgttctactttgtctgaacattctgcaccccagcacagaaagtgtcatggagatgaggttttgtacaaataactgaaaaaaattagttgagacgaaaacacgatagactaagttatttatacttttctaaatacttaatctaagcatacataaaaaattttaactaagatttatttaaagctatttagtcactttttagtcttaatgtttgctactaatcccttcatttatgatatttataaaacatttagccaggagctactaggagacaaagcaaaacaagcattatttcccttttctatgtttcaggttggtgcaaaagtaattgcggtttgtttcactgatttgtttctgtgtccccagtgggtcctcttgctatgcccaatgtccttggtgatatccagctcaacaaggggcaggcacatgtacatgttttacatgtaagaaaataatacagaacccagatgatacctagtgaattatactaagtgtattgtacaaagtaatgagatgagaactttgatgaattaaaaatactgttttaaacaaagatttcaagttaaaacttatattttattctctcactattaaacagtcctgcttttggagaggtgactttttttttttttttttttttttttttttgagacggagtctcgctctgtcacccaggctggagtgcagtggcacgatctcagctcactgcaagctccacctcccgggttcacagcattcttggagaggtgactattgattgattgtttaagtatttcaattcccttctagtttctaagctgaaatctgcatcagttcaggggacgtggccatcctttgtggtgaggcttttctacttcacaatagtgctcattaatatattaaggactcttctctttaaaaagaacaattatgacaagatggggcatttaaagtagagtgcactgtggtgctttgtgcctcatcgctgtcatgttttcaacaagagatattaaaagaagtaaatgccgggtggtctcatgaggatatggcgatttaagcctttgaaccttgggcatccagtatgacaaaatggctggttgctttgatgttgcaacatgagaaaatctgttcttttattgtttgcaaatgctagaattctttcacattgaaatgatcactttgcatatataccacaagttaaaatttaatatgttttgagaaagatacctctgaacaatatggacatggcaaaaatttgaaaggttctttttgtgtttttccccctaaatcatgaccttggatacactgaatttaaattgtttggttgtaggaaagttattaatagtacacattaatagtaatgtatactcatactttgctcataaagtaccttttaaggtaaatttataagatatatttaccaaatgtatttgtttttaggagtaatgtctcaccaaaggttgtaatttcagttattgaaaatatatttatatgggatatagatggtatttgtactgatgtttgttaagaataaactctataaaatggttcttaaatgattaaaagtatacattgtaaattggtaactggtgacagcgtgaagtaaaaacaaattgtagataatttttgaaggttagtctatgtgaataagtacatagctgctagaagtttatacaaataatgtaaatgcagttttttaagtaaagaactccttttctattagaaaagaagacacgtcaagtgacagataatttgtttcttaaaaaactgtttcctcctaaacaaaagatgggtaaaacatacagcaaagagaactatctcacctgtgttccaaccaatatttggtacatagctaaaagctgatttaattgaattttaaaatgtgagattatgagtgccaccattctgattgggagaaaagcaggaacttgtgttaccaaaacaagtttctctgaaatgtattttacctggatttagaacagatgtttataggacatgtcgatttcttattctctctggaatatgaatgtatgatctaaaaattgacatcatcccttttaacttaatcccctcccgaaggtacccttgctcctgtttatggcagaggtagtttccaagtgattgtctatcctgaaagatttctatgaaattattctggattttgtttcatctacttgcatgtagtatgttctcagaaaggcttttaggtacactaacatttttgttgtttgactttgattttttatgctgaaagttggctgaaatatcatctactaaacatatataatcaattaaaagacataccatgttcccagattgaaagatggtacattaatctattactcaatgcaatctcactaattatccaaatgtgatgttttaatgaaacttaataaactgctagtaaaatttttaaaaatatatgtatataattaaatttgtgttaaatgaaattatatgagtagatatgacatttttaaaagtggctcaaaacttaatatagctccattcattctactcttagcctttaaagttgcattccttaattaaaaagagagcattttaaacatgccaataaaaatattgaccatcttaaaatctttaaatgcctaactactcggcatttattgctgaataactaacattcaagatggtttacatattttaaatagtcacaactcttttcaaatcggtcatgacttaaatgcagctttcatatcagtttctgttttatgttttggtaagcaatttttgctattgataaatatccttaccattttagtctgatttctctctttgactgtcagactccggtggccctgaacaatgtttagattattctccaaaacttttggctaaggagataattttggaagtaagcttaattccttcacgttttgaatttaattagcagagaactgtttttgagtgaaaggcaggtgttttatgattttcatggtgctattccaaatataagtatattaaatatcattatttcaagaaattgtatctcattgctatttgaggacttcacaaattctctttcaggaaaaagtagcatgtccctggtaatggttttatatcatccgttggaaactgcatcatatgttttgtattttaaatccactgcaagaatcgtcgctcctggtaaaaaatcagagtgctctcaggattctaatataatcacatgtttaaactgtgctgcagacttcccaagtgtgactcattggccttttggaagtccaagcctaagcatggaagctactcaacatacgatgaggaaaaaaattatgaacgaacaaattctatgatcatacagatatttagctaaagtacattataaacttacatataacaaaaatttaagaataacccaaatgtttgacaataaagtttctttaagtaaatttcatattgtgcaagtattaatgatgtcgaatatcattttcctaattttgatattcgatatataaaaaaattaaatgtctttgaaaattgcttccaagatagtgcttttggttccatagttgtgtgtcctttgtttgtaaaatgtgacttctccttcaacttttaaattagaacttctcatgatatcctaaatgacatattattgtagagtaagtgctggaagtgctcatgtcttttgcttgtttccttagtgtcattctgtagagctcattgacttgaaggtgacagagacttacttctatagatactatatgtaataccatatgtcaatatctatagattctatatttgataccatacatgagtcaatcaatcagtcaacacatatgtaatcaaagttggcagtgcatttactcctgagttagatgctgtagggccactgttgtgtgtgatcttgccttccagaaacttacaaccaagttgaaaagacaagagccataaaataaaataatagcaaattaatataaaacctggataaagaatgtaataactagatgaccaatttgagagtgcttattgggacttatgaagaaaaagaaattgaaaaaaggtgagcctgtgtttaaaatttagaggggtatagatataacacagactgttaatgttttctttcaatatccattttgttttactattcttttttaaggtgttttattttagttgtttttacacgttacatgaacattcattcatcgtaatgcatattttatcacattttattgattgtccaatattcattttattgtttatccattttattgattgtccagtgctgacatctccctatgtcagcatttaataatttaataatttctgttgaacttttaaagggctttgggtatgtaatttctgttgaactttttaaagggctttgggtatgtaattatttaacaaagtgcaccaactagcagaattatctgtatacatagaagcgattttttttataatgatgatgatttagtcattcaatgattatttattgagtacctgttatgagccatggactgtcttaggtgctggtgatatagaactaaaagaaaaagacaaaactccttatctttgtggagcctacattttaattatgtaagtaggtaataaataatataagtagctaaagtatacagtgtgttgataatgattaataataaagagatgctgggtacagtggctcatgcctgtaatcccagcggtttgggaggctgaggtggatggatcgcttaggccaagggattcaagacctgggcaacatggtgaaaccctgtctgtaccaacaaaaaagtacgaaaattatccaggcacacacctctagtcccagctacttgggtggctgaagtgggaggacccatttgagcccaggaggttaataacaattgtaggtagggtagttggtggtagttggtgagaacttccctgaagagataattcttgagtaacaacttggaagacatgaggctaatatcatctatatctgggggaagaaccttccaggcggggaaactgaaggctgttttcttcactgcaggtggctgccacataaggctagtacttccctttcaaggtagggagtatcgaggaagaggcaaacacttattgctcagagaagaaaaaaggactaattttgctttagcaaacctgttatttttgtactctaaataatattatatctaaccattccaatattttgaaatcaagtattatataattctgatcattaatctttactaaaaactttgtatacatactctgacaaacaatctttcttcctcatgagtttgctgagtattgtggagagtgaagattaacaaaaatcgtgagaaaaaataatgtaatagcaacttagagatagttggagtgaagttaggtacattcttattaggagtaagaacaatcaaatccagcacttgcctcaagactcacatctttctaaaacatgtcacttctggacaagaggtgactaccccaattaagtaatttatttgtgtgggaggatctaactccagaactctgtaagaaaaagaggtgcttttggatgctgataaatcccccaaatgaaaagttatattaaaacatacatcttgatttcctttgaagagtgtatggtgtctgtcccatgactggcaattcttatcatccacttgagaagggataatctcactgtttgtcagttgagatggctgtaaactgaaaattattatgtaagcagcctgacgaaagtaccaagaaaactttaattaacacttgcatgattaagaaatgtaataaatatgatggtagatatgataaatagctttaatctcaatccctattacaatcacaaaatttaacttctcagagaaacaatctgatgactatgtactgacattttgaaattaagtttgaaatgttaatgtttttggttgagtatcactctttctgctgccccagattctagtgttagacatttatatgcttttcacttctcaagccagagaaccataacatgattggcatagatatctattctgttttttagcttctaatatctgaaagtctgaaccaattccaaagtgttgacattatacagtcatttttcatggatgtacatgttatggctggcatgtagtaggaccgagaaaactgtgaaatatataaatatcttcaaactactgttctatttcttatactttttgaaactgatctagtgatttgcttttgatttcctattgcagtgtttgattgtcatctaactgattattttaagtgatttaattatattataagatgaataaaattcaggcttccagttaactaactagcttttgttccctgaagaaattggcagaaaaggacatatctatttatgattttttttcctcaccaatttctactttaagagacatgttctcaagtagagaagattttcccacagacggcattaattggaaacgttgtaatgacaataacaagtatgcagaaatctagttgtttagaagaaattttctctttcttcatgaatatttggacaagctattccgtcaaatgtctgatatatttaaaatgaggccaagaagacatgcagttggttcacagttttccaaagtgtgtgttctagaacacttttatcactagatttctgctgggtttgtgtgacagtgcatcttatctccctcttcattaaataccttatttctcattcattgtttcaaggttttttgcttgtttgttttttgtttttttgttttgtgttgttttgagatggagtcttgctctgtcacccaggctggagtgcaatggcacaatctcggctcactgcaacctccaccttctgggatcaagtgattctcctgtctcagcctaccgagtagttgggattacaggcaccccaccataaccggctaatttttatatttttagtagagatggggttttgccatgttggtcaggttggtctcgaactcctgacctcaggtgatctgcccactttggctgcccaaagtgctgggattacaggcgtgagccaccgcgcccggcctttcaaggttttaatatcttctacagcaaagaaatctgattaaccttgcttaacccaatgtttaccaaatgtatttactgacagaccaattacatatttacatcagaccaattacatttacatcagaccaattaacatattctgagactagcatttcgggaagcaaatgctgctaaaacaccttagcaatttctgtgagaatgaaatccatatccagttaacagcgtttttcagtgttgtataaccttgtggacaatttgatactggtttaggttcttgaattattgaccttttaagaagtctgcaggtgaataataattggccacatacacagcaatgcacttagagcattattttaagttccgcacttggaaatttgccagcactactttggaaatggcaactaaagcaagcatttcatatattggattctatggaactttgctgaatttggagacagaaatgcattaagcagcattcaatataactggtcttaaatgtgggagggcttcgtgtttatttgcaacacataattttttgggagccttaaggctctttagactccaaagtgttttcctcacatcctatcactcaatgaaattccagctttggagctcctccatctttcattggaattagataatcaaaacaaccctgtcattttctatcctatgcctctgcttagcctttttctcttcctaaaatgtccttctcctttatgcctcaatcagtgcccttcataattctgtgctaccttcaaatgacccttcctccctcacacctttcctcattctcaccatggtgacagctgtttgtccaggctgtgctgaggtaatcgaaatgtttcctcttttctctgtgtctaaacgggactttgcttgcctctttgtcataacagattctatgaaatactgttactgggaaacacgtataatattccaccaacgttttcataatcacagacgacgttttgcttatgataactagtgtctttcacggagtagaaatgcaaaatcatacggcatggcaacttaaaaattggccttgaccatttcttttacactaggggagtcacatgaaaatgcaggttgaaaatcacattttgagttttttttttttaatttatttactaagatatactctggctacttcacatgtaaacaaagaatttatttcttgaggatcctggcattattggtacattttcttgttgtcacttggttttggccatttttcaactggtcaaaattaaaaaaaaaaaaaatttcaaagcaatatgacacctacaattacattgttaattttggctctccttattctttccagataattgttcttcatccattttattcctaagttagaattctttaaaataaacttttaaataatttcagacttatgaaaaagtttcaaaagtagtacagaaatttccttacagtttttaagcagcttccttaaaggttaacatcttacataatcagggaacagatattgaaaacaaaagattaacattgaaaccatcctattaactcatctgtagacctacttaagtttccttagttgtctccctgaggacttatttcctcagtctaggatccaatccctgatccaacattgcaggtagctgtcaggcactttgcctccaatctgatatttcttcaatctttctttgtgcgtcgagaatttgatatttatcaagagcgttatccagttattttgtagaacatcaatttcaggttgtctgctatgtaagtagccattatatcctttgaaaaatagtcttaggcatatttctgaagattacttgtgtggaaagcatttgtttcccaaatgctttgttgacttgcatcattactttccatgtgaaaaaatgcatgttttagcgtctaaaaaaaaaaaaaggcagaaatatcttattttcccctttcctgatgatttgtcctataatagtctttggaaagatttataatgagattgagtttcagagctttgtaagcctctgttcacgagtatacatcctttatcaaaaaatatttttaaaatgtgaagttatttatattagcattctccagagaaacaaaatcaataaggtatatatgtagatagatatatgagaggtaatttgttaggggaattggctcatgtgattatggaggctgagaagtcccatcacaggccacctgcaagctggagatcctgggatgcctgtagcgtgactcagtgcaagtcttcaatcctcagaatcagcgaagtcgagggtggaactctcagtctgaggctgaagtcctgaaaacctgaggagcctctgatgcaaataccagggtccaaatgctggagagcctggaatttttggtgtcggagtgttataggaaaggggtcctgatccagaccccaaaagagggttcttggatcttgtgcaagaaaaaattcagggtgagtccacagtgcaaagctttcaagtttattaatagtaaagtggtgaaagtacagctactccatagatagagtagggtgttcctgaaagtaagaggagaaatgcatccacactagatacaatacttgtttatgtatagtataaaaaaaaatcatggggacctgtgctctgctactagggtttgtgataaaggattaattttcttaattagtatattttgcaagaatcagtattatgatctttaaagcaaaattaggaatgcttcttttctcaagataacaggatatcaggacactcctaagtctgggtctgtttagtaaacattatcaatctgttcccttgcccgtaaacatctagaggctaggaatacctaacttcctgggaatgcagcccaacaagtcccagcctcatttccctagccctcactcatgatggagtcactctggtttgaaagcctctgacaccaggtcaggagaagaggggtgtcctatctccaggagagagagggaatgagaatttacctttcctctgccttttccacctatattgagggtggatcttctccacccactccaccgactcacacagtaatcttctctggaaacatcctactagacacacccagaactaatgctttactagctctccaggtagtctttaatccaataaagttgacacctaaaattaatcatcacagtctttttttttttttaaaccacacaagttatccattttctttcttagtgactactaggtaggagtattagacaacttgaaatgttgaaatttaattgtttcaagttatccattaattatcctggttagaaaatcaggcttgattggtgtacctctttaatgaatagcgcagagaaatcacattaaaatgtgatactgttaaaccaatgtgttaattctttgacacacttgctttccttctttcattttccagtgtgcctctctctcaaagtttccagactctgctttttcactaacttccttattcattttgaccaattcctgccttgactaatttaccctaatcaatttgcaatctgatttctttccctaccacttcatgagactgctttgctccctcaagaagtgcaaatgactttctaagctaaatctgctacttgcgtgcatcattgacaatgctggccactttctttttcagtgaaattcttaccctcttgtaacatctgacaaacattatctcttggttcccttgctgcttctccaaacatatcttctattctcatttttgctgcttgtcttttcaaatataggcattccacaggtttattctccaaccatgccgtgtttagagaatgctcaaatgctcccaaaacttcagttatcaccttcgtgcaactgactcaatctttaccttgaatttgcatattcatcctgaactttttgttctgaatttcccataggtactacagattcaactaggcactaaactgagattattagttccccttataaacatcaatttatttctcctactctcactccctgatttgggctgaagttaaattcagtgtttaggttctcccatcccacttgtcctctgcctcctaaaccatattattcttttaatctggactattctctccctctgtcactttatgtttgaacatgataatttttcatttaggtacagcttgagttctatctcagtgatacctaccctattcaattcagaaagaatgaaagaactctcatgtaattaacttcattgcatcgtgtttcatcattagttgtagacatgtctgtattgttttcctcatcagaatgtaagtctctcaagcgatctttgtggaacttgtaagtcggtcattaccttctttctttctttctttttttttttttttttgagacagagtctcgccccgtcgcccaagctggagtgcagtggtgcaatctccactcactgcaagctccgcctcccaggttcacaccattctcctgcctcagcctcctgagtagctgggactacaggcgcccgccaccatgcccggctaattttttgtatttttagtagaggtggggtttcaccttgttagccaggatggtctcgatctcctgacctcgtgatccggccgcctcagcctcccaaagtgctgggattacaggcatgagccaccacacccggccgctcattaccttatttctataatgatttgtgaattggcctgaaataactcatccctgctttgttgttgttgtgttgtgttttgtgattcagccctgtaaacggcatgctcctcccaggaatgataatgctacactgtaacacagatcattggtgtttcaaaaaacccatccatccatgtcttcatttatttgcaaaacaagggcaggaaaaactagaattaaatcgttaattctctctcggtctctcagggcaatatgttgggcagttacttgagtgagatattttttatcaaaccaaatatgctgaggcaggaataacatcaaaggtgtttgtgatgtactgttgctctcattagttacctgcagatcaaacaggtatctgttctaacacttcgattttgaaacttaatgctgtgtttgttaaatttacttaattaggacctcttaacacctcagatagtcgcttaaaacaacaacaacaaaaacaacagtaatacccagctgttagccctgcggatgaaacaataaatgcaaagttaacactttttaaaggtgaatatgtacattttgatgcctcgacagcattcagtaaaaatcaagtgtgcttagagataatctactaagttgctgattgtttctggacctgtaactcttaataaatattgcaaatatctaaaagatatggatcattatttaggggaaatgtatgtgtatgcataaatgcaatcttttataatctaaaaatacttttcaggagctctttctgagatgaagagaattctcaatgtcaagatttgaacaagaagagaatggaatacacaatatggtaagtgacttgcaaaaaagatcaatgtgaccacatttctagtgctccattgggcagttatcacttgtaagttgcatgcatagaaaaatgcatacttatggtagtcactgttgcaagcagttctgaaatattaacacagttgatcaaaattgttccactcctaaaagcttattttgataaacttggtgtaaaagatacttggctatcactcatggcaggtgattttactctaatttttaattagggaaaattaaggttgcttatgtgattaatgtcacgcacgtccatgtgaagagaccaccaaacaggctttgtgtgagcaataaagctttttaatcacctgggtgcaggtgggctgagtctgaaaagagagtgagcaaagtgtggtgggattatcgttagttcttataggtttgggataggcggtggagttaggagcagggggtagatctcacaaagtacattctcaagggcagggagagtattacaaagtaccttttcaagggtgggggaatatcacaaagtaccttctcaagggtgggggaatatcacaaagtaacttctcaagggtgggagaatatcacaaagtaccttctcaagggtggggaaatatcacaaagtaccttctcaagggtaggggaatatctcaaagtacattatcgcaagggcggggagggtgtattgtcataaggtcaattgatcagttagggtgcggcaggaacaggtcacaatggtggaatgtcgtcagctaaggcaggacctggctatttgcacttcttttgtggatcttcagttgcttcaggccatctggatgtatacatgcaggtcacaggggatatgatggcttagcttgagctcagaggcctgacattcctgtcttcttctgttaataagaaaaacaaaacaaaatggtggtgaagtgttggggtggcaaaaatttttgcgggtggtatggagagataatgggcgatgtttctcagggctgctttgagcaggattaggggcagtgtgggaacctagagtgggagtgattaaactgaagaaagattttggggtaaggggtgatattgtggggttgttagaagcagcatttgtcatatagagtgattagtgatagtctggatgcagttttgtaggaattgagagattaattggaagacacaagggccaagtaagagaaagagaaaaacaggtatcaaaggactaagaattgggaggacccaggacattcaactagagagtgcccaagggggttcagcctaattatttgcttgtttgatgagtttttgggctctatccttgcatttttttatgttgtcatataccaggccagactgatttaggtaaaaacaacactcttcatttaaaaatacacagagtcttcctttttcagcagtgagtaagtcaaggcctgttcctgttttcttatattaataataataataaaaaaacaaaatagaagtaaagtgttagtgtcatgaggggaacaggaagctgttcggtcctatttgcaaattgattttgggggtaaggctaactagtgtacatgtgcctgtctaattaataggtagacacatgtaggtgaaggagccacagaggaggaagacatcttttttattattattattattattattattatactttaagttttagggtacatgtgcacaatgtgcaggttagttacatatgtatacgtgtgccatgctgctgtgctgcacccattaactcgtcatttagctttaggtatatctcctaatgctatccctcccccttccccccaccccacaacagtcaccagagtgtgacgttccccttcctgtgtccatgggttctcattgttcaaatctcacctatgagtgagaacatgcggtgtttggatttttgtccttgcgatagtttactgagaatgatgatttccaatttcatccatgtccctataaaggacacgaacttctcattttttatggctgcatagtattccatggtgtatatgtgccacgttttcttaatccagtctatcattgttggtcgtttggattggttccaagtctttgctattgtgaatagtgcaataaacatacgtgtgcacgtgactttatagcagcatgatttatagtcctttgggtatatacccagtaatgggatggctgggtcaaatggtattcctagttctagatccctgaggaatcgccacactgacttccacaatggttgaactagtttacagtcccaccaacagtgtaaaagtgttcctatttctccacaacctctccagcacctgttgtttcccgactttttaatgattgccattctaactggtgtgagatggtatctcattgtggttttgatttgcatttctctgatggccagtgatggtgagcatttcttcatgtgttttttggctgcataaatgtcttcgtttgagaagtgtctgttcatgtccaagaagagaactttgtaaggcaaaactggaaatgtaaagtgaaaagacaagagggagcaccaaaacaggtgtcttgcacccagactcttagggatttagtaagggcagcagccgttagaggttgtaatggggattgatggagcaactgggtagaaggggaggtttgatttttatggtgtatgagaaagtacaaagtgtctacgagtaaccgttcactgctattcatggggctgggtataagcaagcaagaggaggggctaagaggagagtccaaagaacaaggggaaggtagctaaggatggagtgaaatgcagggcaaatgtcttaaaggaaatgagaggttctaagaggcgggctagtggcttgtaacttacatggaagaggttatgaaaagacgaaagaatggactgagcttgtgaggcaggaaggatgagttttccatgatctaagaaccacttgccctgagttggaaaagactggtagagcaggttttcagaagaagagtaggtgggagtgatagaggagaaaaaaaaatactggccctccggagtgggggctggaatattagcgggtgtggaggcattggttattttttttttgcaataagatcagtaggtttctggtgtcctttacaatgaatgattccagccttggctggcaggagaacaaccttaagggcctctattagggaggcattattagtggaagagctttgtgtggtaaggaagcctcttttgacccagatggcagcatggttatggaggatgtggaaagcatatatggagtcagtataaatgttaatgtgcattcctttagctagagagagcacacgagttaaagcaatcagtttggcttgttgggaagtggtggagggaggaagtgcagcagcttcaataatagaggtgtgggacatgacagcatatccagctttagctggtgaaaattgattgggtttagaagaaccgccatcaataaaccaagtgtggtccgggtttggaatgggaagattagaaatatgaggaaagggagaagatcctatgtgtgttagggaaatacagtcatgtggttcaggacttgtgttgggtgctaaatgagaagctgggttgaaatcaggcccatgggtaatagttactattggagtttcaacaaagagtgaatagagctggaggagttggggggcagacaataaatgtgaaaggtatgaggaggatattaatgcttgaaggttgtgagagctgtaaagggtaagtggagcatagcctgtgatttttgatggcctctagaagtatttaaatggcacaaacatgagggccagcccagaattgtgaagttgagttgtttggatagaaaggctatagggcacggtcccagctcttgtgtaagaattccgactgcacagtcctgtactttggttgtgtgtaatgaaaagggttgggatgagttagggagagctagtgtgggagcagcttctagggctgtttttaaggaatggaaagaggagtggggaaaggatctaggatctatggggccaggtaggtttccttttgtgagtttatgtaatggtttagtcaggatggcaaaatcaggtatccaaaggtgaaagtacttaaccatgcctaggaaggaaaggagctgtggctttgtagaaggggttggggtttgggagattagctggacatgatcagcagggaaaacacgtgtgtttttatgaagaatcatgccgagataggtaaccgatgaggaagaaatttgtgctttggaggggaatatgtgatatccctttgagaatagatgttagaggaacaggagggtgtcctgttgagaagattttggtgggggggggcagctataaagtagaaggtcgtgaaaatattgaataaggtgagaagcagatggacagaatgaaagtaaatcatgagaaagggcttgactgaagtaacgggggctgtctgtgaagccttgcggcagtacagcccaggtaatttgctgagcctgatgggtgtcaggatcagtccaagtgaaagcgaagagaggctgggatgaaggatggaaaagaatagtaaaggaagcatatttgagaaccagaacagaatgatgggttgtgaagggaggttattgaggtgtggctgtagcccaggaatagtcagggaagcaaataatttggctaaaatgtctcgacctaataaggaagctgggcaggtgggaatatctgaaaaggagtgcttaaaagagtattgtccaagttggcaccagagttggggagttttaagaggtttagaagcctggctgtcaatacccacaacagttacggaggcaagggaaaaggcccttgaaaagaaggtaatgtggagtgggtagcctccgtattgattaagaaagggacagacttaccctccactgtaagagttacccaaagcatctgtgatggtccaggaggcttccgaggcgatcgggcagcatcagtcttcagctgctgaaccaagaagatctgggaaggagtcagagagccttgggccagagttccaggggctctgggagtggctgctgggatagttggacagtccaatttccagtggggtcccgcagagatgggacgcagcttaggaggaatcccaggctgctggcattccttggcccagtggtcagatttccgtcacgtggagcaacatcctgggggaggaggtcctgaaggaacgcctgtcctctgcggtttaggcaatttgaaggtcttgtgtgctggggatacggctagggtttctctcacggcagaggcaagtaatcgcaactcagaaatatgttgccacttggctgactcttttttattattgtacaccttgaaggcgaggttaattaagtcctattgtggggtttgagggctggaatctaatttttggagctttttctagtatcaggagcagattgggtaataaaacgcatattgagaataagatggctttctggcccctctgggtctagggcggtaaagcatctaagggttgttgccaaacgggccatgaactgggctgggtttttatatttgatggaaaagagcctaaacactaactgatttgggaaaggtctgatagagaaaaaggagcattaaccttgactatgcctttagctccagccacctctttaagaggaaattgttgggcaggtaggggagggctcgtcatggaatgaaactgtaagccagactgggtgtggcaggggaggtgatagaggggttgtagggtaggggagcggaagctcaagaaaagctggagcctgattcagcctggcagggagcgacctgaggaggagcagtgtgggaagaaggggagaggtcagatgggtgggtagaaaaggaagattcaaaagacttagtgacgcttggggttgggactgaaggaacagacagaagagaaagaagaaagatgtgggacaagtcgcactgggagcagagactagggagggaccgatgtgtgaaagaatgccgggatgtcagtcacctcagaccatttgcccatttttcgacaaaattatctagatcttgtaggatggagaaatcaaaagtgtcattttctggccatttagaaccattctcgggttttggcaccaaatgtcgcgcacatccatgtgaagagaccaccaaacaggctttgtgtgagcaataaagctttttaatcacctgggtgcaggcgggctgagtccgaaaagagagtcagcaaagggtggtgggattatcattagttcttacaggtttgggataggcggtggagttaggagcaatttgttgtgggcagggggtggatctcacaaagtaccttcttaagggcgggggaatatcacaagtaccttcttaagggcgggggaatatcacaaagtaccttcttaagggcgggggaatatcacaaagtaccttcttaagggcgggggaatatcacaaagtaccttcttaagggcgggggaatatcacaaagtaccttcttaagggcgggggaatatcacaaagtaccttcttaagggcgggggaatatcacaaagtaccttcttaagggcgggggaatatcacaaagtaccttcttaagggcgggggaatatcacaaagtaccttcttaggggcgggggaatatcacacagtaccttcttaagggcgggggaatatcacaaagtaccttcttaagggcaggggaatatcacaaagtacattatcacaagggcagggagggtgtattgtcataggtcaattgatcagttagggtggggcaggaacaggtcacagtggtggaatgtcatcagctaaggcagcacctggctattttcacttcttttgtggatcttcagctgcttcaggccatctggatgtatacgtgcaggtcacaggggatatgatggcttagcttgggctcagaggcctgacaattagaacatacatatttgtgatcctacaaccatggagtttcttaagatgacatttaggattataatactggttttaatagcaagccaggaatttacagtgtcttaaaatgtggcttatttcttattcagactattcaacacacatatgcgacagttaaataaatatatcctgatatttacagggctttttatttgtttacaaaagtaagttagttttatgtagtttgtaagaatctttaacgtgttattttcttttcttgctgtgtttactacagtgagtatattaagaatgtatttattaggtaagtctcttttttacttcttgtgctattcagggtctcccagacaatgagtagtaagacagttgagagagtaaagaaaaaataagagcagagagttccagagtcatttgtggtgtgtgaatatagacacgttgctagctgtgtactctacccctcccactaccatcccaccccatcaagggcccaggaaaatgctgcatgtttacagtgtcatccaggcacaaactacctttttctgtagtagtcaaatttcaaaagacatttgtaggtcctactttatttagttagaaacattcttctatactagaagcccttaaatttggatcaaagagtaagttttatacaaaataataagtaatcactccgaaattatatgcgatacattgtgtttatatttttttttcctgtggagaccatcagttggtttttattaattgttcagcgatagtgatgacagaaaaagttgtctaaaatggttttacaaatttagaatagatgtgattaaaatgaagattttgaaagaattgtggagtttgtttgtattttattatcatgaattctccagattgtgttgactgtaaaatttgtacacttatgactcattttaatgattttttttagagaaataaaaacatttcaaaagagtttagttcctactttcccttttgtcattctctgaaacctaaaacaaatttgcatagttattcttgcaaataaaaaaaacataaaattttattcatgtttgttctgtagtcattttacaaattcctaaaataggctcttagttaacctgtggctaaatgtatattttttaaagatatctattattttacaaatattcccatgatattggctttgttatctgaatattgatctctattatctccagattattttgttttttgttttttgttttttttgcttgctttctgtcacaattataaatagaaaaaccagttctgacccaaacataatttttctttacttacctggaaattctggaaattatttgttttgtctcctacatagtatctctctccctgctaatgccaatgtatggcctcctacctctgtttatactcatgaagatacttattctttagtattacagcagcatattttatcttcatcaaactctattaacaaagattctccagcccatgtctacactaactgatcaccagttttattctctttcattagatatgctaattataaagaaatactctagatattttgacgatttctttggtgggggaaaagaggagtgtaaggatatagaagaaaataaactcagattctcctgctatactctcacaacacagaacatgtctgtgaccaaatgtgtgtggatttttttccccacacacactaagcaattctccagcaattaattctgcagtggacaccagctgggtgtcctctaattctattcagttctgactctcaacctcaagatagtttctgagcccacaagttgagggcccagtcctcttactgaccccacacactacttcagataccagtcacaagtagtagagcccatacttctgaccaactgtctgtaaatcagggttcccacgatcttctctctctttttttttttttttttgagatggagtcttgctctttcacccaggctggagtgcagtggtgcgatctcggctcactgctacctctgccttcctgtttcaagtgattcttctgcctcagcctcccaagtaactgggattacaggggtctgccaccacgcctggctaatttttttaatttttagtagagacaggatttcaccatgttggccaggctggtcgcgaactcctgacctcgtgatctgcccacctaggcctcccaaagtgctgagattacaggcatgagccaccatgcccagtcattgtttttttgtttttgtttttttttgagatggagtttcgctcttgtcacttagggtggagtacaattcgcaatctcggctcactgcaaccactgactcccaggttcaagcgattctcctgcctcagcctcccgagtagccggggctacaggcgtacaccaccactcccacctaatttttgtatttttagtagagagatgggatttcaacatgttggcctggctgatctcaaactcctgacctcaggtgatccgcctgcctcggcctcccaaagttccgagattacaggcgtgcaccaccgcgcctggctgatcttctctttgagtttgattaatttgctagagtagctcacagaagtcaaggaaacacttatgtttactggtttattataaagcatattacaaaggatacatatcagtgatcagacaaatggaagagatgcagagggcaaggcattcaagaacaggtgcaggctgggtgtggccacacctgtaatcccagctacttgggaggctgaggcacaaaaattgcttgaacctgggagtcagaggtttcagtgagccaagatcatgctactgcactccagctcggaataagactgtatctcaaaacaaaacaaaacaacaacaacaacaaaaaatacaggtgcagagcttccatgccctctttaggtgtgtcaccccacagggaacctccacttgttcagctatctggaagctctgaacccagtccttttagattttcatgtttcatggaagcctcattatatagtcacgattgattgaattatctgccattagtgatcaacttaacctccagcctttattctatcccccaaagctggaggggcaggcaaaaagtccaaaccctctaatcatgccttggtttttcctgtgaccagccctgtggtcatcttatttgcatcctagatactcttatgactctagagattccagaagttataagagctatatatcaggaaacaaggatgaagaacaaatatatatacaagtgaccatgcaaaaatgcaggggttaggggtggcacagtaaaaaatccacttagaaattttgagtccccaaaagcttaattaatagcctactgttgactggaagccttactgataacataagcagtcaattaacacgtattttattttatatgcattgtgtattgtattttcacaataaagttagctagagagaaaaatgttaggaaaactataaagaaaaaatatatctactatttattaagtggaagaggatcatcataaagctcttcatcgtcctcatcttcacattgagtaggctgaggtgggggaggaagaaaagggggtggtcctgctgtctcagttgacagaggtggaggaggtggggaaggtagaaagagaggcaagagaggcagatacacttgggttatgaaaagacatcctaactgatgtctaattgctttttaatttctctaaaaatgtttctgtatggcaacaactcttccaccattttctttaatttttccgcccctatcacaaaacagtttatgtcataaaataagtcaaaatgggtctagaataaccgaaatccccctgccaaattgtctactgtcagtttgttttctggcattacttcttctacatcttcttcctcatcacctggtactggtttggaaccacttacctccatcaaatctccttccattaattcctcctgtgtgctgtctattaactccaagattctccaagattcatatcttgaacccccctccaacacatcatttttgccatatccgctatctctttcatgatttgtttgattgtctctgttgtaagtccttaaggtcatgcacaacatctggacacaatttttccagtaggaatttattgttttaggcttgatggctttcacagctttttctgtagcaacagtggcatcttcaatggtgtaattcttccagactttcatgatgttctactggggttctcttccatagcactgacaatcctttccataaattaccatgcataatgagctttaaagattcttatgactcccttgtctagaggatgaattagagatgttatgtttgggggcaggtaggccacttctacaccatcagtgttgaactcatggggttctgggtggctggtgtcattgcccagtatcatgagaactttaaaggcactttactggcaaagtactttctgattcagggtcaaagcattgatggaaccaatccagaaagagtgaaagagttcttgttgtccaggcattcttgttgtacaaccaaaagactggcagctggtgtttatcttttaccctcaaggcttgggagttagcagctttatggacaagggcagtcctaatcataagccagactgcatttgcacaaaacagtagagttagcctatgccttcctgccttaaattgtggtgcttgcttgcttctcttccttactgaaaaaaaaatgtccattgtgactttttgggcacttttgtctgcattaaaaaccagttcaggcagaaaacctttctcctcaatgattttcttaatggtgtctgggagctcatttgctacttcttggtcagcagaagctgcttcttcttctgttattttattttatttttttattttttgagacgaagtctgtcgcctgggctggggtgcagtggcatgatcttggctcactgcaacctctgcctcccaggttcaagcgattctcctgcctcagcctcctgagtagctgggactacaggcatataccaccacgcctggctctatttttagtagagatggggtttcaccatgttggccaggctggtcttgacctcctgacctcaggtgatctgcccgcctcggcgtcccaaagtgctgggattacaggcatgagccacggcacccagccttcttctgttatcttgacaatttcaagcaacacctcattctgaaattatcaagccatcctttgctggcattaaattttctagttttacctccttcaccttccttttgctttaagttgccaaataataatttcactctttctcaaatcatattagtgtctatacatatgtctttctcacattgatcttaaaaccacataaaaggtgcacgttctatacaatataaaaaagtattttgcagaaagtactggtgtaattgcagctatagcttaatgaatttttctttttttgcaatggttgttaagctggattcatttctcttgaaacgctgggcaactgcaactgcagacctcaatctatgatatgtatcaaacaattcaactttttcttgtaatgtggtgacttctctctgtttcttgggagcactttcagtaacactaatagcacttcatatgggcccatgctgttattcaaggtttacaatattgcgctaacatgaaaaatacatgaaaactacaagagatatgtttactatgtaacatattttactggagaaagaactgatcacttgaagatgattagcttcacatggtgctttaaatgcatacttgatcctttcaacatgaattggcaacaaaagatggctataaaattattaaaatagtacagcttatatgacttaattttatgcagttatataatacagcatctttatgtttggttacatttctctggactgcaaatatctttgtaagtgtttgtgtttgtacagtttggtaaattttaacttttaattgtagatttgtatctattttatagtaataaatgataaaatagagcagtatttacatatattttatgcattttcatgacatatctaaccttttctgaattttttcaaaatttctgtgctacactgtgagttttttcaaattgtcacaaatttcacaaaaaaattcaaatgtatctattgaaaaaaatctgcataacagtgagccttcacagttcaaggctgtgttattcaagggttagttgtatatgttattaaaattcacaatctcacaaggagcttatgctgctttctgacagcccaagaatgcttcccatgctagctcatgtctttatttgatagtaaatatgttccccacctaaaagatgtctgaagcccattagctttactcatggtgccagaagtagtgtaatattttttcttctcttagtgaatttcttttccagaaaaaagagttgaaacttaataagatcaatatagaaggccaaaagttgtcctgagcaatggggttatttcttaaccagatgcttgtctcttctccccagctgcaacattcctctgtactgaatttctttagtgccaagggggataagtggaaagagatgaaaatatagctgctgttgcatggatgaccccattcactctgactccttcagcaagtttcatttttccttataattctcggaggaatgctttgcctaaccacctaccccaacatctaggatttacttttaagatggtcagttaatattgcttgaacataaacttttggccagagtaactggaaatttaagtttattaaacttttacatacttaactatggtctacagggtattttaaactctgccatttgggtttagatctgcttttttacccccacccccaaatgtgcagcagtgtgaaatgtatgagaactaattggataaagtaatttttttaagaccttggtatcttatttctgccagataatagagaacaaatataaaatattcccatgattaaacacaccagatacagcttgaatttttagaatattaaacaggagtgataatgaggaagaacttaggtccctaattacaaaaggtttacacacacacagacacacacacacatcatattaagaatgtaagtaaatcaagttacaacacaatatatgcagtaagatttcctttcttataaagccaactatatcaagcaaattaaagtcacatatatggaatataatttaatctgttttacaagtgagggctgggggtggtggctcaagcctgtaatcctagctctttgggaggctgagacagaaggatagcttgagcccaggagtctgagaccagcctgagaaatatagtgagaccattgtcttcacaaaataaataaataaataaataaatttctaaaaattaaaaatagggtaggtacggtgggccacgcctgtaaacctagcactttgtgggggccaagatgtgcagatcacttgaggtcaggagttcaagaccagcctggccaacatggtggaacgctgtctctaattacttgaacccaggaggtggaggttgcagttagccaagatcgcaccacttcactccagcctggtcgacagggcaagacccctgtctcaaaaataaattaatattacaaaaaaggtacaagtgattatgtatttttcatacaatgcatatttcctgaaaacacattcagtttagtagttacattaggggaacagaatactatcattatggaaaggaaggcatctttattttatgctttgtatgcttctgtatgactagattttttaaacctcatgaaggtattacctttccaaacagtctgctatgatatttattgaacaagtattcaaatgtttcctttgcatagtttactacttggtggtattctgcttagcaatgtctattggaaggtcccagtatatccaatataaataaatgaaataacattgtactatattattagactgtattattggattacataaaagtttttttctgataagaatgtctgttatatttttctcttcttatttcacagtgattaggctgactgactttctctttcacttgctgttaggatttctggggacattacttcccatctcccttatctagtcagttcagttcaccattttgcaaccaggactatcattcacaagcctggcaaagcctgactgtgaagtctgtacctctactctcgcctactccttagatgaaatgacctggaagtaacactacttcttattgatcctcctggctatcatatcccgttcaccttcttccaggtttatccaagataccctaataatgtttcctatgcaaggtaatcttttaacacaagtctaactcccactttctgatttcacaccttctactgagactgagcttctgatagtatcaatactcatatataagttattttaacatgcatacatatatattcttggaggagtagacagtacacattttttatagactcatgcagtggggtttaaatacaatttagctattatgtaatttttggcaagtttcttagcttctctaaatcttagtttccaaatatgttaaaagaaagtatataaaaattaccaacttacaatttcattttgaggatgaaatgaattattgtacccaaagtacttaaagcagcacctagcacagaaaaatatgaaataaagatagaccattttgattatttcatagaaagaaatgtcatggtattacttattattaatgaatatgttgaaggaataattagtaaaaatgaatatatgatatatattgcagtgctttgcattgatggcctgatgcaaatagcagtaattacttacacaggatggctaacatttctgggaaagacattctaatcaatagttgctatctgtggtaggttaagtgtttgaattaaaaaaaaaaaagcagtaattcattgtgatacttccaaatgcactgttcacattttaagttggagacagattattacaagaaataggaaagataatcctaaatcttagtcaattttttttctcattacagattttaaaaagtgactagtaagggagaattttgagagtctagaaaacctggagggaaagaaaaaagagggaaggaaggagagaaaaaaggaaggaaagaaggaagaaaggaaaaaaaggaggaagggagggaggagataaaggaaagaaaaggaaaagaaaaaaggcagaaagaaaagagaaagaaagaaaaagaaatagaaagaaagaaggaaagagaatggaagaaaaagaaaagaaaagaaaagaaagaaaggtagaaaagaaagaagtaatggaagaaatttgagtattaacagagggcactcaggtttccaattcaatacatctcctatgcatattctacaaattagattgtcaaatattcagcttctctcagaaatttaggctattagccatttacaacttactttgaattaatttaatcagattatcagattaggattttgcttagtgactgccaaaatcagccaccctgaggaaattggagttttgattgaaaagtggaactgacaggaagtttggtttgaaagcacagggctcttgctggaggaggagggattgtgggtgttcagtgagttagaagagcctgagatagccagagggaagcatgagggtactggatgcctgggcaaagattaagagaatttgccaagaggtgggacatttccaagacaaacagcatactttacactttggctaaagtccctcatggcagtactcatttttgatatgtgctctcactacatttaatcgcagtgacagttgtgagattagaggtaccgctttcttcaaaaggatcattgaaagttgtgggtttatccttgtgtttctgtttagttttttatcatactagttttatttgtaaaccaaaatgcattatattttagacctttgctccaaaaggctaatgtaataatttttttaatggacttaagattttaactctaaaacctcatcaacattccatatattatgattcacatgggacttgtaaaagacagactccacacttcagaactgcaatgggctttttgttcccactgctgagtatttccgacttcttttgaaggttataaatttacaacttagtatgttttatggtgtggtgaatattgcggagaatgatctggccagatgaaaatgggattctgttggccctcaatgttcttttcttgagagacctactctgcattttaatacatgttatactatcttcaagttttaaccaaaatgttaatttgattttttttttctttcagtcaggaactttttgatgacatatttgtattccacatttcttcacttgtcccagtgttttattgggaaagtgttgaggtgtcttgggatctcttctgactcgttaagcatggagaatgattggttgttaaacgcagtaggggaatattagtaggaaaaaactgttttggttttatgaatggagatgggtgcctgtcgacatttagaaataaggttggagcactatactggtgtatgtgctgaagatttggaggtcatcaaacaacctatatgtaagagtcaatgagatttaaaagaattgaaaagaaaatcagatataagagaagaacaaaacaggagaaacaatgtcatggaaactaagggagtagttttactactttaatgtatatttctcagaaattgctttttggacattacttccatacttgagaaaatatttctgtaacatacctattcaagtgtttagattaattatttttttctgattaaaacattttgctcatgtatcttttaatttttaattttagtacaattgtatatttacaaaattattgaaaagataatacagagagctccccacactcagtttctcaaatctatcatattagtatgatatatttatcacaattaatgaaacataattgatacctggtaacacaccaaagtctatatgttatttaaatctcctcagtgtttccccaacaccctctttctattccatgatgatgtgcaggggtaccacattccatttagtagtcgtatcaccttagtctattcttggttgtgacagtttctcagacatttcttgcttctaatgacctttataattttgtggcttacgggtcacttgttctgtgtaacattcctcaattggaatttatctgatatttatctcaggcttagactggagtcatgcattttaagaggaggaccacaaagataaattgccattctcatcacctgttatcaaagatgaatactatcaaaataacttatcattattgatgttgacattgatcagctagcttgtggaagtgttaatcagatttccccactgtaaagccaattattttctttctgtctctttcaacatcgtgcttttatatatatgtgtgtatatatatatatatatatatatatatatacacacacacatatatatatatacacacatatatatatatatacacacacacacactatatatgtatttttattacactttaagttctagggtacatgtgcacaatgtgcaggtttgttacatacgtatacatgtgccatgtatacatatgtatacatgagccacgtatacatgtatacatgatacatgtatacatgagccatgttggtgtgctgcacccattaactcgtcatttacattaggtatttctcctaatgctatccctcccccctccccccaccccacaacaggccccggtgtgtaatgtcccccttcctgtgtccaagtgttctcattgttcaattcccacctattagtgagaacatgtagtgtttggttttctgtccttggaatagtttgctgagaatgatggtttccagcttcatccatgtccctacaaaggacatgaactcatccttttttatggctgcataatattccatggtgtatatgtgccacattttcttaatccagtctatcattgttggacatttgggttggttccaagtctttgctattgtgagtagtgccacaataaacatactgtgtgcatgtgtctttatagcagcatgatttataatcctttgggtatatacccagtaatgggatggctgggtcaaatggtatttctagttctagatccctgaggaatcgccacactgtcttccacaatggttgaactagtttacagtcccaccaacagtgtaaaggtgttcctatttctccacaacctctccagcacctgttgtttcctgactttttaatgatcgccattctaactggtgtgagatgatatctcattgtgattttgatttgcatttctctgattgccagtgatgacgagcattttttcatgtgtctgttggctgcataaatgtcttcttttgagaagtgtctgttcatatcctttgcccactttttgatggggttgtttgtttttttcttgtaaatttgtttgagttcattgtagattctggatattagccctttgtcagatgaataaattgcaaaaactttctcccattctgtaggttgcctctttactctgatggtagtttcttttgctgtgcagaagctcttgagtttaattagatcccatttgtcaattttggcttttgttgcttttgttgttttagacatgaagtccttgaccatgcctatgtcttgaatggtattgcctaggttatcttctagggtttttacggttttaggtctaacctttaagtctttaatccatcttgaattaatttttgtataaggtgtaaggaagggatacagtttcagctttctacgtatggctagccagttttcccagcaccattaaatagggaatcctttccccatttcttgtttttgtcaggtttgtcaaagatcagatagtttagatgtgtggtattatttctgaggcctctgttctgttccattggtctatatctctgttttggtaccagtaccatgctgttttggttactgtagccttgtagtatagtttgaagtcaggtagcgtgatgcctccagctttgttcttttggcttaggattgacttggcaatgcgggctctttcttggttccatatgaactttaaagtagttttttccaattctgtgaagaaagtcattggtagcttgatggggatggcattgaatccataaattaccttgggcagtatggccattttcacgatactgattcttcctatccatgagcatggaattttcttccctttgtttgtgtcctcttttatttcattgagcagtgttttgtaattccccttgaagaggtccttcacatccctggtaagttggattcctaggtattttattctctttgaaacaattgtgaatgggagttcactcatgatttggctctctgtttgtctgttattgatgtgtaagaatgtttgtgatttttgcacattgattttgtatcctgagactttgctgaagttgcttatcagcttaaggagattttgagctgagacgatggggttttctagatatacaatcatgtcatctgcaaacagggacaatttgacttcctcttttcctaattgaataccctttatttctttctcctgcctgaatgcctggccagaacttccaacactatgttgaataggagtggtgagagatggcatccctgtattgtgccagttttcaaagggaatgcttccagtttttgcccattcagtatgatattagctgtgggtttgtcataaatagctcttattagtttgagatacgtcccatcaatacctaatttattgagagttttttagcatgaagggctgttgaattttgtcagaggccttttctgcatctattgagataatcatgtggtttttgtctttggttctgtttatattctggattacatttattgatttgcgtatgttgaaccagccttccatcccagggatgaagcccacttgatcatggtggataagctttttgatgtgctgctggatcccgtttgccagtatttattgaggatttttgcatcggtgttcatcagagatattggtcgaaaattctctttttttgttgtgtctctgccaggctttggtatcaggatgatgctggcctcataaaatgagttagggaggattccctctttttctattgattggaatagtttcagaaggaacagtacaaactccttcttgtacctctggtataatttggctgtgaatctgtctggtcctggactttttttggttggtaggctattaattattgcctcaagttcagagcctgttattggtctactcagagattcaacttcttccttatttagtcttgggagggtgtatgtgtccaggaatttatcaatttcttctagattttctagtttatttgcatagagttgtttatagtcttttctgatggtagtttgtatttctgtgggatcggtggtgatatcccctttatcattttttattgcgtctatttgattcttccctcttttcttctttattagtcttgctagtggtctatcaattttgttgatcttttcaaaagaccagctcctggattcattgattttttgaagggctttttgtgtctctgcctccttcagttaacatcatgctttttgaaaagaggtcactacactcagccgccagttaacaaacaagtgaaaaattatgttctacctctttaagaatatatatatatatattcctaaatcctatatatcacaatcatatatatatatatatatatatatatatatatatagagagagagagagagagagagagagagagagccaggtgcggtggctcatgcctataatcccaacactttgggagagagaggtgggtggatcacttgaggtcaggagttcaagaccagccttagcaacatggtgaaacaccatctctaccgaaaatacgaaaattatcggacttgatggcaaatgcctgtaatcccagctttccagctacttgaaaggctgaggcaggagaatcagttgaacctgggaggcggaggttgcagtgagctgagattgcaccactcactaaagcctgggcaacgagagtgaaactccatctcaaaaaaaaaaaaagcaacaaaacaattttctgcatggaatatctgtttattctctgtatgtttattgtttattcatctaatcatttacttacatcagtatggattcatggatatttattttatacttgggttatcaaccaatactactttactttgttgtttaaattgtttcagcattagtaattgggacttctttcagctgtcacttatatgctttttttaaatatcccaccattgtttatttttattttattttttagcacttactttctttgtggcactatgctccaggtccaccttatatatttcttgtcaagtcctagaatcaagcatttctctaaggagtcctagtgtctttgattggagaatggtattagaaactaatatctggtttctaggtatgctcacttccacggtgctgtcattgcttctagaccttctcagctgacagaacatgaacatagatttattttgatcttctttaatttttttatcagtgttttgtagttttgcacatatacatgccatacatattctgttacatgtatatctaagtacataatgtttagattctattatgaataatatttttaaaatttcaaaagtcaagtgtttatttctggtaaaggggaaagcatttgactgttgtgtattaagcttgtgtcctaaaaccttgccaaattggcttttttttttttaatttctttgggattttctatatagacatatcatgtgtgactagacagttttatatattcctttccaatatttatgtttcatttccttgtcttgtattatttcatcagctaggactgctggtatgatgctgaataggagcagtgacagggaacatccttgtcttttctctgtcttgggggagagtatctagtttctcactgttaggtatgatgctagtagctattttgtagatgttcttcatcaatctgaagatgttctcctctatttttagtttgctaacagtttttatcctgcttgagtgttggattttgtgaaatgttgtgtcttgtgtcaattgatatgatcatattttgtgttgactttcaaaaattgaaccaacctcgcatatatgaaataaagaccacttggtcttcgggtataattatttcaatacattgctaaattatactggctaatgttttattaaggatttttatgtctacctccatgaaggataagggtgtacaaatttcctttcttgtaatatatttatctaattttggcattaggagtaatgctggcctcattcaatgcgttagaaagcgttcctctgcttttatgttttggaggggattatgggaaactgatgtgagttcttccttaaatatttggtagaactcacctgtgaaaccatttggatccagtggtttctttggggaaagattatgaattattatctcaacttattttagatatatggctgttcgtgtcatcaatttctctgtgtgtgtttagattgttcttaatctttctgaaactaaaaaatatatttgataaaatataaaagtgcctctagagattccctcaaaaaaaaaaagcagatttataggcttagaaaatggaatgaagctggtaatgtttaaaaaaaattatactgagaatgcaaaatcatttttgaaattctggtcaaattaataagatagatatcttccctccattacttcaatgtaccatatttttgtttgtttgtttgcatgtatctgtgtgcctctctgtttgctaaattaaaaaaatttctattttgacaattacatgtcatattatgttttattttaaattatttccatatgacctttgtggagaagatttacttaatcatttaagcttattttctttataatagtttgagttgtttcatgatcacattcaacttaatttaactttatttgaaattgtttctcaatgtattctggttattctcattaagaaataggtgttcaaaataccatgtcattattagcatatcttgcttaaagtgaaagccattgtagcatggtttgcaatttactttggagtaacaatggggttttgtgaagaaagattatgtctcagattttattttaaaatgttagaatttcaagagataaatagtcttcttggtctcaactagcatgagaagtagaggggaaatattttcataaaaagtaaaagagactaacaattgtagtttcacgcaaccaatattatattagttgttttaagacaatgacatcatgtagctgtaggatgacaaaaaaaatggcatttttcaaatagcacctttctccataatttgtttattataattatttgaatatgtgataattactaatattgtcataatagtctgccacatttacgaaaacactggacgtttccacctcagcattttaattgctcaccacagtgccattttctttaggactggttgttttgctttcagtttgcttcctagactatcatcatgagatcaaaagctgtgttttttataccacatgacagcccgatgccccacacagggtcagcattaaactgaatttttgataggatcaggtgagccaaaggatgaataaatgagtactcacgttcaggtggcatcaggtgggaattgtggctaggtaaaatggcatcttgttacaatggtaatttcagtcacctattccttacctcttctgggcaggcggattgatttgcaattggcttcttttcttctttctcactctactaatactagatggaaatctcattgactcttaacaacaaagcaattatcttaccatattcacaggttctaccccacctactagggaagtaaaagtatacaggtagtggaaatcttggggccatcttagaatcctgcccaccacaagcagcaaaatattcctactccattatgtttcccatagctaccttgtgtcttccaacttcgtgtgagtggtgtgtttgttgctttgcttatgggcaaagatgattttttgggggagatatttgattaaccttctaatttcttttatctttgacaccttcagtcttccttcatttacctttatacagacttttttataaggccacttttcttttcctttttcctttagggtctcttccctttgcatagattattggaactctccacttacaaagactagcttttatgcttccaactcttgatataaagtttttatctagcatcagaacttgaatgtgagttgtccatgtgtcagaactgtctttcaaaatcaaaagtttcacataccattttcaattaacccaaaggaaatgctaggcacctatttattccacaattatttttaaagtctgtatgtattaattgtgtacatactattttattatttacaaagtgagttaagcacagtattcctgttcaaaatatgaaaataagtatcatggaaaagtggcaaatgtgtcttgtgttccttcatttttagcaccttgttattccttttatataaaactctggtgtacacacagtttttcctcttttctggaaaatgtgaataaattacatttcctttgtacattccatgctgtcttagacaaaatcaaacacttgagtatagaaatgaattgtattccagtagtagataggacaatttttcactcctttcaacttaggcattgtattagttttctacaaataacaactatagactgaacgacttaaacaacaggaatttattttttcacgattctggaggcaaggagtaccagctcaaggtattggcagggtaggtttttccgagccccatcctttgctttgcaaatggatatcttctccctgtgtcttcacatggtcttctctgtgtttttgtgtcctaacctcctcttcttataaggacaccagtcactggattcaggcccatcctactgatctcctttaatttaattacctctttaaagacactaactccacctacagtcggattttgaggtactgggagtaaggacttcagcatctgaatttggggggagacaattcagcctgtaacagtcatgatatgaattaactgctattgtgcatgagatgtctaacgaaaagacagaaaagaagtgtaaagaagtgattactgagatcaacaaatgttgctataggactgccagtctatagctactgcagatatatatatatatatatatatatatatacataaaacaatgtgatagtgggtgatttgtagatggtaatagaccattcagagaaacaagctgaatattttcttacattggaaaaaaagggggacacaaaagaaatgatttcccagcattttattagattccataagaattctgagcatcaaactatacactgctatatatgaagccagatccaatgggaatcttttgattttacatatcgatcactttcaaaataaggatactagccttatttgctgtgcaatattatcatgacatatatttttaatttattgggtctttcagtttttgtgcatctataaagcctaatagttcagcctctctgtaggcatctttgctacttcctatctgaggaaataatgttttattataaaattacaattttttgtaatttagatctctagtttctaagataagaaaacagatctatcatttggggcaagaatagaaacaaaataaactctcctcttaaagcaagggaaacaactttctgaaaaaaaaaattgaagacacacctttcatgtattttaggaacatttcacttttgctcatcttctgactgcattgtgaaccatcatagctagatcaaaattagttatgttaataaacaaaaacaaaaattctgtctatttgccttacattaagagatatccttttgcctgatgcaacaacagaaactaaaatctctaacgaaaaacatgctggcttctctcaccatcgttgtccaataggaaggaatttggtcaggagtaaaaataactcagttatgatccatgttattacactcctctgagcttctttctctcttccacatgttgaatgacttactggtttatttttgccacatacataatgtttggctcctatctcatgtgcaatcaatcttaattattggatctctttcccccctacaatcagatcattttgattattactttaattgtacattccctaactaacttctctctagtttgtttttaacttcaggctacctgtgggcataacgttgtacaattcagaatgtgaattttacacttagcctaataactaaataagcttagaaatttaggtacggtaaattaggtcacttggtaccttttcgtacaaggaaagcaaacttcttgtgtgcctaggtgttgcttttggagaaactttcctgagcattgaggagtcagtgctaactcctgcaagcatgtgagtctctccgactctgtgatgccaacttaccatcttgctgtagtcgaagagctttaggttggagtgaatgggtaccatctttgttcttagaggtggactctaaggaccttgtttttgtaggaacacacaagggctattttagtgttaatttgaacacatcagaagagtttacatcagaatttcaaagaaacgtaggaatccttgttacctttaaatctcaaattttctccatgatataaaatatcagtcttcttttaaaagatcagaaattaccccaatgaccagatccaaatgctgaacaacaaacagtccagatttaccatgaggaatagggttaatatttgctccccaatgacaaatcccaacccggaacagatttcagccaggcagctagcaaagctcgcgggtgaactgcacaggccatggtgggtgcagagctcagagccggaaagcaaacagctgctgtagcctgatttgagttaaaatagtgtgagtgtttagtctggcgcacggcttcaggggagattggcagctgggtcaaacaaagtccttccattggctcccttcccaggcagcttctgctagtgtttaggtactagtgcagtgtagaacccttttctcaggcaaaacctaacatctgaccgcaccctttttgctattaaaaaaaaaaaaaagcttctatttttttcctgctgtcgataagataaattctccagtagacaacctctcccactaattgtgtattagcaacgtattttatcttgagagcttgtacactgggctctcaacgtggtgtggaaggtagcctgttacagtgctggattcataaaagggcctttatggtttgtgaaagaatatctgtgtgcttagggaggaaactttttgatctgcagaaaagccagaagacatctaggtaaggctacgatatcaaatctacttttttgggggaaagttgggcagtgagactgcttaatcgcaaccaatgtgagtttagagggtgcatgttcacttttgtagaagttcaaaatgtactgacgattgtttgcttattttttgtttgtttgtttaaatcttaaaggaatactgtcgtctgcgtttttacgattttgttttcttctattgaacccattacagtggatatagagttttattatatagcgaaatctttgtaaactgccacagaaagaaagtgttatttagaagggaaattgacaagttttaaagagtaattgtacaatcatttgaggacagaggaacactgcattatactaataagggtttaattaccaaaaaaagtttaatgttgctttggaaggaatattaagtaagttgtctttgtctcttactttttaattttagtcgctgatttagcctgttgggtcacattttttgttagtgctgaaggctgccatgaatccgtaatgaggcccctttgcacatgattttggcacttggccaaaatcaacttcccagcggcaagctttctctaaagaacctggagcaatttctttctttttttttttttttttaaatcaggaatcatgtctgaaagctgccacaaccagttgtataggcatgtcaaaatgactttatacagtcaatatgaaacaagcattaaatattttttctcatgttgttgcttttatcattatgaattccttgcttgttgccacctaagatacgatggagcaagcacagtcttaaagaagatttgctgattttttgtttttctcagcagaccagagtaggtatgatcatcttattgagaagtatacagtgcaaaaaaggtttttcaaaacactacaggataaataacaaatgaattcttaaaactgttaatctctgtaagtaatactcagtgaacagtaagtaatggagttttctagaagtttcatcgtgcgcgcaattaagcttaacatttttatagtgtttttgtctatgttaaaaggtagcatttgggatttttaaaaatgtcagcatttgctatataattttaaaaacgtattaacaccttgatattatttctaacaaatgttttaatagaaatgcttggtatataaacatggctgaataacttttaagtaattgtgtttaattgctgttttgcaataaaaggataatttttcatgaaataaattttgaagctcaaaggtacttaacatccaatttctggaactgttattaattttgatattactataactgaattttgttctgtaagccaattttatactctagtgttttaagagttaaattcacgagtggcaatgaaatactatagcaatcaaatattaacacctcaaattttctatagccattttcaataatatctttagacattaaacataggtactctacagaataattagaagtagaaaagtgtaatatcagttgctctattttgtttttttaaaagaaattttattatcactatcgtaaatactattatgccttgtgtgttaatctgtagtaatccagagtgcaactttattttactagaaacagtcatatttctctttaaaatattgatgagaatcagatacattattttttaagagtgacctaattaagagatttcttaataggcatgtttattctgtatttgtcttccctttacagtatagaatattgcaaattttggtgatagaaaaaatcatattaattttaggtaaattttaggattagaaattgcctcctgatttccttcaggtcattttttgtaaatatacaatttatatttgttttgctgtggaccaaattatgatactgtaaaaaccttgctattagtttaaccgaggaatggagtgtttggaattttcatactagtcaacattaaaagccatagaagttataaattgttattaatagaaatttacctagataaggtctctttgtatgtgagtttacagctgaattcttatttaatgtaatctttgtaatttatataaaagcagttaataaaggtaaatatttcaaaacttggattaaaaaccaaacattttcacatttattatcatgaaacaggtgcaggaaaaataagatagcttctcttgttgagcatgattctcacttaaaaattaattttgaattcaattttaattttaattttagctcttacacacatcttctgtttttattttttgattattttgaatcagttgttgtacttagcatttgaaattgatagattatttttctaatatttactaagaaatgttttaactgaaaattatagggtattctttgttaatcagagcccatagcaaagtaaatgccatcaaatatagaacttttggagtacacagaagtgttagtttgcgagttcagaagaaacttacttgtacacgattactgacaaatgttttttagttgaggtagaaacaagtaagtattaaggacaatttaaattatcttccttactgaaatagctaaaaaaattgctttcttttgctatggcaatgcgttgtaattatttccataatctaggctttttagcagaattattagctagttttccttaggaccaaaaatgcaaaacactgattacatttccttcattgagttaacattttaaaaatactatatggaaatgtaattacttttaaaaagaaaaatattttaatatttttgttgaatttcttcaatttataaagaatagctcgaacaagtttttcgttcatcttttcccccatacttatattggaaatattaaaatctatgaaattttacaatgtggaatctcttttactcttcagaaaaagttaaattcatttatagttgtcaattcaaattatggacttttaccattttaaatgtgacagggttttttgtttgtttattttaattatgcaacaggcacttaaaatactttctttccctccaattaaaagagacattaaataattaaacatcaacttttattctgtattgaaaagaaagctttaccattgcagtattttatccacaattgtttaaatgtgagaaatgtttacaacagggtattttaggtgagcatttatcatttaaatgaagtgctttgttctgaggagtctaaaattcagcaataagataaatgcattgctacattagattgaacatcattgttgaatttttggcacaacttcagtgacctcggccataaaaactagtatagtcaggatgatttggaatttgcagtaacaaaactagatatagaagcacgtgaagacaccaacctttgttgttttggagaaagtatgcactaaaataaaagatgatacctttcatataaactgctaataataatactttgttatttcattaatacaataaaagtgaaatattaaaacagtaattataatctgtaatgcatttgtaaggcttttctcataaaattaactgccatattttactcttttattagatgaacaaatgtcatatttccaagcagccaacatagaactatagcttatataaccaaataattttttaatgttactttgatttatatacaattgatattgtatagaaagaatcacgttagctgattttaagtcttgttcaaataaaagaagcattgatttgcacttgttgcaatttttttactttatattggtttaattttaaaattatcacaaagtaaatattactgtttgatatcattcttaaacattcattttacaagccacctgacctattagctgtttaaacaatgatgatttatatcttgctataaattcttctctcaaagtcaagacaaatagatcagtaaaagaacctcttttttaatgctcaaaattttttcttaaaaaacaaagaatttttttagttttcttttgtttatgtgttcatgtgtatttgccaacctgtgtttttgcctacatcctgaaatatatgtcttttgaactcgaggttggaaagtctgatagcaggctcttaagtttattcttattccatattattttttataaacaaatttattgagtttcttactgagagtaagtcgatatatgaatcaatattaatgatcacatcaaatctgaggatttgcttcctttaaagcgctgaatattcagcataaatttgtgctaatttacgtgtttatagagtgattctaaatatttgattagtattcgttttaaagatttactaattctttgaaaatctggagaactatcgtttgcttaaaaaactaatatctactaaagttgtaattgtctctgctttgctattattgaaatattacataatctcttgtttaaaaatatcatgagactaagctatcgtgcctttctttccatttctcccactaacatctgaggtcaacgtctgtaagaggaaatatctgaaaatatttcaaaaacattttctttcctgtgataatcaactgctttatcatttgcagagattttgaaaggagtaactgttttatttgaatgcttagataaatgtgaggaatatatgggctttctgtggacttcagttttaaaactaaaatagaaagtaagatggagagtaataaaatgatatattttatagcaactaattacaacttgctgttcatacataaacaacacgctggaaaggtagacagtgggctttgagagcagctttcatttactcagtctgtaagaactcgtgaaaatggtgtcaaagggatggtggtgatccattctgtatggtccatggtgctttaagcttatacagtcatttaccatatttaaatccccgagtcttgcctcagagccccaatcaccaatctgagatatttttacaaggagagaggagttacacactcattcttgttcactggaggatctgtgatagcgtttccttggcagaagcagggttcttctctgtatagtgattttttttaaatccctgtttaggtagttcagctcgttcagttggacaaatcagcattataaccaagctgactcagccttagcaaggatcactagtttttcattttgccctaaacctgggcattttcctgaagaatatggacagttgtgcatgaaaggtcaagttgctaaaaattatagaacatgcatgttctacttatgagttactaagttgtgttttgtgttcaaaatagtatatataaatacatgttttgtgtacagaatatttaaacagtgatagaaacagttgttctgaaatttaagttatgggattggctttattccaattctacttgagatgtcatccaaaattacttttcgaaagcactgctttgaaaatttcctgttacagtcttcatgaagtatagtgatctggatatgaattttctgctagtacaggagtttgggaaaaatacaagtatatgactattgcatgttctgtgggattctaatctgatcacatgctctttcctctccattccttgggcccattcataaatattctatggagagttattttttttttcctgtcaacagccaattttagtctttattttaatttatttctttttagagataggatcctactatgctgccaggcctggagtgtagtggctcttcacaggtgtgatcatggcccactatagtcttgaagtcctgggctcaagagattctcccacctcaaccaccaattgtagatgtattcagatagcatgacatttgaaaaagttgatggagagaaaattcctactgaagtgtgttatagatatctctaaaacatctttggttgtcaggaaatgaatcaatgatatagaaacaaacaatgatttgtaatcttggcagataaacagagaaataatcagttcagaatatttatggaatgataacattttcctgttgatatatttttgtgccaacaaatttaatttggaaactggtatttgttactagaaggcagtaatcaattttggtaatcagtagttttaaatgctttattcaagaccaagggctgatttattgaatgaataggtcttagataaaatgtaagctattgggccaacccatatctggaatttgtttttattttcaatacccaagtcattaagtgtaaatgtaatagtatttgcatattttcaactttcagattagtcatgtctacctttgaaatttgttttctccttagataagtaacttatgagtaatcaaatatcttgcaatttccattttccatcttaaagcccgtgcaagatcaaatttgcagttgctaaatcacataaaagtctggattaatagcaaaatgagattatgtagcccaaaatgaaattataaataaagtgcaggtgtttgctaggatttgtgtggtcagatatacaaatagaatcacaggtagagtttctcatttctcacttgagaaaagtgcaattaaaagtaatttccagatgttcaaatgcacagctgctttctcctaaactaaattttgcagaaatgagctaaattataatgggtttaaaagtcactacgttttaatggtttttaaattgaatttgaaacatcattactaggtttaccagatgaagagagttaatgcttatgagtacctggtacaattttcatttaggtggcagcagagccattaacgtattggaaattataataagaccaaaacttacattgggtttgaaaaaattgattagtatgtgtgttgatacactccatgcctttatgagatttatattatatactctatgacactatgaaagttattcagctataggtgaaagaaacgtgtgtatatgttcataaaatggtatgtgtgggggggaggtgtgggtgtgtatgtgtgaaagagatttttacattttctttgcctaatgaaaaggaaaatagcaagaataagatgcaagtacactgtttgaaatatgcaagtctattaaattgtttttacatatcaaattataagcaatgactatgaacctacatatctgtaatatcaacttaaaaaaatccatctattttactcagagttacttacatgcccaatagcaataagctactgtcataaatattatcccattaagtaaagtcctgttcttgactaagttttcttgggcttgaaataggcttttctttgcagccaggaatagccaagttttttctaaaactcttacgggaaggcgtgtggatggttaaacgaggaatgggaggtaaaaagtgggggcattgcattggaatagagaattaaagagcttttaccctacgtaagctcagaaatttatcattaaacaatccattagtatttccacaacagttttcaaagcgcactgctgaaagaatttcaaaaatttgaccttggaagtgattagaaaactgacgcattagttttgagtatgatggtagaacactttatcctatgtacgacgttctttcaagtgattgactcgtgcccttgaaagcattatccatggccagtgattgatggacttgttcaggtcctatgcagagtgcttcatatatctcatctcaatcctctaaataaccatgaaagttgatgattatctcatggtacagatgggaggctaagagtgtttaattttccccaagttccagtgctagtaagtgttgatgtctggatctgaacctgtgttaatggtgtttctagtcgatgctgttatctgttgcaccacattttgaataatcttggactttcagagtatgaaggacgattaaatataaccctttggtataaatgttctctctctcactcctctgtaacaattggagaaacagagttctaacaatattaaaatcagccatagacagagagtagtgagaaatatactttttttaatacagaaggttccctgaagtacttttagtattattctaaattaagcaataaccaatgaacaattttggtcataagcagtttctctccagaaaaaaaaaaaaaaaaaaacagataatatccatgaacaaaggttctataatgtgagtctcttttgcacatcagtggcttaaaataatgagtagtggaatagcataatagggggaaatacctctcagacaggaaattgcactagcttgttttgtcaacatatacattactatacccagagacatacaagagttagagactcacggtgagttttcactgtggccatctgtgccatcccgtgcaggactctactgtggcattccacaaaagcaaatcctcagaagccttctcaaagtgcttaactgccttgaaacaggtgtttctcactagacaacaatgtccgtttactttaaaattcagaatttccccatatcacatgcttgtgaagaaagaaatttgaactctattatagtctagttgttggcaattgttataaaaattagatttctaacctctattgatagcactatacttgaaatgagaatgtgggcataaaatacttcttataaacttgtttttaagttttatgtaatgttggctgttacaggtcaagatatgaacactgaaaattttgggccaaagtcactttttcaacactggcccatttgagttgttgattttagagctgggatcattgaatgttattttttcatacctttattttatgcaacagaaaatgaaggcttaaagagggaaaaatggcctttctgctcatggtcataatactagcgcctggagagttggctttgatcacagattttccttccagttttctattccttcatttatataaggccatttaccctctaaatcatttacatctagttataaaatatctttttcttttcctaaaactttagtagtacagaaatacaattgaaggagatttggcttcgttggtaaatgtagaaataactaataagaggtattgaatataaacttacccataagttattgtttctgtaaatgcacacgattaaaatgtctagtttgtaatttcattcttgatgtatattctagggcacgctgacattttaaagaattttgttgaaacgcccactgagcgtgctttctgaaaaatgaagattatcttttgttttttttcttttttatgagctttaaaaagttttaaataaaagtttctaagatgcatgattcttaagcatacatctggatgaatgtcttacatatgcatccatatgtagttataaacattcgtacatcttctcccagataccagaatataaaaatttcagcactccttaggactctctcatccccctctgacacctgtcaccatatatattaggtttaccagtctttgatttcatataaatagaattgcacagtatgtatatatttttgtctggcttacgttactcaatattttgtccatgtgattttcccatcttgcatatattggttggttgttcttttttgctttgcagtatttatttgtgtgattatggcacaattttaatctattgtgctgtgttagtacactcgttgggtgttttcagatgtctgtttacataattttttaaatgcagaactggtaccaaaaatatagtagtcagttgttttctttaatagatgaaatataaaactagaatcactttaattaaagtactacaggcagttattgctttacatggtcccatgctaactgaaattcatttatatttgaactctgaaaagtgataactcagtatttctgagttatctatgaaaaaaaatcctggaaaaaagaattagtatgtgttatcctaagtagatgctgaagaaccagtcctgcaatatttaaactttatcatcacccatttgctcctgttatttattacatatatacaactgtaattatagtttggaccaaatatccatgtagttaaactcagttgtcactttattttctaaaactccttctggatggcaaaaattttctggtttaaagcaaaataattaagccattgcgttttacataggatagttagggatgattcttaaatttttttttttttttttttttttttttttttttttttttgagacggagtctcgctctgtcgcccaggctggagtgcagtggcacgatctcggctcactgcaagctccgccccctgggttcacaccattctcctgcctcagcctcccgagtagctgggactacaggcgcccaccagcacgcccagctaattttttgtatatttagtaaagacggggtttcaccatgttggccaggatggtctcgatctcttgacctcatggtccacccgcctggtcctcccagagtgttgggattacaggcgtgagcccccgtgcccggccaattcttaaaaattttaaactcaacattttatgtaccatatgagtgaaatgagacccaatatttttgacaatagggataaatatttgtttgaaagtaatgggaatagttttagagatattttctaactattttctgtgatattttttaacggttccaccgttggtgttactatactcaaatttaagatcttttcctctgctaggataacacaaacattgctaatacaaaattgtaagatttttaaatttttcttttattatggaaaaaagattaagttatttagaagttcttaagtcaccaatcgaatatatttataagcttctattgagtgtatcatccaagagctaatgaatatatttattacattgactatattgataaacagtctggggttgtcatctggatatttttcacacttgctagtaagcaactgctttaataaaataaataacatgaaagtagtatattacaatgtggtttgcaaagccgtttcacatatacatatacacattaacattgagagggagaggatatcacagtcttccaccccagacagtaaaataattagtatcctgtagctaagaaagactgagctatgacctgcactgaaattatttttctactgtaaatctgtcatcttttattgcaacaaactacatctctgtaaataatggaacttcatacaacagatccgtggtgaactagtggcttaatatatctctcaaaatattttttaaacaaaatatattttttatttgtatctataatgctacaaaattctcatatgatctggaaattttcaaccatatatgataaatgatttatttatcatttaacacattttcttggaggttgtgtattaaatacattttagcccctaaaaatggtaatatcactttctaatttttttgtttgttttaaataatcagttcaaagttggccaaggtcaatgattcttaaatcctattattattttttgacaactatacaatgcctgatattgattccattcctgatatcagctggcagtaagcttccctctcagatgaagtgatagatggcctgttcataattcatacatgcagtggacactacaaaattccactgctaggcttctccttaattagacgtatttgcatctaataggaagagaagactaactttccaccatgctttgtccctgtaattgtattctaggtattaaaaacatttttaaacatgcgcagtgtctgaagacctgaattaacaaactcatgtggacatttgaaaatgtgtacctgtttgtcctactactatgctacatatgtttggttttgtaaaaatatgggtgaattcatagtattgttctttttcactctgaatgtcaccttgtatctattggtttttactgacccatgaaaatggctggagttagtctgatctcaccatgtagaaaggtcaggttcatggcttggatttgagaacagcagaatgaatcaactttgaggaagaagctgatttaaaaaaaaagaaaatgtctatttacattgagcttataagaaataggtagagatcaagaagaaaacaagtatggaattacttcaggatattttaaaagcacttccatttaggtatccttgactaaatctgtcaactttgtatccattttctcatgaagaaagtgttgaacttttcactagaagtacttttttttattcctcagttaaaacatgcctgttattctttttgtaatacttaagcaatttttttttaaagatatactacttagttcatccgtctccacttgttttttttttttttttgcaattatgtgtttgtttcctttaatacaactgctataaaagcaatcatgttcatggagaaataagtataattcataaaactagcatgccttgcagagatacaagtaaaaatatagttgtgtgtgtgtgtttatttactgagatgaatttaattcctggagattattttaagctttggaaatgatctctggagtaaagaataatatatttcacttttttattaataataatttttattttgaaacattgatatttataatctgaaaatcctatttatttgtttgtttgatatataccaagaaacagtacattgataggtgatcatttttttcactgtatttatttatttttggtaagagaaagtaaattgatatttaattatgaaataactaaatatgtttttcttttgtctagactaattgtgaagtgataaagtacatttcttaccaaatataacattttaatgcatagaacttactatctataatagctatcttacagtcatgatagttattaaggtaatttatcaataagccttcttttggacagaagggatacatctaatttttaaaaatttctctttgtcttttactaagaaagcctcatttatagaaaaccaaatgagaattctggtcatcatggaccctaagagctctcaaatccactaagaaaattgccatatgtgaaatattctcttgcccagttagaactattcattcattgtaggctctgatacccatttgataagaaataacattctgatgcatggctaatttgaatcatatttaaaaattaagtaaaatttgagccataaaggattaaagagatgtagattatctcattttgtagcaggagatttttaaaatttgattacaaagaaaaccaaatactcctataataggaaatgttacaaaattaactgagaatcgtttttaccctattttgttattctagtctctgactggcgtgaaaaagctactagttaaatgattcaggaaagaataagataaacaaagggcatacactgtccatacaccgtagtagttcctaacttctctctggaataattaaaatcaatttacagtcagagcagttaaccagctctcagtagtcttccatgtaatgaatacacttctgtacccttattaaaacacgatttgtcagtgcttctgtcctcatgaaaattatagcttggttgagaatattaaacagaaatgaaccaacatgagaaaaatggaaaataggctaaattagtttaactaagcagctagattttctttatcatgtgccaatcatgggcaaaaattgaagccagcacaaatctctctgaatggctttctagggaaaacacatttttaattaccacatgagcctgttggaaggtaaccgaattcaacaaaaccattaattgatattttatttgaaacctttcctgataatgcttctagcatctatcaccctattcctatttctcttgaagaacagaacatagcatataataggtgctcaacaaatatatgttaaatgaatacatgaatgaaaaaccctaataaagtgaatatttgtatctctaactgagtttctctttctcaatacggctcatttcctcaaatgctaaaagattcttaaagctccttctgggtcgcttatctttcaatgatttagttactttacaaagaaataacatctaattaaatcttaagcatccagagaaatcactttatcattttgtaataatatcagtcaatgaacatgacagtttctgaagatatatgtgtggtaactcgtgatcattgtgcttatatctggtccacaagggaatgaagattgttaccaaggatgtaataatttagtgtgcaatacaatttaaaaatagattaaaaactgagatgtaaaaatggcactcagcctgtttttggtttctttgtgttgtattatagtctcatattttgttttcaaaaggtaattgtctgtcaatgtgtttagtcatttctttgggcattttttgaacatggtacatatagaccatatcttcataaaaccaacaacttttatttttgccatttataaattcaagtgtactcataatgtatatatttgtattcagttattcagaaaccttagtatttaatgaagatgtacagagaaatggcataatcaataatgaattggtatagcacctatgttggagcatcttttatttagtgcagtaaaatggagcagatgatttctattcctaaaagtatttccccacttgatttaatggtaaatcctccagatcatagtattactattctagcattcatgtctgctgcctttagctttctgtgtgaaaacttctcatcaggaaatttcttaactaatcaccaggaagatttaatcaaaatcagtttagttactaactaatgtaagcttaggggaaagagagaagggaagtgtataacgattgaattatttgactacatattgttaacacagatataaaaatccatgacttctctcccttcctcctccactaaaaaaagaaattgaagatagttgggaacaaatagttgttaacagcaaaaattaaaaagaatactagcagctaccactgcctctagagagtgtactgggttctagtagacaagtagagcttttttaaaagaactgatgctggagacggtaacaccaattcaaacctcacctctaccactaaccagttatcaaatcttgacgtttttttcttacctttgttttttatctgtaaattggtaataataacaaacttgatttcatagtatttgttaaacaatcaaaaattaataatgtctcttccaattaaatgaagatgtatacaatttaatccagatttaggagtgaacatgaatgaaatgggaaaagaagcatgttcctttgagatgttacacttttttagtataacatcattgaaaaaagcatcaaagtattcaacatgttgccattatgaaggtaaaaacagaaaacagagtggcaagtttctgagagtattaaaaagtagtaaatgttgactgcttcatgtttctttaaatcatcattaactggagggtatgccagccatatcttccatgaatattttcttttgaaacatttcttcaaggaaccttaagtacattaattaaactagggcaaaacttcaaaagacctacttcacttttctttgtgcaagttcacataagaaaaagcaattaatttaaaatccaagtttcatgtattcccagctttccagttgggagaagatgaaatatacatcctcaactctcctatttctttctgaactcaatcttctcattctcttttttctttttttctggcataatgggttattttgattactattaaaaggctgaatggtgttgacaattatcttctttttacttctgatgctaattccattgttcagtaaattaagggaaaggaataccagatgaaacttggtatgatttttaaagtctggaaaagaaatcaatatttagcttaattattgtcttttatgtacaggtctgagtatttacatttggaacaatccttgagcttaattctgctgtttagacatgaaatagagttccaaaatcaagttaacctatttctcattaagatgtattagtttcagtgtatcttgccctgctaaaaacaatcttttttaatgctctatgttttgatctatttaatttttttaaaaaaaacataatagtagtttccagtatggaaaatctggttgtctctaattcagtctctttatactaagtccagtagatccattttaagagcaggatagacctttttaaggtgaatatctttcagaggggaacacagtgtctgatgtatgctgatctaaatctaagaagttttttccaatctgagatctcttgccttacagatactgaaagcatcagtgtttctcttttctaaaattttcacacaaatttcagtcctgatggtgtgatttttttttcttttgccttcaagagctaacacaagacataaatcagaaacaaattaactgaaaggaaaactcaaaaaaaaaaaagaaaagaaaaaagaggatgctttacgaagggagatgatttgatggtgggtgaaactgtagactaggttaatgcaaccaggttaaagaaactagagggttgaagtacaataaagggtgtccagaattcttaaatgcagtaaaacaaacaaacatgtagcagaggggccttgtctagggtatggatgtttttcgatttaaacaaaaaggaggaaaaataaccaaatgatctagcaattccttagaacgtctgtatactatctatccaatgtaataattaatccaaatcatctgtcactatgcactgccactccattctgataacaaccctctaaccatgtctcaccaggaaataacatttttattcatacaagttgcaggttattttcaagacagacttcctctgtgctgttcatcatgcataccttagctaaagtattgtagctagaatatagcagcaattttccaaccgatcttcgagtctttattccttcaggtatgttgtgtgtactctttccatttgcctaaattttctctcaaaaattaagatcacatctcacattttctaggaatcttttatgactttgttgctttgatgtccatgtcccaactgcacaggtaaaggttcatcatagccttacctaaaccctctttctggtcttatttctctgatggttatttccacagttagagctgcaggaagccacttctttctttaacacatcatatcaacttccatctattttagttcatgctgcttctgctataaaaactcttactgctctttgtctttacctaaaataattccacttctgatttttattaactatatcagtttgggcaacatattaaattgcttcgtgcctcactatgaaactctttggttccagatgtatttagaatagtttgaattttagaaaagttagagtggttatgctatacattatgtaacatccccagcaaggtcttgggtggccaaggacattaatatgtatgaataataacattaaagtcagtaaatagatagtataagtagtttttgctttaatgttaattgattccaaacttgaaaagtctttcatgtttagaaattattgtgatttggaatttcagaatccaaaaggagccatgtatctctagtgccaatctcacagacttgaggtaaagattaagtgaggcgacacatttaaagaacttgcaggctatgtgcagtggctcatgcctataatcccagcactttgggaggctgaggtgggtggatcacctgaggtctggagttctagaccagcctggccaacatggtgaaaccctgtctctacaaagaatacaaaaattagccaggtgtggtggtgtgggcctgtagtcctcagttacttgggaggctgaggcaagagaattgtctgaacttgggagataaaggctccagtaagccaagattttgccactgtacaccaacctgagcaatacagtgagactcggtctcaaaaaagacaaaaaaaaaaaaagaaaaagaatttgcgaatggtcaacaatcattatctgtaactgttattatcaccatcacctgtctggtgtttcatttaaaaaccttgtcgcctgcaaaaattccttctagccaatcagaatttattatacaattcttataagaacattacagatgttactttttgcctgtttgtgtgattcgttttttatatgtttgtttttacctaccccaaactttaaaatatttgatagcaatagtagtttatgttttcaaatccacatcacattccaagctgcattccatagcatctctatctcttccctctggatttgtcctccacttccagtgaaaaaaaccagtaatattttggctttgtagaaaaacttatttttattcagagaaattgtgacttcctccattttgcctcttacggacaggaacttgtcattaatgtgcagtagaggcaaacattccttcttggaacaggatctctgcttctggctgataagctaggtgctgctagaatgtaaatgccttctaacttgggtaatagttcttagtacctttcataaagtcctctcttatttcagataaaatttgaaggaactgtcacagatatttaaaattatcaaataaattataccagaaaaactgcttaaattttaataaagtttgtttttagttgagagtgtaaaatatgacattttattttcttaataagtttatgtggacttaaactatgaaggtctaagttttttgttttcctcatgtgtatagacctccaaaattctttgaaattttaatttgggagagtaaaaaatttgttcaggagagtaatttggttcagagtattaaaaaaacaaaggtaaatttagaacttttgtggttaacataaacaaaaatcccttgattcattggatttataataacgaagagaaaattgaaaattagttaggttgtttggagttaggaaggtagaatgatgagagaggaaaatggaattcaactaacttttttgaggacataacctttattttatttatttatttatttgagatggagtctcgctctgtcaccaggctggagtgcagtggcgcgatctcggctcactgtagcctccacctcctgggttcaagcaattatcttgcttcagcctcctgagtagctgggactacaggtgcccaccaccatgcccggctaatgtttgtatttttagcagagataggatttcaccatgttggccaggattgcctctatctcttgaccttgtaatccacccaccttggcttcccaaagtgctgggattacaggtgtgagccaccatgcccggcttaacctttattttattaatatttgtttcttccccaaaacttgcatgatgagtatcattaactgataatactaaattgatcttggaaggactttctgtgaggaaacattacttagtgttgcctataggtatttataagcacctataatagctcaattgaaatgttgcagaaaaattctgaaagacctttacgaggtgtatggaaatgagtgaagaataaagttgagagagaaaactgatggcattctgaaagggaaacacattgtatggaatttagtgggttgtttgttttcttaacctggcttattgaataagctgaactttcccagcctccatcctttaaaatatgaacaccacaaataacaggaaagataatagcattggtttccaagaagagctctacatgtaagccatgcattgggtctctaaggccagtaaccatagcttttgaaatttcaggaattctctttagagtcaccatcttcaaccttaaaaatatgaatttaaagactgaaaagaataagaaactctttagttaccataacacagaaattctgttgtgattttagttgtatgtttattttttaagagttcaaattaaaaaagacaaaattcccatcatttcaataacatttttctcatggttatttactctataaagaagttattgactaaagtatttcaatgctaataactgcaactctaacatgataagtatgtattatttgaactcactatgcaattgtaatccagaataatgcattttaaaatttctaaaaatcaaatgagtctgcttgtaaaatatttttgctggcagcctttatagaatattgaaaataatagatttaaagtgaatattctgattaataatagatgtcaaacttgccaagaaaagtcagtagaggatacagtttttgaaatcttatgtttacagaaagataaaatgaataaaacaggaaaacaagccttaccattctggactatcacatttgtccacattaatgtccacattaatgtcaaatttaatgtctacattaaaatgctcgatgtaggctgggtgtggtggctcatgcctgtaattcacactttgggaggccgagacagggagatggcttgagcccaggagttcaagactagcctgggcaacatggtgaaaccccacctctacaataaatttaaaaattacccaggcatggtagtgtgcgcctgtggttccatctactttggaggctgaggtgggaggatcatctaagcccggaaggtggagattgcagtgagccatgattgcaccactgtactccagcctgagcaacacagtgagagaaaaaaaaaagtgttcaatgcaatttaaataacttaaatgttattggggaaaaatagtgttcttcagatatcatatttgcttcaagcaaaaaaataacttcagttagagctagctggaataatgacagatttctagattatggtcaaaataatgccattaccttgtacctgattgctgcatgtaatttttgaaaacaatacaaattgttttacctgaccttttgggtatcaaagccttctcctatctaaatgcaatgatgatattaggtaaatgcagaataattctgaagttatgttttagacttaaaactgtatgtatttagaagcatgaccaatttcatctttagtaaagcaatacctgaaaaggggggttttagtattttaaacattgtcatttgagcttagaagtaacattttttccttctcttatttatttatgtatttatttatttatcctttataggtcttattcaataccaagaattcctcaggatgtccatttttttgttttgttttgtttcttattatctttgtttttttttttttttgagatggagtctcactgtgttgcccaggctggaatgtagtggcacaatcttggctcactgcaacctccacctccctgaggttcaagtgattctcctgcctcagcctcccaagcagctgagattacaggcacttgctgctgcacccagctgatttttgtatttttagtagagacatggtttcaccatgctgcccaggctggtcttgaactcctgacctcaagtgatctacctgccttggcctcccaaagtgctgggattacaggcatgagccaccgcacccgtccaggatgttcgtttttaaataagtcaccacagcttcatatttaaaaaaaatctttaattaaatttcaaatcttgagctgaatttagtataatattaaacatagtttagtaattacatatcatttattgttgatagttttgcatatgaatctatgtatagctcatttaaaaaatggctttagcatgaagtataaacagttgaacaaataaatgagaaaaatgcttgcttagaaggaatggaaattgggtcagcacagccttgcctttgcccaagcggtggagttgagaaagtattttgtctacacaaaagccagacagctactctaatgcccagtgaattctgacagtatgttacagtttaatgtgatgaatgatgtaaggacccgcctaaaatgctcacgcagcttcccaatgtcttaccctgacctacaaaccagctcataggtctccatgcatgtgttgtagaaagtgatgtagatggccaggcggggtggctcatgtctgtaatcccagcactttaggaggctgaggtgggtggatcaggaggtcaggagtttgagaccagcctggccaagatggtgaaaccctgtctctactaaaaataaaaaaaaattagctgggtgtggtggcaggcgcctgtaatcccagttactcgggaggctgaggcaggagaattgcttgaacccaggaggcagtggttgcagtgagccaagatcgcgccactgcactccaacctaggtgacagagtgagaatctgtctcaaaaaaaaaaaaaaaaaagaaaagaaaaagaaaaaaagtgttgtagattagttgaggatatatatagggagaagttacttcaaaaatgttattttttataaaagtctttttgactgtgtttctcacccacttaaacacctccagggtagagactgtttcttatttatatatattcagtcttgtatatagaggatcctttcctcatgaatgtttatagaataaagttagacattagaaacaagaatgagccttttgcttcttgttgcctgcagggctaaggcgaagctcatggaataagtctaggatgtttgtttttatatgaactgtggtgtaatagaaagagagcaagaaagaacagcagtaagtaggacaagaattagaagctgataagttagtccttctactttagcttagcatttaaagcccatcccactattcttcagcatatgattcagttgatgtgaaactctcactggcttttcatagctctatacatttgcacatactgttctatatgcataaaaattcttttattcctttttcacctgaaaaaaaatatctgctgatcctttaatactctgacacctcatttgaaaaagcttgctttactcctccaggcagagttgattgttcctgtctgagatgttacctatctgtatcatagtgcttttcactttgacttacaagtattcatttacatacatgtctgctctcaggctaaattttcagctcctcacagccgggactatttcttgttcatttctgtattccaaccatcttttattatgcctttcacagttggcattctatgaaaggctggttaatctttctaagcattaaaccagccttttggaaaaataatgtaatatatttacagagaaatgatatatgatggcgaacagtagtttatgctctctgttgccttgtatttctccacaaaagtaaataacaatgacaaaaacacaatatcaaatttagaaatgaaacaagatttgtttgaaagcatttatttgaataacttaaatgaaatagtcagagcagtataaatagcatactacaagaaaataaagtcataaagaaattttcaaaactctctgccagcttttcatagacaatagaaaattagaatagaaaaaaatcattataggacatcctattcaattacatcatgaatggacattgaataaataaatggatgactgaagcctagaggctagaaataacatcctaaagtcacatttgttagcatctgtgctaggattagaacccagatcccaatgccaagtcaaaagtaaaatcctcacttttaaagtgctgtgtcttttttaacttttattttcatgtaataattatagacctacagaaaaagttgtgcaaataacatagagagtttacatatgtccttcacctagtttcccctaatggtaacaatgtacataactatagcataattatcaaaaccagaaattaatataaaattcaggattccacattgcctttttttgttgggtctccatcttctcactatgttgtagtttctcagtctttggcttttatgacattgacacttttgatgagtactgatcagttattttgtagaatgtccctcaatttgggtttgtctgatgttttctcatgagtactttgttgttgttttcttttattattatactttaagttctagggtacatgtcacaacgtgcaggtttgttacatatgtatacatgtgccatgttggtgtgctgcacccattaactcatcatttagcattaggtatatctcctaatgctatccatcgcccctccccccaccccacaacaggccccagtgtgtgatgttccccttcctgtgtccaagtgttctcattgttcaattcccacctatgagtgagaacttgtggtgtttggctttttgtccttgcaatagtttgctgagaatgatggtttccagcttcatccatgtccctacaaaggacatgaactcatcattttttatggctgcatagtattccatggtgtgtatataccacattttcttaatccagtctatcattgatggacatttgtgttggttccaagtctttgctattgtgaatagtgctgcaataaacatacgtgtgcatgtgtcttgatagcagcatgatttataatcttttgggtatatacccagtaatgggatggctgggtcaaatggtatttctagttctagatccttgaggaatcgccacactgtcttccgcaatggttgaactagtttacagtcccaccaacaagtgtaaaagtgttcctatttctccacatcctctccagcacctgttgtttcctgactttttaatgatggccattctaactggtgtgagatggtatctcattgtggttttgatttgcatttctcatgagtactttgaagttatgcatttgggaaagaataactgctatgcccgactcagtgcgtcctgtcagcaggtacatgttttcaacacatctaattactgaagatgttaaccttcagcacttgagtgaggtggttcctgtcgggttttttccatgtaaggttactatttcttccttcataattaatatatttgcaggaaatagtctgtttttcttccatctttcacctactaattttaacattaatggtagatcttgtctgtaacaattattaatcttgtgtttgctttatgtgattttgttatgttcttcattccttctacatttattaattgggattcttttaaaggaggtggttcttctcccccatttgtttggttatttaattatataatttacatcagtgtggacacatagctgtttatttattttaggggttataatccctaaatagtatcattatgtattttgttgtcaaattatttcagcttctgccattgagaatgcttttcaggccggtttcaatatccattcaacatgtcccccattttttctagcactttcttactccttgccatcacaagatattccagattcattttgtatttttcctgcccagtcttctctgattttattctaatgggatagattaattctagtcttctgcctttccttgtttctaatttttttcaaacaatgaaaaattaagctctcattatctacaatatgtttacttatttgttcaatcccggtacacacatcaagtagttacaaagttgctaaaccttgtctctgtaaaaacagatcgactgatcatagtaatgtaatagagtacagtatattcaaaatatttttactaagtgctaatatatttaaagtaatagtttgttattttcttcccaccccattcagtgtggtgatgtcattcatttataatatagctagcttcattttttactatttgtattccactccatgtccacctgatatcctggtttattttgatttttttaagttttggggggatatgtgaaaatcactatggttctaagatgcaaaactattttttagaagtgacacccagaaaggtgttgttccctgtagctccttccctccgtgttcccattacacccttttccctactcatttctcttccactccctgcagcttctgggctttccttcctgtatttcttttgcacaaaggagaagatacatatttattttcttatattcctttctttcttacacgaaaggtagctacagtagatactcatttacaatttgctttcttcaattaagagattatcctggaaaccactccaaatcagttcatagagaccttcctttcttttttacaactgcagattaccctgttgtgttgatttaacataacacagtcatgcactgcataatgatgttttcgttaactatgaactgcatatatgagagtggtactataagattataatggagctgaaaaatttctatcacctggtgacattgttgccattgaaatgtcatggcacaaagcattactcaagaagttgtgttgattctggtgtaaacaaacctactgtgaggccatttgtataaatgggtagcacattcaattatgtacaatacataacccttgataataaacaactatgttactggtttatgtatttgctgtactatactctttctcattgttttagagtgtacttcttctacttatatattttaaaagaaggttaattgtaaaacagcctcaggcaagtcctccaggaggcattcctgaagaagacattgttattacaggatgagatgagagccccatgcatgatattgtcttgaagacttttctatgggacaaaatgtgaaggtggaaaacactgatattgatgattctgattctgtgagagccttggctaatgtatgtgttcacatcttcatttttaataacaaaattaaaatataaaaagcttagagagcggtgatataaggaaaaatatttttgtgtagctgtacggtgtgttagtattttaagctaggtattattacaaaagagtcataatgtttaaaaattgtttataagcaataaaagtgacagtaagctaaggttcatttattattgaagaaaaaactatttttaagtaaatttagtatagcataagtgtacagcgtttatcatgtttatagtagtgtacagtaatgcccttggcttcacattcactcaccactcacccactgactcacccacagcaactttcatcctacagctccattgatggtaagtgtcctatatatatgtgccattttttatcttttacactgtgtttttaccgtatcttttctattttcatgctctttagatgtacagataccattgtgttacagttggctacagtattgaatacagtaacattctgtacagatttgttccaatgggctatactatataatccatgtgtgtaataggctataccaataggtttaagtaggctatattaaagtaagccataccaatatgcttaagtatatatacttaagtaggctataccagtatatttaagtatgtatacttaagtaggctatagcaataggcttaagaggtctataccaataggtttaagtaggcaataccaataggtttaagtacacaagtatgatgtttgcacaatgatgaaatcacctaacaacccatttctcagaacatattcctgattacttgagtgatgcataactgtatattcaacaaaattcctttccattagcaataggttgtttccaatatttgtcaatgaaaaacaatattgcaaagtatatccttgtgtcatgtattttctaattgtttacaatatctttaagatagagtcttagaagttggactgatttctctccaaaagggttagaccagtttgtatttccaccaataatgctgggagtgtgtatgaatgagttaatgatgcttaaagacataaaagtagacttgagcaaatggaaaagacatactctgtttaaatctactggtatagctattactacagtgcctgttttcccacaatctcatgaacagaatgcaatgtcactaattttggttgatccgagaattgagaaacaatatcgcagtgttttaatttgcacttcactgattatgattgagttcacatattttaatatgttggggggctggctagactcagtggctcatgcctgtaatcccaggattttgagatgctgaggcaggcagatcacaaggtcaggagtttgagaccagcctggccaacatggtgaaaccccatctctactaaaaatacaaaaattagcccggtgtggtggcatgcacctgcaatcccagctactcgggaggctgaggcaggataattgcttgaacctgggagtgccactgcactccagcctgggcaacagagcaagactctgtttgtataccttttgtagaaattttcagtttgtttgtttttccagtttttatgtttttgatgcgttttttgcaatttttaagaattcttgataaatcgtggatattagccttttgtctgtggttgtgaatattttctcccagtttttcagatttattttaactttgcagattttatcctgcagatttttatattttgtatgtagtcaaatttatgaattttttatttcattgcttctgaattttgatttgtatttagaaagcctgtttttaatccagttcatattcattcatattttctggtacttgtgttgtttcatttttgcatttagatctctaatttgtttggagtttattttagtgtatactatcagatatgaacctaattttatctttttttcaatggctagccagtagttctagcaccgtttatgaaaaagtttatcttcaccctaagggtttgagatgccacctttaacatgtgccaagtttcagtatatacaaggactgtttctgcattctatttttttttggattatttttctatttatatgccagtacaacaggctagtatcagagacttcatagtatatttgaaagtatagtagtgtttattccttttatagtttttctttttagtgtttttctggctattttttcatgttgccttttaaaataaactttagatcaacctaacttcataaaatagcttgctggaggttttattggaatttcatcaagtttacaatttaccttagaactgagatctttataatgttgagttgtgttagacaaaaacaggatatgtcttttccatttgctcaagtctacttttatgtttttaagaagcattaaaaattccttaaattaatatattaattcctaaatattaattcctaagtacttaatcttctttattgacattatataaaggatttctctatcattacactctttattcatttattagtatattgaagctacttatttttatatgttaatgtgcatcaagctacttactgcttctttaattgagtttgctttaacattgattttataggggtttcatagtatactgtcatatcatctggaaacagatatcgtttttgcttcttctttaccgattcttgtgccactaattaatatcagttatctaattatatcggctagtatttcaagtacattgctgaatatccataaataatggccaagcttacctttgtcccaattttagtggaaatacttcttctcttttctcactaaagaagatacaggtcttggactaacatatatatgtgtgcgtgtgtgtgtatatatatatacacacatatatattgcttctggaatatgtgtgtgtgtgtgtatgtgtatatatatgtgtgtatatatatatgtatatatatatatatacacacacacacacacacacacacaaatatgtattagtccaaaagctgtatcttctttagtataggttttaaagtattcctccattcctatgttcttcaatatttttgtatcataaatggttgtttaattttgttgaagattttttcagcatctatagagatagtcataattttcacctttagttttctaatataatgtatgacagtaagaaatgtttttacattcctgagataaatcccatttagtcacagtgcattatttttaaaacatatcattgaattctgtttgttaatcttttatgtggaattatttatgagtgatagtggtattttgttttcttccttacaatgtctttatttttagatatcactattatacttgtttcatagaaggaattatgaaattttaattccttttcagggcattggaataatttttagactcttcaggctatatggttgttgaaattagttaaaaatctcctgtgaaaccatctgggcctgttgcttttttgtaaagtaattctttgatagctctctttgtttttatgcattgatctgctaagatttataatggaagttgagtcaatttggtaatatctgtttccctagggaaactatctagcttttcaattgtatttgactagagctctgagaagcagtcctccgggggcgtgtgcatgtgtatgttttaatttctttactttcaaagattatttcctttttgtcatttcttattttgaatgtttatatgttattgctgcattttcttgattaagttaactagtagtttttctctcatttgttttccttaaaaataggataatatattagatatagtttttcaattatcttattctcaaatcattttcttcttttatttttattatttccttcattatgatgctttgtttttgtttccttttttgttctttcttaaagctttttgagaagggaatttaattcattgccttttattatttctttgtgattaataaagcctgacttttcttcgtaattaattaatcttcgtaaggattttgttaaagatgcagatggatgggccccacccatgtatggagacttagtttcagtaggcctaggtgtgacctgaggaccagaagcagaatatctagaactacactggagaaccgctgatgcaatattaaaattttacaaatgttcctctcaaggaatgtttaattccttatccaatcattttgttattcagatgcattcaaacatgttatggtgttttgctggtaggtgtcctccttctagacctgtggtattttgacttaataatcgtgactcatattcgaccatttaaaacttgcttaggttgacaataggcaataccaagagtctcccttagataaaatatcacagtttcctaaatctgtcgctcttatcttctaaggcaacagaggtcagaggagctatactaaaatcttaactaacaaacattttaaaatacaactgaagaatgtaatttgtaacaaatttgttcacaataatttttaaaaatccctttgtatgtacactaagtaactgaacattttagaaagactatcagtgatgagaaaaatacaaataacatgaaaataaattatttggaaaattatgctacaaaactataaccactgaactcattcaagcatcaaaaatattagttagaagccttgctctaatgttttggaggtttcccaagactttcaaactactaatctcacttcttaatataaggtagagcaagattctgaaaagtctttgagtttttagttttgctaaagctgttgtttcaactgagcctaggttatacaattgttaggctgaggtctcatcaaataactgaacaaatggactaatgaaagcacctcatatctataattatccacagaacacaaaggaaaagaatgggtaatttcactgtctatattacattgggctggtacttttgttgtgaagctggaatattgaagatgcagtgtaataattcagaggttatttatatatcctttaagactgatactatctgtacattgcacattggcatttatttctacagatttattttggtgtagctggtatgggagccataaagtaccagtgttcatttttccagggatgaaatcagaagagtgttagagaatggtcttcttcctcaagctatcagtgtgaatctctgagataactagagtctgaaaaagaagttcaaatctgtcttaatttttcaggccaggatttctctacaaaactaatcttcaatttagatagatatatgacccttgattttctttcataatgtttataaacgtagagcctcttttgtaattttttcagaactcctcaccttatgctattggggacaaagcaaaagtcaggaaaattagactaatttggaaaatgaccacgttactattgctctggagtaggacacagttggagtttatcaccaagtcattttatgtcccctagtaatgttcccatctcccaaatcctctgctaatattcctgtatctttcagagaagagagaagcaactctatagaagaattatcagcaaaattgctctatgcaacgaaagtatcttaatccactgaaagtaaagcaaatcttgtcagtttctactttgatttagaagattaaaaaaaacaaacaaagttatacataacagatattaatgttaatgaaaggaagaattacaagctctttctgtaatttggaatgatatgaaatgtctgaccattattttgttataattctttactataaataagactaaaggaggatcaaaaaatttttcacttaagaagtaatcatacatttctataaatatttaaatatcaattaaagtacaggtgttttgctattcaacagatgccttataaggacatatacaacacaactgcattcatttcagggttttgaatgtgtcaaaaatgtcctggtaccttgctcagtagttacaactagtaaactgattttcacaaagatctgagtcaaggttgttgttaccagatccttgttcaaagacaccagatactgtagttataatatattatacacatttcagcagtcttttaatttaagaaactattttgagctgtacttagtgcaaagggcaagcgatagtgactgttacattgtttcttttagaaacaaacattgtaggcaggaacacactaaatacaattttaagcaatactggaactaaatttggtcatgtataattatttttgaaacattaggttggttagttgatgttctagatttacaataagcagtgtctattagagagagtttcagggttttttattttactgtggagggaaaagaaaatttgggggtgcctaagtcctgctatgatcataattagttgtgtgattgtaatcataattttgagaatagtaatatatcagttaccacgtattccatatttacttgtggccaggcatgttgctgtatactttagattgatgatgatgggattgaaaaaccaaaactagtattatcttagacatttttcacatgcagaaaccagtttcaaaaaattaggtaacatccaaggttaaacttctacataatttaaatttatttctaataatgacttcctttctttgttaagctaagtttttgaaaatctgctttgatcatgcaatgtaattgtgctgtaatatggcagggtagagtcaattctttggtctttctggataatagtaagaaaattactctaaacagggacatctttggactctatcactgagtccagtgtaattgggagcaacttggtaatgggctttgattgtacctcgttttctacattgctataatgaacaggactgtgtatttgatgagagtcacaatggtatgatgagattggaaaacatgatattacagatgctgtcatatgcaaaccatggcagaagtacttagtgaacaatgactgtaagcattttatgttgcctttcattgaaaatgttttataagaaaaaatttttgcattccatgaagtgatgatggaataattacattttcgatgacaaaattgcgcagcaaatacatcgcataaaagctaaagagatgactataaaattgagtaaagatgccaccttctctacatttgtatatgtatgagtaccttctccaatgttctctttttgtctaattgaactgtgggaaagtgtaaatatccactgagttgagtcaatattaatgtggttcctagtttctatttttcatttgaactcaagttattgagaggatgatgttaaagtctctaactcatagctttgactttaaaataactaaaaaaattgtatatgctctaactgtattgagtaccaactctgctatatactctgcttgagacttgaggacagaaataaatgatttcatatattggttgagatatacaagtatataattgattatccaagtttttttacatgaagtgtatggtctataaataggtttcaaggcattcacagaaccctaaaattgtatgcaaatcactttctgtctatggatgtgaacattttcataggcaaggtgttcatggatttcatcagcttttttagattctcaaaaggttcattatgttaacaaagttagaagttattaaacctctttctccttggcaatggaaataacctagtttgaggggtatatgttttcatatgtgatgaaattttggttcagaagtttcgtgacttgcctaaggtcaagtaattgtttaatgacagatctagaataagaatagtaagttgtcttgtcacctagtccaggcttgttacccaccatatagtttttatctcattgacattatctcattgtttcttcaaacgctagccatatagcctgaagcatttgttttctgcattttcctatactattaaatggaaacatcgccttttatgtgctttcatgtttaatagggaaaaattccaaattgcattagaaaaccaaatcgtaattcagtttttattttggctcattctttataagaagcaaatgacaaccagaattttccaatgtaatttcccaggggagacctagtctcagaacattgtttacccaaatcacagtatcttcgacatctaatgatcattgattatcacaatgataaatcacaaaagaaaaattccattgtatttactgtatgctctaccatctagggcaagggcataaagaaatgattttggatacttcaacagaattgggacaagatattcttgttaagcctctacataggtattattgtaaacctgaggagtccattctccatgcattcaagtcataggtgctctggttttcctttctttctttttggttttttttttttttttttttttttttttttaatcactggggtttggtatctctatggaaataattaaaaactctcaggaaaatggcacttctctgctctcagttcaaatgatagtaagtcagtgcattcttatatgacttcagaagctcacttttaacaatgcatgtgtgtatatatgtgtgtgtatgtgtgtgtgtgggtatacacttgaaggttgattaactcatttataattcatatatgaacacagtaccaaagcgtttacttatttttaattaaaaattggaaggcatgatcttctcacaaaagggaatgtatcactcctattttttcattaggagaggaaaattcatgctacactttatgtgtttatctaacattttgtaattctggggctgaaaaatagaaggaaattaggtcagggttagcctttataaaagacacttttactctgacataccactgggtggagtacattgctagcccagagactaatattactctattgaaaggtaagaatttctgtgccagaagaaactcctgatcagttttgaggttttatgtattgcttctaaaatctggacatgtttaacaatggctaagtgactagaatataataccaacattgactatgctctggcattataactttcaagtttcagtccatcatccctacacctttgggagatatgcctagaagactctgagagaattatgtggatgaaggccattttatattctagtcaaaagagcaactgcagtttggtctgaattagtgttttaactctacatggaaaggcataaagcttctttttgataatgaaatcaaactgtacccaggtattgaatttgactttttatttcatgttgctttgatatagcttattttggagctgagcctaatcttataataaaatgagcttctctacgatgccctgtgggactattattgtccatagcatttgcctgaatttggccttcaggactttatgaatgagaataatttcctagtaggcattagctctatattattttcagtttccccccattcccctctcctctctttaattttttctctctaagtgctgggaaaaggaactctactaatcaaatctaaaaatctccaaccttagaaatttattgtgctttaaattttataatctaataaaattgagtcatttttacagaactatttaggatctataattctaaatatatgtctttatatttcaagtaaagattatgttatatgaaagaaagaattctcacattgatcattcttttgccttgtttcttttattcctttaatttcattttcctgctcacagcacccctttattttttcttagcttccagctctcaaacctcgccctatagcttttatgcttctaaacttcccctcctgccccatttccattctaaatggagttctctttcatctttttttttaacaacctcatattctgcactttacttaatttttcttcccaacgctattaaagattctttatttctcccttcacccaagtatagcatctcatctatttctctatactgaagatgtggtttacccaggggaggaagtttctcatgcacactgctcagtgctgggatgatttcagtggtgccagcatattttaaccacatcattatcatgtagtcccaaagccttgctcactgaaaacaccatctttaaaaggatttagtttccattaatcaatttcagaacttgaaattcaagcacggaaagcatttattagaatgttccctacttgttcccacattcatttcattctcttgactatccaagaaaaaggaattgtgcaaaggtcttttctctctccgtgcttacctctcctttctataacccaccgagccccccaagtctattctttcatacagtagttaaatcagagcatgcggcaggaaggcattgtgtgaactggtggccacacaagtactttgtattcactagaggtttagaagtacagcagctgcatataaatatgcatagttgagagattcatgatggtgcctcctcattctagtgctggttggctgcagtgcaggcactacaaatcaatgaacattttccccatccatcagctgctcgcttgcaagcagacaaaacacttacaatgccagaaacccacagagagctccttagtgaacgaaacctcactgtcacaagattcaaaatagccttctccctcccaccctcaacctccacagctctcgacctcaaatgtcttttttttgttaatccaacgtggatcgcaagtacttaaaaaatgatgccaggaaagaaactggaaaaacaggagcaatgatagatcagagttttgagggtcctcacatcacacttgtcacaaaacaaaggcttctttgagatttaacccttttagaaaataaaacccatcataaagatgaatctgcttatgttgactgtactgctttacaattgtagggtttgagcgttgaagcatttaagtatgcaaagcattatgccaagctgtgtcagacatttgtaatttatctatagttactagatggctttgggtattgaaggaattatgattgatgatatgagaagaataaatcatagatatatttaacagtagaaatcatatttctctctttgagcaattttttgcagagaactcagatgtatttatattgtgacaattcatgtagaaactttaataaagcttaacgtcacttaataaaatttcatatgcaatatattagtgaatcaaatgtatatttcttggtgaaaagatatacattcattacatcttgagaacaagtctatttctcatttttagataaacattggtaataaaaatagtttattcttgtgtagcatgagctattaaacaatttacagtgctttatctgacaacttgccaacccatcttccaataacaataataataaatataatttttcattcatttaggttttcactactttgtaaatacacaccatagcaccatgatgctatgtgatacatactatatgataatatctgtagtccctgtttttaagatgtgaatgttctgattggggatataggaaatacagttacaaaatgaccacgtgactttcaagtgttaggaaagtctagttcagtgttcagtacgttgaagatagtaaatattttttaaatgtatgacatttatttaaaacttatctatccagttaatatgttttgttaccatgttaaagcaaggataaaaacaaatataggcaagataattataattatacttaactgtggctcagagaagctgacagacatgtccaaattttatttgcatgtgtgcagcaaaaccaaaatttgaactcctgtctgcttaacttcagagctcatccattcacttctactaagccatgtagaattacaaggcagaatgtgataattgctctagtggatcagaagaggtaaagatcgcttccagcagggaggaccaaagaagacatcattaagaaggagtagcatttgagcaagcctttgaagaatgggcacaggaacagaggaaaaactgcagacaggggttagcattggtgaaaccttatgactctggaaaatgagttgccaggcagatgaaggacaccactttgaatgaagtggatgccgtaaataacactactatttaaagaatcgccagacggacttcttagttattagaaatggaatgcaaaaatagacttatatttcaggtttcaaatgaaagtcagttaaactctctggacctcggtttctttgtttctaaagtgaggacttgaacctaaaaaccactgaagactcctcttaggaggtccattttgcaatactttcattttcattttttttcggaatataaaaatgttagtagtagtgaattcaatgtgtagtaattatataacctgtatatatgtaattcgtcttaaaacaaaaagtatacctatgtatttacatattcttttaaaacaaaaagtatacctatgtatttacatattcatatctctatatacaaacaagatatttgcatttgactggcttatataagctctcaacttcatttcaagaaggctttttttttggccgtgtatttatctctagtttgcttcttagtgtttgagtgcaaactgattcttataataatttagtcaatacataataagaaagtatacatgtactaagcaagtgataaagacaagatttggggattatgtgctctctcatgatatctgtatatttcaacctttggaggggatgtggagactgaaatattatatattaattcatcaatataatggcaaatttttgtgatgttcaaatgctcttgagtagattcacaaattccacttttctatcctgtaacccatgcagaagtcaaagtaagattttggcaatgtttatgaaatgaatgtgcgtgtgtgtgtatgtgtgtatacacttgaatgtatatatacatatacatatatgttcaagtatatcaaatacatatacatatatacattcaaatatatatgtatttgagacatatatatatcaaatcaatataatgtgtatgtgtgtacatgcttgcacatatatagacaatttgaggaaccataagaacgtaaaagattaatacaataatgcttatttttttcctgacttcaaagcatttttttccattagtactttttctctctaatttccctttccaaataagaaaagagaacccgaaaaacaggagtattttgtttgaattcatggtgagaagaaaaccaaacattgtttttttccataatttttgcaaaggtttctaagggattttagtggggacctcttccttgaatagaattgcccaggatggaattccatcctgccattgttgctgccaaacccattcaggggaacttgatgttgtgagagttccagactctttcattttccatcttacactgtctctcatgtcctaaaatagtatgttttggcaaaaactgatttggattccaatgtatttggaattgatctttggatttggattccaatatgtttggaatttattaggtttgttttaatgatttgaatgaaattgaacctcgttggtagcaaacaatgcagtgctttgatcatattaattctgaggctgatcttaagtagggatagtttaagctcattttggttaaatcagttcatggtcaaattaactaatcttcttaacaaatatttacagagcactaactatattcattagtgttgagtgttgttaagatgaacggaaatataaaaaggtttccaaccttcatggtttgtattttatgttgagaaataagattaaatctttgaaaagttaaccaatttaaggtcttacatacataaatactaaatgagtgttagagtgtacaagttctttggaaattcaaagacctggaatttgtgtgaaccctctgattttgttaactaggtagtaccagcaccgctttctaatgggagaaaagtctcaagatgaatttgccctcaggtacattctgagcagatggaagttgaaaagcaatgaaagtaaatgaaaaaattgaactattttcacttaataaagagaagataaaactggagcaatagggaaattgcggtaaattttactattacaacaagaaaatccttcccttcagaagacaccagtgcaacaatataggctgatcttaagttagaagcatttaatttcatataggcatttctgctgggaagactgggtataagtccattttcatgctgctgataaagacatacccgatactgacaatttacaaaagcatgaggtttaatagacttacaattccacatggctggggaggcctcacaatcatggcagaaggcaagaaggagcaagtcacatcttatatggatggtggcaggcaaagagagagcttgtacaggaaaactcctgtttttaaaaccatcagatctcatgagactcattcgctatcacgagaacagcacaggaaagacccaccccataattcaatcacctcccggttactcccgtaacaggtgggaattgtgggagttacaattcaagatgaaatttgggtggggacaaagccaaaccaaatcagccagaattacctttaaagaggatattgatttacttgaaataaaattaccaagtttatatcatgtaagaattaagagcaaatattcatttgtaatcctaaaaatcagtcacagaattgaatgcttatatttcaagaaaaatgaatattaataaatatcaagatagtaaaaaaatcttaagtccagaacttgaataaaatgttaacccaatgacccttaaatattccttttttttaaggtactatatataaaatataataaaaatgatctggttgagaaatattggtctggaaaattaagatagattaaaacttctttcccagcctctagttattgcaaagattcaccctgattgcctgaggaagaacattctctcacactatggctagaagagaagtgaaaggaaattaaaaataattacaaaatcaatcactaggaaagatttaattgtggacaaaataatgagaaaataacacaaattaatgattagaaggtaattggtgagttttaatgttttattgggctctggattctaaaccttttctaaaacctaagtcaattgaactggttgaagaacaaatgccttaagataaaaacaatttttatatttaaaacctaccattgatttcacaataaagtgccatatagcaggaatatgattagctaaacaaacatatattggctgaaaaaagttaattttgatcaaattttgatcattctgttgtcagtgtccatgctctgcatactcagccttcaaatgaaatgttgatcatctccaaaatttaggtaacaggacaccatctgatgtggtttgagtttgcattcccacctaaatcttatatttaattgtgatcctcagtgttggaggagggccctgctgggaggtgactgcatcgtgggggtagtttccaatggttcagcagcatccccctagtggctgctcatttagaagtgtgtggcacttccccatttactctgtctcttcctcctgcttcagtcacgtaggatgtgccagcttcttcttcatcttcctccatgattgtaagtttcctgaggcctccacagacaggcttcctgtacagcctgtggaatgctgagccaattgaacctcttttcttcataacttacccagtcttaggtagttctttatagcaatatgagcacggactaatacaccatctaacctatagaatgattcatttgtttcttcataggctacttggatctaggtgataatttggaatgctattcatctctgatttgaaaatgatttgggttgcttgtaattggtcatttcctaactcacttacttcctggttctcatgcacaaagccaagaaatatccatctatgtagtcagagtaattctttgggtcttagaatcagacttaaaaatcaatgagaatagacttatagatatttacaatcctatttgcaagtctccatcattttataggtaaaacctaaattcttccttttaaaatttcatatagttcctttttattctgttcttaatggagaatatattatatatgtttaagtaaatccgatgcttttcttttttccatcaaagaagtccaaaattcatcttttttgtctttgttgatttctgtttcccaagttctcagaatgcagcttaaatgaaaagcaccaagaaaggatgatttaacagcttagacaaatttgtatttaagagcagatgaatctgggaggggttggattccttagaacaggagttcttgtgggagtatttgtagggtgggtgaggtgctgcagcagaaataggatgaatattttcaagaagctgtccaaccctctcttcctgccctttatagccaaccaaaaagtgaaagattacttcctcaggtaatgtgctctgactccatagactaggccatgtctccccgttaaagcgctcacagctccctgtatgacatttctcaatgatgcctacattatgtttcattctcctttactgacagggaaagtattaattggtatgtgggttaaacacggtaaaaaataatgatgatagtgattacatttgtgaaaaatcttaaagcatattatggatcagcgaaacaccaatatattagaatctctctctttctctatttgtatctctagctctttaaatgattgtattataagcagttcaccctttctgtgattactagaaatacagcttccccttcaccaggaaggaaaatatgttctgctgcacagacacacacacacacacacacacacacacacacacacacacacacgcattttgccagtggattctcccacaaggacaagtgtagctgactacatttcagggaattacatggggagagtaagtgaggaagtgaaagaagggaagaggggacacgtagctgtgtgttcatctagacccacctaaagttccattttatcattcgaaaaaaaagggtgtggctaagagatgggcataattaataaactgttttagtcttttggccattttaaatgaaacaattcatgtaatatttaatattcttgttattgaaattatattactgtatgtttttatatagttcttacaattgtaatatgtttctaaatagcttgtgtaatattgactaaattcaattattttaagtccaccttttaaaaacatgctatttgttttgttttatcttggtgtaccactgatgttgtttggctctgtgttcccatccaaatctcatcttgtaactcccctaattcccacatgttgtgggaagaactcagtaggagatgactgaatcataggagtgggtctttcccgtgcttttcttgtgatagtcaatgggcttcaggacatctgatggctttaaacatgggagtttgcctgcacaagctctctttttgcttgccaccatccacataagctgtgacttgctcctctgtgccttccaccatgattgtgaggcttccccagtgatgtggagctgtgagttctccattaaacctctttcttttgtaaattgcccagtcttgggtatgtctttatcatcagcatgaaaatggactaatacagtaaactagtaccagtagagtggggagttgctgaaaagataccagaaaatgtggatgtgactttggaactaagtaacaggcaaaggttggaacagtttagagagatgagaagaagacaggaaaatgtaggaaagtttggaactcctagagacttgttgaatagctttgaccaaaatactgataatagtatggtcaatgaaatccaggctgaagtggtctcagatggagatgaggaatgtgttgggaactggaacaaaggtgacacttgttatgttgtagcgaagagactggcagcattttgcccctgccctagagatttgtggaactttgaacttgagagagatgatttagggtatctggcagaagaaatttctaagcagcaaaggattcaagaggtgactagagtgctattaaaggcaatcagttttataagggaagaagagcataaaactggaaaatttgaagcctgacaatgcgatggaaaagaaaatcccatgtttttgaggagaaattcaagttagctgcagaaatttgcataagtaatgaggacccaaatgttaatccccaagacaatggggaaaatatctccaaggcatgtcagaggtcttcatggcagcccctcccatcacaggcctggaggcctaggaggaaaaagtggtttcatgggtcttgcccagggtccctgtgctgtgtgcagcctagggactttatgccactctagctaaaatgggccaaggtacagctcaggctgttgcttcagctggtggaagccccaagccttggcagcttccatgtggttttgatcctgcgtgtgtggagaagtcaagaattgaggtttgggaacttccaccttgatttcagaagatgtatggaaatgcctggatgcccaggaagtttgctgcaagggcagggccctcatggagaatctctgctagggcagtgaggaagggaaatgtggggttggagcccccacacagagtccctactggggcactgcctaatggagctgtgagaagagggccaccatcctccagaccccagaatcgtagatccactgacagcttgcactgtgtgcctggaaaagccacagacactcaacaccagcttgtgaaagcagccaggagggaggctgtaccctgcaaagccacaggggcagagctctccaagactatgggaacctaggtcttgcatcagtgtgacatggatgtgagtcatggagtcaagggagatcattttggagctttaagatttgactaccatgctagattttggactcacatgggacccgtagcccctttattttggccaatttctcccatttggaacagctgtatttacccaaagcctgtacccccattgtatctaggaggtaaataacttccttttgattttacaggctcataggtggaagggacttgccttgtctcagatgagactttggactgtggacttttcagttaatgctgaatgagtagagagtttgggagactgtttggaaggcatgattggttttgaaatgtgaagatatgagatttgggaagggccaggggcagaatgatatagtttggttctgtgttcccacccaaatcttattttgtaactcccataattcccatgtgttacgggagggacctggtgggagatgattgaatcatggaggcaggtctttccaatgctgttcttgtgataatgaatgggtctcatgagatctaatggctttaaaaacaggagtttgcccgcacaacctctctttgcctgccaccatccatgtaagatatgacttgctccttgccttccaccatgagtgtgaggcttcccagtcacatggaactgtgagttctccattaaacctctttcctttgtaaattgcccagtcttgggcatgtctttatcagcagcatgaaaatggactaatacagccacccatttgacttttgcttaactgggaaacctggaaggttacaaactgaaattttagaaacagtagctgaaacctcgcagaggtgctcctaggatctctttcagtttcctaccagaaaagtgggaaattcataccaatctgttgcccaacttgtagctcttctagtccagatgaagaaaagtttcattcgtctgtggatgaagaaacttgaggaataattctatctacatcaagactttttttataataaattaagaatgggagctgtgattctgtgggtaagcaatccttgctcccatgcaggacactaatttttacctacatttgcacatcagagctgcctagagagcctttgtgaaatgcatgtgccctggacctaatcctggatgcttctgtaggcctggagaggggctgtgccatgtgcatttttacaggacttggaggtcatgctgatgtattttctggatcagtaacaacaaaccagggctttcttctcacagtcatgctgtaagacccactaatatttgaaggattcattgttggacaaaatgtccagagaccccattctctagaaaagtgacctgcttccctgtgagctttggatgtagattgacttagcttggcctgcctgtcttcatatttttacctatgattcagatgttaaaaaaaattaaagccctaaatttcttgcccatgtttaaataatatttcaaaggtaatttttataacataaaatatctccaacttctagttcaaaatattttgaaagattattgtttaagtaatacatattaacataccctgtatgcttctttgagaaataatttagagagtattttctaaaggcaataataagaaaaccaatagtcataaataaataaatagtaaacacataataatcataggcatacagcattttcatatctggtgtctaacccacttgactataggtaccttgaagctcataaatattttcattaacatatgatgtatcggctgcgtatttaaaatggcatagaaatgaactattttcaaattaatattttattcatacaaggaacagaccatagcctttcttttatttattccataaacatgagaaaaatgtttttcttcttgcttatatagacactgtattagaatacattctaatatatattatgtgtatatgtgtgtatgtatgtatgtaagatgctattgaaatgactcccatatctatgttcacctgaaaagctcttaattgtgaaacccaaggggcatatgtagtctttactttattggacttcttcgacgtgtttgacttggtctgccaccctgtttgaaattcccatggcttctgtgagtctctccactcttttccttctaatctttcatcattgctcctctctgtcttcttcaagggctgctttctcctatgaacgatttattatttatcattctgggattccttatcccctcattctgaatacaggttttagctgagcaaatcaattccgtcatttcaactcttgctagtatgctgctatttctcccaatttttgtctccaacaaaatgacttcgtacctgagccacatggccatttcctctaggtagctctactagtatatcttaaatctcaaagccatacctcagcattttcttcttcaagtttatggttactcttatgctggctctcctaggtgatgacttcagaatgagccaatttaccaagctgatatttaggagtcatctatgactcctccttaagcctcattacccatatctgactttttccaatatagcttcctaaatatttcttgaaaatttccctcctctccctgtgtatttccactgccttgtttaggactctcatcatctgccttctgagctactacaaaggcctcttatttttttctccattccaactcttgccttttctataatctatattaaagaaaaatcttggcatagtaattcaaacatacactgaaagtccaccatccctgtatggcaaaaatagcacatatagcatcaatgtcatgactccctatttttgtatctatgaaaaatattactaattaattaaaatattctattttgttgttttaatatttatttagaaagattctaaggaattctcaaaacagaagccacccaatcacatcatgtaagatttggcaaataagagtaaatgcatttgccatattgattaggataaaccccatagtgcagcactgtgtcatccatgatcttaccttggtccgattttcctgctttgtctccagccattccctgcatcatattctgtgaaacactttggtgacagcagtttcttgcttacaccatgctgtttcttctttccgggcttttacttatattgctccctttgtttggaggctttctccttacactcctacctttttgccaatgccaattccaattaatttttacctgtgtcgaaaagagtcagcccagttctcacccttttcttgagtccagccaaagattatgactctagtccatattcctgtaataatctatgcatatctctatcaattcctgttattgttcttagtatatctatacttagtcatttttccacttatgtgtttgtttagcctactgatagacactgagaaacacaattttattagtctagcaattttcagacaacttatatagtaactagcacatcagcaagcactgtataagatgagtcaattaactttgaaagtattgctgcacatgtaaaatatcagatttatttaggagaggtatttatttgtcttttcctaaagcacagttcacaaacttctatcatgcactcttcaggcaatccagtcttcccttaatccacataattaatttacattgctaggctgctgtgggaatttaagttttaaactcctgtgtaaagcatagaaatactaaatacattttctgatgaaaatgatgtgttttaaaaaataagaatagttaaagactgtagagaaaaccagctttttttgggaaattgttcccaaacacctaaattctgttttcttttgtcatgaattattactatatattatatattaaagccatgtatactttatatttattttccttcccaatgtttaaaaaacacatattcactgtatatactattgattcaccacagagatatgctttggttttatatggttgagaaatatctaataaaagtgtttcaaaattgtttatactgtaattcatactacttttctggtcttcttagtcataaaccaaagacatgattcgcagatttaaaagtagatataatatctctatatgggtcgagcatggtggctcatgcctttaatctcagcattttgagaggcagagttggtagatcacttgaacccaggagttcaagaccagcctgggcaacatggtaaaaacccatctctacaaaagaatacaaaaaaagtagccaggcatggtgccatgtgcctatagtcccagctacttgggaggctgaggtgggaggattgcttgaacccgtgaggttgaggttacagttagccgcaattgcaccactgcactccagtctgggtgcttgtgtggcagagcaagacaccattccaaaaaagaaaaggcagaaaaaaacaaaacaactctatatgtcctggagaaatttgctgttaaaatttattcttatatatcaatatgttttagagtccttaggttctaaaacttttttctcagttttcttgaattttactcatttggtttttataaacctaaacagaaataattatatgctggtaaaaggatttccgtattgtccgagtctcaattatcaatcaaggtgtgtatatgtgcatgttgtgtatgtgtgagtacacattgtttgaaagaaatgtaagaagaaagaagccaaaagaaaaagggctcagtgtcaaaatataaatgctctgtaatgtgatccaataatatgaaaatttgagcaggaacttatatgagcaggatcccatatttttcatgaaattttttgagaatcatgagacagcaatttgaaatatttgtacttgattccctgaaacatcagtaaatagcacaaagtagtcttctcttaggtgcctgaatataatttggtgactactagatttagaaggtgttgaaataaatttttttgccttaaaatacgaaatactgtgtgaactggtctactcatagagatgaatggaaagctccccagaagtataataaaaaattatgcggaaaagtagtcatgtggtaaacagaaatagtaccttgttatccttgtttcaggttagccagacacatgaatttcatctgtaggaaaatggagaaaaaatatctggccatgggtttgactgattcctgttcttattaagtatgtatcttcatgtgagagagaagagacaggaatcatttcttatatattacagcttaattcactcatccactagtgtttcctgagcactttacacatgccaggaataataaacacagaattgaccacttttgtagagcttatagtctagtggcagaagaggcagattattcagtacccacacaaacaaaagtaaaatttttactgtcacaattgctgagaagtgcacagtaaacagtgaataatcagggtggtggggaaggcctgtctaaggaggaaacactttggttgaaatctggaggatgggtggacgttaaccaggcaacaaaaggaaagacagctgtgcagtaactttattacggatacacactttcttagaaagttaaaagctacatatacaaagcacatatgctgacttcagaccgttgttggtatttgcgtgggatagaggggaaagggaatgcattgggtgaaactttggttgtagtaagacatttattcagcttgcagcttacattctggaaagtcagccagataaacattttatcatttagcaaatacgtaacatagacagcaataaacgatacaaaaaatagtaaagcagaataagaaaatgaaaggttaggagtgatgtcgttttagattgactgttaaaggaagtcctttctgagaagttacctgaatgaagtgagatagtaaataatgagctaggttcttttagctttttttaagagatagagaaaaagataatgaaagcgagcatggcaaaatggtaatacctattctagatttcatacttacagcctatttttttttattatttttgactcttctgagcttttgcattttgaagtatttaaaaagtaattttataatgcatatgtttgtgaccacttggggccacattcagcctagatgagcgattgaggagtaggctaggactttgtgtagttgtgtttggttgagtccgcctcagccgcctattaggatggataatattgctatagacagagggaagctggtgtctgttaggtcctgaaagaatccagttcggcattgacaggtaagagttacatgtgagaggaaactaaagaattgggtaggcagtaagccagcaggtccttgtagattgttaagaagttcagtctcttttctaggagcaatgggaagatgttgaatggtttttcttgcaggggtaaaagtgatatgattggttttgcattgaagaatttaacattttccattcattcaagaaattttaagcttgcagctaccatttgtcaggttctgttccaaatatgtggacatatatttgtaaaaaaccagataggcctttacactcagaaaactcgaagtgcaaaggtaggtgaagtttttgctgtcatctatggatgaacttactagctaaatattttgagatctccttataagctgctttgcaccttcaacaacccatataattatcacctttgacaaagattgggcaaccatcttcattctaatgactgagaattttgataactcactagtttgttcattgtgagaaaaatctttttgtgtgtgtgtaaagtggtttcttatattgttttgtctgtttcctattgtatctgcaatggttatgtgattcttttccaagtttaaggattctaatattttaaggtcaagaaggcctgggccaaggacagaagagccacatgagttgcatgttcattactaaagccgagccaaaaaacacagtccttcagagtgtcattcgagaactggaattttcagcacttgccaaaaagagcatttaaaattcaagtattagtgataggtatccttttaatattttggaggtagtctgtatcttctgtacaagaaacgtgttctaagtgattagttattattggggacttggaagaagtgataaagatccattctcaatgaggaaacatgagcatagttaatgccatccagtttaaaagattggcttagtaatttcctttgagcagttccctccgatatttcccattcatttgacttcattctcctggagttttgtcattttccacaaaacttaattgatctatctttagagacaaatgaggtccattgtttgccgtggagacaatgtggatggtagtcaaatttgattattgactctttctctttagttacatagaaaatgggactaccaggttactctagtatctcagtggtttatcggacctaagttggtagcaactaaaattttatgtaagtacttcaaattgctccctatatttattgtaaaacaaaagcagttatcttaatatacggctcttctaacattcagtttatcatataatgaaaaaagatgttagtgctcagaccgtagtatctatcaatgaattctgaaaaagaagaaaaaagccagtaagtatttatgcttttcttaattaccagtttgataactgcaggcagataaatcttcttcgtttttatagccaagtaattaaatgtttttacaacaaatctggcgtgccaaataaagacaaaattgtttttaaaatttaaaagaaatgttagttttcaagggataatatataaatttaggagtcaatttagagcttaatattcctttgagtttatctttcattttacattactaaatttctttttagttataaatattagtatttatattttaaaattatatatttatacaataatatagatgtttgcttttaagataaccatgggtgatagaaacaacaaatcatatatatctttgcaaatgccagaacattagcagaattgtaccaagttgaattatatcaagtctagcactggtagaattacattgaggacaactttatgtgttcccaaattagaattgattaagttggtttgtttgatttttttgtgtaaagtggtttcttatattgtaaaggaagagttaaatgagcttatgagagataaagagtgaaaatgctaattttagaaaatgcaagaacttgattttcaattcttttatttgttattacaaaggttcaaccccaagggaaaaacaggattgagtgtctcattcggagaggctttgcctcacttttctgtttgaaaatggcggagctggggaactgggcttgagagtgacagggacccaggtcaaaactctgctgttctcctttacaatctttgtcatgttaggaagttacttaattctcttaagtatctgtttccttatctataaaatggaaataatacttacaagttttaactagtatatgtaagtgtcgttaagtgtccaaaactcagtgaagcttattatgctatgaaacttttccagtcctttctctaatcactgtgtttattttactttttaaattttttattcttaattttatgactatatagtagctatacatatttatggggtacataagatactttgataaaggaatataatgcataataatcacattagggtaaatgaggtgtctatcgcctcaagaatttatcatttgtgttacaaacattccaattatattattttagttatttttaaaggtacaataaatctgtgttaactataatcacacaattatgctatcaactactagatcttattcattctaactatatttttgtacccatgaaccagccccatattccccatcactgtgggtttgtttttagatatttacctatagtatttgatcagatatttaatttaatattttaaatagagatgggatctcactatgctgcccaaactcatctcaaactcctgggctcaaacaatcttcccactgtggccttccaaagtgctgagattacaggtgtgagccaccgtgctcccccatcagatattttgcaatcaagcatgtgttaaaaattttgcaaagtgtctgttgttatccatttcacagaaagatcagatggtgacataaaggagaatctcaggtccaaatgtccaaaatagcagaagcaaggtgataattgatagcctttaggaagcattatgacctcgtattttgttcttttccttcgtaatcttcctagttcttctaaaaatgtgatcccaacccctcacttccatatttgcctgtattatttcttttcatagcacttcaccaccattgatggtacatatttatttatcaatttattacttttggtagtatataacgtctgtaaagcaagagtttgttattttgtatgtagtcttctcttaataaaaattattaattattttgtattttccatgatataatttgggataatttttagaaatgaaatatcatacattccattaattgcggtcaaaagaaaatgcatttaaagaggatatatgcatgtgtgtttttcaacaagtaaggttaaacttactttgtaacgtataaaataaacatagctaaaaactatactaaaagtgtgattttaaaactgtgatttaaaaatacagcacattttacttaaatggagatttttgttctagaaagatattgaacatgacaatctgacaatctgtccttgggacactgtcactgctattctcagatcagctgacgagacctcagctgggcctctgcaagttgcttaagaacacttctagaaccatcctaatgggcatgttccaactgtcacttggaaaaaaatgatcacttgagatcaatctgtacagcaggtcttctggcagaaaaccagtcatatcattctctccaaaagaggctttgtggggaaaaggccttatcacattccttggacatgaagttactgttggaaccatgctcgtctcaaaccattctatcaccatgccaaaaagctgcagcttctgaaaggtcagaaatggccttataatgacttagaccatcttatgattgttaggaagtgaagatagttataatactataaaagctttgggtcttttaccctttcatgagcagaaactgtgtgttattaactaaaccacaacttcctgatataaatatcagagagaccaaagctaggagactaatattaactctaatcctatcctggacttggattcagagtgtagaattgggttattcaaattgtagaatattaaagagaaaatggagtgcacaaaaggctaagaggaaaaaatatatatttcttatgaacaaaaattcacaattgttgcatatgcattgttaataatgtggggaaatttatattttttaattaagctttattttttaacctggtgtttattcttctgcattaattaaatagaagaatatatgttttgaattttaaaatatactgctagtaggcattacttgatttgaatcatgaagaggagctgggaggtgaatctcaaaactgaaaaattggagcatttcaataatcctcatttttaaagtggcaatgccaagctttgcagaaaatcaaaagaaagcatgtgctgtgataataaaattagactttactcataaatattatagtgcacatcttaattcctttatgcatctgtaaaataagtggacttatctagacaatcaaaaagtttttaactcagttaacctacgaatgataatatatttaaaaatactgttttaataaacatgttaactataatttcctatgtattcattataaagagtatgtttgttttgtgtcaaaggtgcatagtatagacattgtaatattgtttatttgctcctatgcacttttgtaaaaatgctaaggtctattttgtccctattcttcaactgtgagcaacttgctttccttgtagaatatcaacttcttatgaccgcttatcctgatgaaaaagctaaagctttttgtaatgaaagatagaatacagttgcacgatattttaaattcttttgattgttcaaacgttgattttctaaactaggagattgttaattttttaaataggacattgttttgaagatacttttggttgcatcttcataaacaattctctcttcagtgaaagagaaagggagcagagaacaagaagagagtttctaagtaatttatataacaaactagtaatttgatttatctctttgtccttcaactgtctgcaaaatcttgccttccacattctgctaatcttgtcttaaattggtagtcacttacaccatgtatgtcactttgaaacttgcaggtgtgtttattttccatcatctttattttggagatagtgaaaaagccaaaaatctcacctccaattaagaaaaatattcttctaatgcattctaatgcattatgtgttttatgttctcaagtactcttttttttttttttttttaatttttaagacagagtctctctctgttgcccaggctggagtgcagtggcgcgatctcggctcactgcaagctccgcctcctgggttcacgccattctcctgcctcagcctcccgagtagctgggactacaggcgcccgccaccacgcccttctcaagtattcttagcttgagatgatggattagaagaatagatttcagtgtttaagcacatttgcttgtgcaaagcataattgtgtccacctgcagtagtgtgtgtatgtgcataaatttatatatctataaaataagaatgctgaactatactcacatgactgttcatagaaaaatgtagacacactttgtgctttaccaattactgctatttcaaaaaacacatttctttataattcattctgtgactttattcctcttaaatatggttgggtcaagttacttaaactttggcacaaaaaatgtttgtctcagcattcttttttaatgatttaggcagaattgaaaaactcgagtcataagatccagtgaatacacctcattattaaataatgctgtttcttgttacagctactagctgctctagctgggtaccctggctcgaactctcaaatcatttaaagcctacattttaaaaacagttttaaatctaatctcttttttatatctgatatgacttttaagcttactacattcatcctctgacattctgcaagggaaacatgaattaatcattgagtttgtccaacaaggaaagatgcatcttactgatactgtgagcttccagtgtggtacacacaagctgtttctgagattatagcacaagcaaacattcccacagctattgtgttgctgtttgctcagttcccagtctcttagaattccaggttgtgatagtacagcagtggaatctatgcttatgtagtgttgattctgttattgtactcactgcaaacctagaggttactatctgttaatagcaaaacaaacttggccaagggttattatgatgtatcttctgaaagcatttaccagaaacagtttgttaattgttacaaaaattgtattttatttcatagtcacaaatgtttatatatttttaaaaatatgaaatgtagccagagagaaaataataattccgttattgcttataatttgacagatcaatttagaatgaggaagcatattttaaagagcaaatggtacattttctttgtctgaagtctgcctagaaaacagattttatgtgacggactactgggtggcttctttcatatccagctagtagtgttattgactgattttgccagctctgcagctcatgtgctttttaacttaatttttgttcccgctttctctcattgatttgtaagcagcttaagatcagaatgctgtcatctaattcattggtatctccctccaaggaatggagttttattttatgttaaaatttttttctgggtacagagtaggtgtgtatatttatgtggtacatgagatgttttgatataagcatgcaatgtgaaataagcacatcatcaagaatggagtatctatcaccttcattgagctgcaaacaatccaattacactattattttaaaatgttattcttcaatatagtcaccatgttgtgttatcaaatagtagctcttattcattctttctattttttaaaaaatgtttttacccattcaccatccccgcctctacccacaatcccccactaccacttcccagcttctggtacctatcctttctactctctctgtccatgacttcagtctttttgatttttagatccccaaaacaactgagaacatgggtgtttgtctttctgtgcctggattatttcacttaacgatctccagtaccatccatgttgttgcaaatgacaggatatcattcttttttatagctgaataatactccattgtgtatatgtatatgtaccacattatctttatccattcatctgttgatagacacttatgtcgttttcaactcttagctattgtaaatagtgctgcaacaaacataggtgtgcagatagctcttcaatattctcatttcctttcttttaggtatataaccagcaatgaaattgctggatcatgtagtagctcaatttttgttttttgaggaaactccaaactgttctccatagtggttgtacaaatttacattccacccaacagtgtacaaggattctcttttgtccacatcctcgcaagcatttgttactgcctgtattttggacataagccattttaactgaggtgagatgatatctcattatagttttgatttgcatttctctgatgatgagtaatgttgagcaccttttcgtatgctgctttgccatttgtatgtcttcttttgagaaatgtctcttcaaaacttgcccatcttttgactggattattattttttttcctagagttgtgtgagttccttatatattccagttattaattccttatcacatgggtagtttgaaaatattttctcccattctctgtggattgtctcttcactttgttgattgtattctttactgggcagaatcttttaaacttggtgtgatcccatttgtccatgtttgctttggttgcctgtgcttgtggagtattgctcaagaagtctttgcctagacccatgttgtagagctttcccccatgttttcttgtagtactttcacagtttgaggtcttagacttaagtcttcaatccattttgatttgatttgagagagacaggggtctagttttgtttttgcatatggatatccagttttcacagcactatttattgaagagactgtctttttcccagtgtatgttcttggcacctttgtaaaaaaaaaaaaaaaaaaatgagttcactgtaggtgcgtggatttgtgcctgagttttctattctgttccactgttctatgtgtctgtttttatgccagtaccatgctgcttttgttaccatagctctgtagtataatttgaggtcaggtaatgtgattcctccagttttattctttttgcttaggatagctttggctattctcggtcttttgtggttccatattagtatgaggattgatttttttctatttctttgaagaatgtcatgggaattttgatagggattacactgaatctatagatttctttgggtagaatggacattttaacaatattgattttccaatccttgaacatggatttgttttttcattttttttttgatgtactcttcaacttctttcatcaatttatagttttcgttatagagatcttttacttgtttggttaagttagttcctgcatatttaattttatatatgattatcataaatgggattttttaaatatttccttttcagattgttcactgttggtatatagaaatgctactggtttttatatggtgattttgtatcctgcaactttactgaatttatcagttctaatagttttggggggagtctttagatttttccagatataagatcttatcatctgcaaacaaggataattttacttatcctccttttcaatttggatgagctttatatctttctcttgtttgattgctgtagcgaggatttacagtgcaatgttgaataacagtgatggcaatggtcattcttatatattcccaatcttagaggaaaaattttcagtatttcctcattcagtatgatactagttatgggtctgtcatatgtggcttttgttatgttgaggtatatttcttctatgcccagtttttttagggtttttattatgaagggatgctgaattttatcaaatgctttttcagcatcaattgaaataatcacatggtttttatccttcatactcttgataggatgtatcacattgattggtttgcatatgttgaaccatccttgcatcccagggattaatgagtgatttttgtaatatattgttataatgattgatttttgtaatgtgttgttgaattctgtttgttagtattttattgagaattttttcatcaatattcatcagcaatattggcttgtggttttctatttttgatgtgtctttgtctggttttcatatcaggataataccaccctcatacaatgtgtttggaagtattttctttgcttttattttttaaaatagtttgagtaagattggtataagttcttttttttaatttcaataggtttttggggaacagatagtgtttggttacattattaagttctttagtggtgattttttgatgcatccaacacccaagcagtgtaccatgtacccagtgtgtagtcttttatccttcatccttctcctaccattttccccaagttgccaaagtccattgtatcattcttatgcctttgcatccttatagctttgcatcccacttatgagtgagaacatacaatgtttggatttccattcctgaaatatttcgcttagaataatggtctccaattccctgtgaatgccattatttcattcttttttaatggctgagtagtattcaatggtgtgtgtatatatatatataaattgtggtatatatatacacaccacaattttttaatccattggtcgattaatgggcatttgtgctggttccaatttttgcaactgcaatttgtgctacgataaacttgtgtgtgcaaatatctttttcctgtaatcactacttttctgctgagtagatacccaatatgggattactgaatcaaatggtagttctactttagttctttaaggaatctccacactgttttccatagtggttgtactagttttcattttcatcagcagtgtaaaagtgctccctttccaccacattcatgccaacatctatttttttttattttttgattctgtgaagaatgatggtgttattttgaaggaaattgcgttaaatttgtagactgcttttgattctggccattcttgcaggagtgagatggtatcgcattgtgatttggatttgcatttccctgatcattagtgatgttgagcattttttcatatgtttgttggccatttgtatatcttctattgagaattgtctatttatgtccttagttcactttttaatgagattgtttgttttcttcttgctgatttgtttgagttccttgtagattctggatattagtcctgtgctggatgtatagcttgcaaagatgttctcgcactctgtggtttgtctgtttactctgccggatgtttctttgctatgcagaagcattttagtttaattaagttccatctatttttctttgtttttgctgcatttgcttttgggttcttggtcatgaagtgtttgcttaaaccaatatctagaagggtttttccaatgttaacttatagaatctttatggtttcagttcttagatttaagtccttgatctatcttgtgtttattgttgtacgaagtgagaaatgaggattcagtttcattcttctacaagtggcttgctaataattatcacagcatcatttctcaaatagagtgtcttttccatactttgtgtttttgtttgctttgtgaaaaatcagttggctgcaagtatttggctttatttctgggttctcttttctgttacattggtctatgtgcctatttttataccagtagcatgctgttttggtgactatggccttatagtatagtttgaagtcaggtaatgtgctatgccttcagatttgttatttttgcttagtcttgctttggctatgtgggctctattttggttccatatgaattttaagatttgtttttatagttctgtaaagaatgttggtgttattttgatgggaattgcattgaatttgtagagctttgggcagtgttgccattttcacaatattgattctaccaatgcatgagcatgggatgtgtttccctttatttgtgttgtctgtgaattcatccagcagtgttttgtagttttccttgtagaggtctttcacctctttggttaggtatactactaagtattttattttattttattttattttattttattttattttattttattttattttattttatttcatttcatttcattttatttgcagctatggtaaaaggtgttatttcttatttatttatttatttatttatttttttgagacagagtctcgctctgtcacccaggctggagtgcagtggtgcgatctcggctcactgcaagctccgcctcccgggttcacgccattctcttgcctcagcgtcccgagtagctgcgactacaggtgcccaccaccatgcctggctaattttttgtatttttagtagagatggggtttcaccatgttagccaggatggtcttatctcctgacctcatgatccacccaccttggcctcccaaggtgctgggattacaggcgtgagccactgcgcctggccaggggttgagttattgatttgattctcagcttggtcgattttggtgtatagaagagctactgatttgtgtacattaattttgtatctggagactttgctgaattctttcatcagttctaggaactttctggaggagtctttagggttttataggtaaacaattatatgatcagcaaacagtgacagtttgacttcctctttactgatttggatgccctttatttctttctcttgtctgattgctctggctaggactttcagtacgatgttgaagaggagtggtgagagtgggcatctttgtcttgtttcaattctcagagggaattctttcaactttcccccatgcagtattatgttggctgtgggtttgttacacatggcttttattacattatatgccagttttgctgagagtcttaatcataaaggatgttgggttttgtcaagtgctttttctgcatctattgagatgatcatgtgatttttgtttttaattctgtttatgtggtgtatcacatttactgacttgtgtatgttaaatcattcctgcattcctgatttgaaactcacttaattgtggtggattatctttttgaaatgttgttggatttggttagctagtattgtgttaatgattttaacatctatgttcatcagggacattgttctgtagttttcttttttggttatgtcctttcctggttttcgtatttgggtgatataggcttcatatgaatagaataatttagagaggattccctctttctgtatcttgtggaatagtgtcaatagatagtaccagttcttctttgaaagtctgatgtaattcagctgtgaatccaacaggtcctagacttttcttttgttgtcggcaatttttttttttttagcaccatttcaatcttgctgcttgttattggtctgttcagagtttctatttcttcctggtttaatcttggagggttgtatatttccaggaatgtacccatctcctttaggttttctagtttatgcatttaaaggtgttcatggtagccttgcatgatcttttgtatttctgtggtattggttgtaatatctcctgtttcatttctaattgagcttattttggatcttccctcttcttttcttggttaatctcactaatggtctatcaattttatttatatttttaaataaccagctttttgtttcatttattttttgtgattttttttgtttcagttttatttagttctgctctgatttttgctatttcttttcttctgctgggtttggttttggtttgttcttgtttctctagtttttcaaggtataaccttagattgtctatttgtgctctttcagacttattgatgtaggtatttaaagctgtgaactttcctcttagcactgcctttgccatatctcagaggttttgatatgttgtgtcactattattcaattcaaagaatttttaaatttaaatttccatcttgattttattgttgacccagtgatcattcaggagcaggttatttaatctccatgtatttccatggttttaaggtttccttctggagttgatttccaattttattccactgtggtctgagagcacctgatataatttcagttttcttaaatgtattgagacttgttttgtctcaattattatatggtctatcttggcgaatgttccatgcactgataaatagagtgtacattctgcagttgttgggtagaatgttctgtaaatttctgttaagtccgtttgttgtagagtatagttcaaatccattgtgtcttttttgactttctgtcttgatggcctgtctagtactgtcagtggagtattgaagtccctcactattgttgtgttgctgcctatctcatttcttaggtctagtagtagttttataaatttgggagccccagtgttaggtgcgtgtatatgtatatgctaggtgtgtgtgtgtgtatatatatgttatatatatgttatatatgttatatattatatatatgttatatatatgttatatatatgttttatatatatatgttaggtgcatatatgtatatatatgtgtatatatacaggattgtgatattttcctgttgcactagttctcttatcattatataatgtccctctttttctttttaattgctgttgctttaaagtttgttttgtctgatataagttttataaatttgggagccccaatgttaggtgcgtgcatatatatatatatatatatatatatatatatatatatatatatgttaggtgcacatatatatatatgtaatatatatatgttttatatatatatgttatatatgttatatatatgttttatatatatgttatatatatgttttatatatgtgttatatatatgttttatatatgtgttatatatatgttttatatatatatgttaggtgtgtatatgtatacgtatatatgtatacatatacgtatatatacatatatatacacatatatataggattgtgatattttcctgttacactagtcctcttatcattatataatgtccttctttgtctttttaattgctattgctttaaagtttgttttgtctgatgtaagaatagctattcctgcttgtttttggtgtccacttgcatagaataactttttccacccctctacctaaagtttatgtgagtccttatgcattaggtgagtctcttgaagacagcacatacttagttggtgaattcttatccattctgtgattttgtgtcttttaagtggagcatttatgtcatttacactcaatgttagtattgagatgtgaggtacttttctttccatcatgctaattcttgcctgaatcctttgttttttcaactgtgtttttgtttcataggtcctgtgagatttatgttttaaggaggttctattttggtgtatttcaaggattcgtttcaagatttagagctccttttaacagttcttgtagtgctggctggcttggtactgtcaaattctctcagcaattgtttgaaaaagactattttttcttcctttatgaagcttagttttgctagatacaaaattcttggctgataattgttttgttttaggaggctgaagatggggctccaatcccttctagcttgtagggtttcttctcagaaaccctcttagatattggtcttaaagccttgcccttgtgagggtattttccagattctgtatgcatgctttattgttttctattcttttatcttttgtctcctctgactgtatttttaagtagcctgttcttcacactcacaaatttgttcttcttcttgatctattctgctattaatggactcatgcattcttcattatgccaaatgcatttttcagctcaagaatttatgcttctttttggttattttgatctctttgttaaatttttctgatataattttgaattgcttctctgtgttatcgtgaatttctttgagtttactcaacacagctattttgaattctctgtctgaaaggtcacatatgtctgtttctccaggattggtccctggtgccttatttagttcacctggtgacatcatgttttcctggatggtactgaagctagtagatgttcttcagtgcctgggcgttgaagagtcaggtatttattgtagtcttcagtgtctaggcttatttgtagctgtccagaattcttggggaggcttaccagatatttgaaagaacttgggtgttatgacctaaggcgtttctggtatagggagcatcccaagcccagtaactctgtggtgcttgcagactcacagaggtaccaacttgatggtcttggacaagatccgggagaattttctggattaccaggcaaaaactcttgttctctttccgtgctttctcccaaacatacagtctctctctctgttctgagccacctaaaactgggaatggagtgacacaagcacccctgtggccaccaccactgtgactgcactgagtcagatgtgaagacagcacaccgctaggtcttgcacgggcctgctgtaaccattccctggctactgcctatgttcactcaaggccccacaatcagcgggtggcaaaggcagccaagaatggtcaaggaaaggagttttaaatgaggtggatacagtaaatgttgatgacatagattattcaggcagaaatatgatgtttcatcaagcggatggaacttatcaagaagaaaatacataattctacttcctttacttctttccaatcttggaaattatgaagggttaaaaaacttaatgttgtgaaatgggtatgaggaagagagatggaaattttacccttagttctgccgtgaactagtgatgtgacgttgctttgcttctctgtaaagtgaggaagttgaaccagttgatttttaaattaccttctagttataagactaatgctgttttaatgaagggcatcataatttttaataataattctctacaccagataatagtctgttacatttctagaatgtaaaacttgggccacttaagctgaaaccttatgatcatgtccacataatggatttcaatctcagcacctatttttttaataatttaaaaagatgttattaaatctaaaagtcttagttttgtcattttgttattttttagctgttattttgttttattgtagcaatatggagtgatttttcttttttctttttacctttaccaactgtcaatttaaacattactaaattgactaatcgttttgaataacaatgagtcttttttttttttttttaaattttgagatggagtcttgctctgtcacccatgctggagtgcagtggcatgatctcaactcactgccacctctgcctcctgggctcaagtgatcctcccacttcagtctcctgagtagctgaggtgccaccaccatgcctggctaatttttgtatttttgatagagatggggtttcaccatgttgcccaggctggccttgagctccggagctcaagcaatcaacctgcctcagcctctcaacatgctgggattacaagcatgagccaccacgccccaccaagagttttaatcattacattcatgctctacagagcacaaacatgctcatgcttttattctaatgctcatgtgccctttgtcactatcagtgttgccagtctcatgtatgtatgagaaggaacagagaatgccttgccacagtgtatcgttaccaaatacaccactaacactcactgtgtataataatgttaaagcagttagctatttttttaaattctctatttcatctattttctgtttcttttccaggacatccataaaaattcatcagagagcattttactactgagctgcaaaggtaggaaaaataaattttttttggttagaaaatatacttctttcatctgcgtttcaataatttattccccttgttagatatacatggaattgatattgcttattctgactaagtgaaaagtgttatttctacttactgctcaattagaaacatgtagtgtttaattgtcagtttgaatttttctttcatactattacagtttatattttactataggcagaatttcctctttatcctaaattttgatattctccataatttcatcgtgccttgacattgctgtatataatttctatacatcaggaaggcaattctgtgtgcatgtgtgtgtgtatatatatagttagaagttagaaactgaaactcttttttgtctaccatcatttcatatttttcttgctatttcaaacctataatttttaaagaaacgactaacgtaatcattcatagaatatgctgtcagtaacttaacaatataaatgttaacatggaggcatttagttcagcatttgctttacttaatagagtgcagaaaatgtggcccttttctcagttagggtgtatgtgaagataaatttagaatttctagactagtaaatacttctctgataataacttaattatagctatttcaaaccaaattgtttaattgtggtgaatcatatgtaaattgttcagatgtaggtcaacacccacgcccacattctagcacctctttcctaattcaagacaactttgcagtgcctaaaagagctgaacagtgcagattagagacataagacaaaaaaaaaaaaaaaacacaaaacaatggtaacataaaaaccaaccgtgtcagaatggtaacacaaaaaccaaccaggagtcagaaagtctctgtaataatgaataggcaggttgtatttatttagactttgcttgattatttcttaggctttatatgtttgtagataacagtttcctcactgctcacgagatttgtggcaagcaaactcatggtgcttctaggatattaaattttctcatctgtaaagtacatgcaatagcatcattattgtctactcattgaactgaaataaggattaaacaaatcaaggactgtaaaatgaacgtgtgactcctcaaatcccatacgggaagaacatgctgtttttcttgatctggttgagtcaaagatcactgatggcaagaatgccttctgtagctgcaggtgaggacaactgagatacggtgcaattgcagaaagtaaataaactttttattttttgagctgttacattatagttctaatctatggatgcctttgtgatgcagcattgtatcattttctgatgaatggctaaggttttatgattctattttatctttatatattgtctgctgtattttcaaatattttatttccatttatagatgcattgaaaaatcataaagcacattgcataaatgtgttacatttgtttttgcttatttgtttatttgagacggagtcttgctctgtcactcaagctggattgcagtggcgcaatctcagctcactgcaacctccgtctcccaggttcgagcaattctcctgcctcagcctcccgagtagctgggattacaggcacccgccaccatgtctgactaattgttgtatttttagtagagacagggtttcaccatgttggccaagctggtctcgaactccttaccttgtgatttgggaggcctacctcagcctcccaagtactgggattacaggcgtgagccagcatgcccagcctgttgttgcttatctttaggtgattattgctgatgtttttggtatattgacagaaaatagtcttgctgcttgttgatgtatactactttttggctttaatgataataaaattataattttgccttaatataaacttaatttttattgtcacttatcacgagaatttgttcaaggatttgaacttatatctgcatataatttatgatttttgacattttctaaaaattaattatcgaaaaaagtggcaattgtttattttaattcttagaggggtaaaataaatggtgtatcctttgcgcttctttcaatatgagtatctttgttgttttaattatttaagataaaaaaataagaattacactaaacataaaatgatatatccctcaaagttagctactacaaaagttttcgtatttattctttcagattctttctttatatacagaaacatcaatatcaatatgagcatataatgtttccatatcatatatatgatcctctggatttttttttggtgtttaccattttaattatgggcattcttctaagtctatgtatgttctctatttcatcgtttgtaatggctgcacattagtcaatattttggatgtatcatgatttatttaataggtcctctaagcttttgtttaaaaaatagaactttaaaatagaataaaaagaggcctctcttaattacaggtttggcaggcatacaaaagaataattctcacttgtatactgaatcaagaaattaaggagtaaagaaaaagtgttacagtaaagagtcattgaaaatagtattgagtaagtgtgtattagtgggctgggtaaaggaaagctaataatatagatattcatgcaagtgtgttgtaggtgtgtaaaatggaacagctacccatttcttcagagtttatctcaaatggcacctccttccataagcactcagagacttttcccttcattcccactctcaccagttgtcttacatcgctataaaaattcagggaaaaatagaccttttcatgttatgtcccatgtacaaattcattttgtatgcatctttttttttcctcactaggctgttaacccctagagggtaatgactgtgtgttattcatctttgaacctaatagatgcagaaaaaaatattcattcaattaaattggaacaaagtgtaagaaaagaaagtaatcggcagggcacagtggctcacacctgtaatcctagtactttggaaatccaaagtgggtggatcacctgaggtcaggagtgtgagaccagcctggccaacatggtgaaaccctgtctctactgaaaatacaaaaaattagccaggagtggcagctcacacctgtaatcccagctacttgggaggctgaggcaggagaatcgcttgaacccgggaggtggaggttacagtgagccaagatcgcaccactgcactccagcccgggcatcagagcaagactctgtttcaaaaaaaaagaaaagtaatcaagtagaactgttaaatcttacacagattttataagatgccactatatgccttgctattatgcctggagtaaattataatcaattctcctgatggatgagacacaaataatataaacacatgggtttgatatataatggaaattattttaaattgaattttagtgattttttgtggtatttatgttcaaaaagcataccgacaagtcaagcatttcagaaaaatgtttataaatgtatgaaaaagttgtttgtgtggtgctgaacttggatatatattactgcatatcaatgtgaaaacattgtgtcagcttcaaagcattgtgcatatggaagacattattgctattgttaatactgtaatagaattgcctctgcggattaaaaatgtagatgtttatgtacaaaatagcagcaataagtaaaagaagaaattatttatatggattctattaaataaaaagggagtactgttttcagtactttgtgtaatgcagattgctactcatgccatttaaatctctgacattgtcttaccatttgaatcatgcttgaaagaacctgtgtccacttagtctgatttcactggtaaaataaattaggaaaaaaaacaaaaacaaaaacgaaacagtgaacagatgtaacgattgcaatttaatttaaagaaaaattagaaaatagtggaagtaaaatatccctttgaaacagaatgtaatgcctagtgagttctttttcttatctcacttgcaaaagtcactagctccaactctgatttcacatgcctattactgagcaggtcaataagtcattgggaagaaggcgagtatcttggtcagtcttttctaatttatttattttttttaggctgttgctgagctttgtaaacccagaggctgaaacttagtgtttcaaatgcatatcttagcaatgcttttttgttttgtttttttaaaacaacaacaacaacaacaaaagctctgatctcctcattgttttctattttgctagggatacaaatataagtacctctagcccctatggcatgcaaaaaaatgagtgtaacaacaaatatcagataatagaaaatggtgggtactgaggaacaggtgatcgtatggttaacatctgtgctataagggctacttctagaatactataatgaacattctagtcaaatgttctgacaaattgtgtgttccagtggctaccacttctgaagatttaggaagttgagtatcggaatttttatgtaaaatttcatgattttgaatgttggctcaaagatagaaaggaaaaaagaaagaaaaggaaggaaggaaggaaggaagaaaggaaagaaggtaggtcggtcaaggactagggactaaattatgccccctgccttgcaattcatatgttaaagccctaacccccaatgtgatagcatttggaggtggggcctacgtgagataattaggtttagataaaattatgagggatgttcatgattagattatggtccttataaaaagagatacaagagggcttgtttcctttctcttgtttcccacgtgagggtggagcaagaaagccattgttagcaggccgggagaatgctcgctggggtatctcattggccaatatcttgatcttggactttccaacttccaaaactgaaagaaaaaaaaaatactgttgcttaagccacctaagctatggcattgtgttatggaagtccagcctgcctggaaatagcaatgactaccatctaatccttagattccattcgagttttatgggctgtccaagtgaattccgatgactgtcctttaaggtgtaagaacttgtttctgagtgatgtgcgctgtttagtagtcatgttttattagtttctgtcagtgtaggaaagtgccacagacttttcttgagtttcttgaccctgacacttttgaagattacatgccagctgttctgcagaatgaatttaatttgggtttaattcagggatcaggttttatgccaatttggatcctagtgtctgggacagtgtctggcatagagattgtgtttcataactaattgaggaatggattatgattgaaaatatctattgtgcacctctgaatcaccaggctaatgctaagtatttcaaaactttctaaataaaaaaaatgtcaaaaatagaaaacacacaagtctaaaatcagaaaagaaaccctcaaaaacacagactctggtgtcttctcctagcagcactgggatctgttctttaatgtatatagtgagcaggcaggtgctagccactgtgtaagtgaatactagtttctttagagcagggcttctgaaagtgtggtttgtggtctgcttccaggtcacaagttgtttcagattcatgatgacataagaagagaaattggaaatgagaatttagaaatctttgagcattttgacaaaataattttgtttttgctatctaataattccaaaaccatctcacattttatctgtatttttattacactaagctgattattaatttacattgtatttttccattgtattgatccataattgagtggaaattttaaaatgtaattatttaccacagttggtggccattcttcattgctttagggggattaaagtagagtggtgtaaatgtgatctagaccatggtgggatttgacatagaccccaaagaatggataaaatccacctagaacataaagtatagagctcgacaatttatgcacaataaaatgttagaatatatgtgtatgcatatatgtgtgcatgtgtgtacttgtatgcctgtttgtatgtgtgaactttcttttatgcactgttatctgtgcacatgtactcttgtgtatgtgcacatatatcatacatgtgggtgcacatgggtgcgcatatatatgtttgcatgggcatgtgtgtgtatttgggaatgtgcatgatatgttcatagaactgggtaatcatgatcttgactagttttttagctgtccagttttggacattaaatttgaggtgcctgtagaagaagagagagggggccgggcacagtggttcacacctgtaaagccagcactttgggaggccaaggtgggtggatcacgaggtcaggagtttgtgaccagcctgaccaacatggtgaaaccccatctctactaaaaatacaaaaattagcctggcgtggtggcacatgcctgtagtcctggctactccggaggctgaggcgggacaatcgcttgaaccctggaggcgaaggttgcagtgaaccaagatcacgccattgcacttgcactccagcctgggcaacagagcaagactccatcaaaaaaaaaaaaaaaaggagtgagagaaggtcaaactggagaaatgtatgtatgtacttttgtatgtatgcatacgtaatatacagcttatgcatatatctcaagagctctgtgtgccagttctgcctgtgcagaatcatatggaggctttactttctcatttgttgctgtcacattaatttattgcgtgaacatatcatttgaaactccagtaatttgtcccatatttcaaaatgtagtatggacagagaagaatgacatagcttaaaactggttccagacgtgtaaaaacatcttgtgtctctactaccaaagcaaggaggaaaattgtgccgattaaatgcctgaacctgttttggtttcaattacctggattattgaggcagaaacaatctttgtgcctgatatatgcttataattgccttagtcttcagctttgacttgctttgggaacatgcgcatgttctattaataccattgttagaaaggagaatttatttccttttttgatggttccataaaagctttaaaatatattttacaattcagagaactaacattttataaagcctccataatggagaatagtatacggagcaaagggaaaagagttaactagtattcacttcacagtcatcatgtgatagttgagttacctcttactcctttttcacaacaaacgttagtgattcaatcttatctgtagtgacctttgagcaccttctgatttaagacatccacggaaaccaaacacactcttgaattctccatatattagggtcagtattgtgaagatcaagcctccattcaattcaagcactttcgagtgaagctcaaaatgaattagaatccataggaagagaagactcacctctctatcccccaaccacaacctcagcttttctatttagcacccaaaacctaaggacttcaactaaatggagatttttcagcacagacattattatacacttcatccataatacctacttagtatttttatttcaactcagttaatgaaaaagccagaatagtaaggtagtgcatgagtaaataatgaccatctcaaaatacctttttggaccttttttctatgaaagaagtagacaaaatttatgtaatgacactccttttccctgcacagtcagtaaaatagatgtcaagttttagtggtcagcatcacttaaatatctaaaatgtatagaatccaacatatataaacctaaattgagcaccttaaaaatcaaaaatatttaacattcctatttcataaaacatgtaggtagtctccaccatttattttgatctactaaagtgtctattaatttatgagttaaatcaaaaagcattgagcatagactacatattaggcactttagcaggctctgaagactcagtaggtataagttatattatctgtcctagagggaagtgcattattcctaacctggagtgaaagcttcaggtgtagcctctcagagaagggaatgtaaaggaaaagatttcaaaagtcaggcatttggtccaaatggataagggagctccgagcatcataacaaataataatggcacttgagaaatagcaatacgatgtgtttgaaatgtagagggcaggaggaggagggacaagataagtaggaacatgccagatcacaagagctttacatgcaataacaactttgaactaaaatttaaagacagcaaggaacaaatgaatacatttaagaatgagcatgaattgatcaaatttacattttagactgatatctggaagtgtgtgcaattgtgatagctgtgtaagttgatcaagcaagaaagataaaggaagaagagcatggtcaaagaagagaagagtgagaagatagagttgagtaggttagccaagaaatgtattttaaatatcaaattgacagtactttaccattcatgtgtggtaggttagcacagctgtaaatcttaaaactcccaaaggtttgcaagaaaaactgggtagatgaaggtgccaataaattactacaaagaacagatttgggggatagatgattagttcaattatgaacatattgagaggttggtgtgtctagggtatattcaattagttatttaagtagattgttctgaatagacaaatctggtttctttcttagagaaacttagactgtaatcattataatgatatagatggaagttaattcattgatgtaagtggattaattcagcagtatgtatatggcaggaaatgaacagagcttgaaacctggtaagccagtaaattacataaaattacaaattcaggaccaatgtgacaaaagtctcaaccataatcttaatgtcttcgaatgttaatgtgggatgatttctttaatagatgccttgtatttttaaagacaaaaatgcaacatctaggaaaaatattttttaaataaatggacgagtacccaaatcttgatctttgtcgtatttctgcaaatcttatttttcttaaatccacttttattttgacttgcaaattttcaaatcagtactgttcaaatatgagtttaaacatgaaaacatgattaaaattttctcagcactcaggatatcactccttcctaccagatttttttgtttttttataattttatagcactcaacttgcttgaagaacagccttctcaaagtgtgcagttttcagtgatctaacccggatacagcaatgttttcctgcattagctcatcggaaagaatgccaatgatataaaaataaattggagcaaaaataagttaaatatttgaccttaataacatattgctcaactcttattatgtttatgtcaccttcatatgaattatcataattgacaaataagaatgattttattttctatgctgtaaaacaaagttacagtaaggttaaataaccacagaaagaaatgcactctgagaaggtatttttttctttgagaattctacaggttttaggcagttattacatcatagaaaatatactttaggccaatattttatttaagctattgttagacttttgattagatctgtaagcattagtgaggtctctttggggtcaatattagtaaaggaaaatggagttgagtgtaacaaagatgaatcaatttcattgtctagaagtcttttaggattcattatcacttggattttattatagttcatcatcattgccatattatgcaagcaaatcaatgaacttttaacaaaaccggagataaaaacctaattacttaatttgataatagttattttctaatttatactgccaaaaaatttatatcatattttattacagaattgtcattttaaaatacatatgttgagtcatgtccaagtcataaagaaacatataaagcctctgtcttttataagtcatttttatagtcacattcaaaaactgaatttttaaaaattttacaatacaaacaaaataatatattttgagataatttgaagatcagtcataactcatgagcacatgggattggtagatcttttattaacctaaatccttacctcattccccttcaagtcctatcccccttctccctttaaggaagtattttcttgaccaaacagaacaatagctctgacgtgtgtatggccaacaaatatcaagagcatttgaacgctttcaaaagacaattaaatatgtttgttggccatttgtatatcttttgtgaattgcctattcatgtccttggcccactttttgatgggattgtttggtatttttcttgctaatttgtttgagttccatgtagattctggatattagtcctttgtcggatgtgtagattgtgaagattttctcccactctgtaagtctgtaggttatctgtttactctgctgactgttccttttgctgtgcagaagctctttagtttaattaagtcccacctatttatctttgtttttgttacatttgtatttgggttcttggtcatgaggtgtttgcctaagccaatgtctagaagggttttctgatgttatcttctagaatttttatagtttcaggtcttagatttaagtctttgatccatcttgagttgatttttgtttgaggtgagagatgatgatccagtttcattctcctacatgtgactagccaattatcccagaaccatttgttgaatagggtgtcccttccccactttatgtttttgcttgctttctcaaagatcagttggctataagtatacaaatgccaataaacatatgaaaaaaatgctcaacgtcactaatgagcagggaaatgcaaatcaaaaccacaatgcaataccaccttactcttccaagattgccagaatcaagaagtaatggatgttggcatggatgtggtgaaaaggaaacactgctacactgctagtgggaatgtaaactagtacaaccactatggaaaacagtgtggagattccttaaagagctaaaagtagaactaccatttgatccggtaatcccactactgggtatctacccagaggaaaagaagtcattatacgaaaaagatacttgcacaaacatgtttctagcagcacaacttgcaattccaaaaatatgaaaccagactaaattcccattaatcaatgaatagataaagaaattgtgatatatgtatggaatactactcagccataaaatggaacaaatcaatggcattcatagcaacctggatggaactggagactattattctaagtgaagtaactcagaaatgaaaaccaaacatcttatgttctcactctgaagtaggagctaagctatgagaatgcacaggcatgagaacgatacaatggactttggggactaagtagaaaagggtgggagggggacaagggataaaagactacaaattgagttcagtgtctattgcccaggtgatgggtgcaccaaaatctcagaaatcgccacttactcatgtaatcaagaagttactcatgtaaccaaatacaaactgttccccaaaaacctatgggaaaaaaaatttttaaaagtaacacaattaaagaaaaaacttttctaaaggaggaaattctcttctgcaagaaatttgactttatttttattaaatctcaacataatttttatttcaggttcccgtttgtcctcaaggtagtaaaaaccagccacagtcaattcaggctttctccttattttgcctgatgtctagtctaagttctggtaggggacctcaggtccattcagtcatctgtctactcagttattcaccaaggattccatgattccatcatctggttcttagtcactaattcatgattgtcatttctgagaggcttctttctcccattcctatggccgtcccaggcctacaactctcttcatgtcagtgcaagactccgtctcaaaaaaccaatcaaccaaccaaccaaacaaacaaaaactctctgatgctgttttgggctttacatacacatgcaacatgcccatatttaagttaaaggaggagattaaacaaaaattatctccctcctcttcttctaaactatcagatgttgttttcaggaggacagggcaggggtcaagagaaggtggaacagtatagttgtttgaatgaatacttaacaattatgtcatttaagacgtatttttcacgagtttcttgatgcaatatataattaagataagtgtttgcttgttttaatattgctttgatctacttttagcaagagacttttatcatatttttatggaatatgtctttaatttagtatcgaaacataaatcactccttaaattcaattactaacatataattccagctaagaatttcaggagcaaaaaaaaagtttgtatttttaatgtcaagaacacattaaaatataaatgcttttgatatcttagatttaaaataaggaatttgtgtattcatgaaaaagataaaaatttccgagaagactttgacaataagttacatgaagaaaagtaaatgttctctttaaaaattagatctttccttacatccaaatgaatcagctatctaatgtttttggttttttgtttttctatttgtgtactctacttatattattatgagaaatttgtgagatttccaaatttacctctctccaatattggaaattctcataatgtttaatgtctgctaattagatgagtatttaaagtgtgtaatttgtcattttaaactaggtttctgtcatttatgctaattaatggtaaattttaaacatgttttacaccattttctgtgatggttttctagcctcccgtctttccacttactgcctctaatccactacttccacaaagctctccttacagcacactctgactgcattgtgcagagaatatcaatgattcccagttattcacaaaacaaattcgaaatgcatggtccagatgacctgttctttacagcccagtcccaatgtcctttcttgtcacttaatttctcaactcttcctcccatgccttataactgtgtcaagctggtataattttcagtccctttccctataactttatttttcccattttactaattgaaatcctacctatggtttaatatttggcaaatatgccccaacatttatgtaaaattttgtcttagtctgttctgtgctactataacagaataccataggctgggtaatttataatgaacagaaattaattttttcacaattctggaaattctagaaagtccgagattagtgtgccagcatctggtgatgatctttttgctcatcacggtggaaggtggaaagaagagagagagagaaggagagagacaggcattttaaaaggccattgaaagcatgttcaactgttgttaagatttaatttacaaaccattagatttctttaatattttgtgttttaaaataacctcaggtctacatgtccagagcttttcagaaatgtttataaaatttggttgctgcgtcaccaaaaaatagcttaaaggtatataactttaagcatttgaacaaattaagattatttaaaataatgtatgtatggttgttctacatatatctacatttaagtttattttaaaaattatgcaaactaactttgcataaccgtaaccaaatagaagtcattaaaccctatttatttttgtagtattcttggaatacaagtgttttattcttgatgctatgctttctgttcagccaaacatatgtttgttcccaaagaaaaaaattgagaacatgataattaagatatgcactcaatttataagtaaataactgatgaaaaaatagaccaattgctttgataatcagttctgttagcttatgtttagggctgtcacttcaaaactggaaaatgaatcaaaaggtttttcttttccatctgttaatatcatctatgacatttggatacatatctatatttacatttgcatttttacatatacttatgtcttacttaatatagtatttacatttgttaatcagcaaattgtggtagtccttcttttaataaacagtggtagagtttgaatttttgaagtgtttattaatttataatagtggactaaaagaaagtatagttatttatttagattatcagaccatatgatgagttatgaggatccatatttattaatggttttgccttgtcaaatgtaagtcttgattactcttagctggaaagaagtgatgtttttattatttagcttaattcatctaaaataaagaaaatggctttctggcaagacatgacttcgcctttttgattacagcatttatttcccgagtcttcaaacacctcaatcacgcaaggttcaattccaattgagtgttcagaccacacaaatagtacaatgtttaatacttggtttaacaaaataagggcattagcactcacaattttgattctttacatattgcctaggctcgttaaggcaaaagatcaaagactcttttttaaaaaagggaaaaaagaaaacctccatgctagaaaatggggaaaagctgagtctgaaattaaatcctaagcctcataggttggcttttcaacagttcaaacctcaatttttcttcgctgtaactcccatttgaaacaaaatgaaattttccaaacctaagtactgtgttttgcaaatctttttggttttcttcataacagcatttctctttttaaacagtctatcgcctgcttttattagttttttatctctactctcttaattttactccttttctatttagtctcttttttccatcaccctttttcttcagcttctcctatgtcttcctgcttgaatctaatgattagacctccttgcgttctagtacttttgtctgcttggaatatgcatacacaaacaaaactgttcaactttctcagttccgtttctactattttcgtaatttatgaaaccacagtagatgtaatttgcgtaaacattctcaacatacaaatttcgtttcctgtaattctcggtatcaatttggagtattgtttatctatatcctcaaatttgacaaatgttgattattagaatcttttcctacttctcaaagaagcaacagtttccatctttaaattacagatttctggcgctttatctcatatcactatgaattacttttgctttatttaaaaaatttaaaaaagatattatgtagaaaatacattctggactcagggaatatagagaggtctgagagcttaagaagaatagaaactcatctggctagatggcaccaaactgcatcacttcaggccacacaatgttcattaacacttaaaggactttttttttttgtatataaattatatagccaaaaacaaagtaaaacataacccaccaaaaatattttgttttacctcttggttggcaattttggcatcaagcacacatactttaatcatagtaatacttttcttacagagacatggaggttgctcgctaaatagagcaaagcaaaacaaaacaaaacaaaacaaaacaaaaacacacctttcagaatgaacagggcattcatacagaaactgtggaggtgaagttggcacttactcatctcaaaggacattgtcttttggccaaggctgccatcctgtctgctttgacacttggaaatggcaactgagttcgtaacacaaaactgaatgttgcccttcttaatgtgaggagagaatgaaatagaacacaaaaaaaatggcattcaagaatataatcgccatggtggctcatgcctgtaatcctagtactttgggaggctgagatgggtggatcacctgaggtcaggagttcgagaccagcctggccaacatgaggaaaccctgtctctactaaaaatacaaaaattagccgggcgtggtggcatgtgcctataatcccagctactcaggagactcaggcaggagaatcacttgaacccaggaggggcggagcttgcagtgagccgagatcacaccacttcactccagcctgggagaaagagtgaaactctgtcaaaaaaaaaaaaagaaagaaagaaagaaaaaaggatataattataagaaatattgctgggagcaaaacagactcatcagactcattgctacactaagtcaatgatctgagtttcagaataaaaagagaattttaaatttagcacccagagtaatttgaaaaagtatgaagaagacatattttaaataggtgattgtagattgatgggattttcttgatttatttctgtacttgagctttttctctgcagtaaagtttataaaagataaacagtacccctgtattctatgaagaaacagataatacccccacttgaggttgtttttgaaaattattaattgaaatttaaagtgagaaaaatattaggtttctgggaataatcctacaacattgaaatgaatacataaagaaataaattggttaccacagctcacctctttattttgcacttttgtataacatacatcaaaaaccatattccattagtttccctagaccatcctatgacttctaccttttccttacatttcatattttcatatcagatctcatatttctcaacccccacttctatgtgttttgaccaatttttaagctgcatttctttacagagtactaggcatctcactattttattaatattaggcatattaataaaatgtctatcatcaatattatcaattattaatattgttaatattaactatgttaataccaatattcattatgtgcaactcttaaacatgctatatatgcataagtatttggatagacagattcgattgtaaaggaagaatggacaggataaagccatgtgtacagagtgcaatagtgaggtccagaaaagctggatatttgtctaggagagtttctaatgcatgacatattcggttggttgggataatttggcagtaatccctgtgcttttaaagtagtaactacaaaatagaagtgttgtaccttttgaatttagtatgtcacttctttaaaagtctgtaaaaattttacaagaatttcaatataagttcttttctggaaatgtaagtaacatttaaagaaatgtacagacaaaataatacactaagaattttacacacacaaaaaaaagttctaaatgtttaactctatccagtacctattattgcagtttaacaaaaattgatcacccttgaggtttgtggtactgttactcatcacagaggttgaaaaaccttaattgctagcttatttggttcaaaagaataaaaagaatcagaaagaaaataaatatttttcagaaatccaaaaataattctttagtgcagaattattaaatgttaatttattgccaagttccttgtatttattgaaatagttgtgctactttggggaaaatagcaaacattgttaagtgatgtgtagtgtttggttgccagtttctacatttttaaacaagggacaaatgtatctcttggggttagcagaaattaagctgtttacatatcttctcattgctcagaaattttgagccacacatatgtatggaaattcaaatgtttttatatataagagttttaactcctatagtaccttgtaacaaatattaacttccatagcaaaaaatattttgttatattttgcaaaccacttttattactggaaaagcaagatgaattcagaaataggtagaaatatcatgttctgttttttattgcttgtgacaatgcactataagtgatgaataatttttgagtgcttgctgtatttccacaccatttttgtcatcataaaagtgactgataattaacatagttctcttcaaatgtgttttgatataattatggaaatgtctctaaaagacataaaaggatcttgcatattaaaaagtcattcaccaggaagtgatattagagttacaggaattgacaggaggtggagccgaatgatagtggcaataatgagcgagtgcctcatggaagcatcagggttacagtattgaagattatgtagaactttattagagagacgagggtaaaagtggagggcactttgtatgaaggcaagctcatgaatgaaagaatgcagttttcaatgatacagcagtgagaaggtaaccctgaagtatttcttggtatgttccagtaaaaataaataaataaataaatcagatgagtattatggaaacagcttatgtatggctttgacatctagatagaatagttttatgtttgatgttgtctgaaatagggcaccataatcgatttttaagcagagttacaatataatgaaagcagcatttaatatggattattccagaagtgacaggcaatatataggtgacagttggagggtggagagagaatctggaggcagctcaagctttgaaagtccacaggaaacatttccaggaatgcaggtgtgaagtgaatgataagcttttagcttttggtggtggcaattagaacactgaaaaggagaggatacctgaggcatttaatttataataacactgtatatctatattttaatcttataactacccttatatgtttggtgttacagttgtcagttttgttccatgggcaaaataggttaccattaatgcattccttatctttctgttaaaggcattatttaaaaatccacattgtcctgcttatgcaaagatagtactacatagtactatccactattataatccactgagagcatgtactttgaattattttccaacagttgcagaaaaatttgctgaaacagacacatgctctctcagtccatcctcattataaacaatagctggtacttttgagattcttagtaagaattggtgaaccatttgatggcttgggactgaaagctctgtatccatcatatagaagaaggcagctgatacataatggttgccatcttccaatagtgttattaatgccatctactaagcaactgaaccaatctactatgtatagtatggaaggtaagctagctgccagaagatggcagaaaggtaaactaacagaatttgtctttgagttctgtgttgatgaacacttttgaacttctcactaattctgtagattgtcagaatacgaggtccaaattaaacttatagcaaatttgatgaagacatagagttgattctgatatgaatcttacgaatgataaaggagtacattttatatatttagagtattgattcatactaattaattggaatgccatttaggggtcatttatgatgttatggggttcagcaatacaagcatgagaattccttctattaaatagaaaatttatttcctgctctttggaagggtgaggcccattttgtaattggagtgtgaatgttgtaaacaatatttgctattgtttgattgcttttagagctgtatcaaagagccttaaccattgtgtgttattttttgctttatagcctctaacctaagcgtcaatatatattgttttcacgtattgtattgattgtatcaatgtcacgtaattttgtcagcaacagcctagtcaattccatctgtcctgttttgatgactgatttccttatgtcaataaattgacaactaagttatccaaatgagcaatctaaaaaagattgcttttaatatgctttcttccccttggacatttagacaactttataccaagtctctgtgcatccattattagtatattctggccagctaagcctctctgaaaagcatgatttttacataatacatctttatttgttatattgctgtaatcaaattatctctatgttgttgatcagggaggaattctagacatataagtaaaatattgtgtgaattttattgaatgaagcaattagggctctttgaccttctggttgcaacttctattttagaaagacattagaaacccacatttgaaaatgtctaggaattttctcttggcaatatagtgctttcatttttaaaggcggagaagaaaacttcactttctgggttgtacttgtctacagaaaaattgtactggagctttagtatgatcctgacaagtagtttaatcatccctggctgtaaaatacctaacaaagcttgagggggaagataagacttaaattttatagagagttcattgttttgggtacaatttgtctattattttcctgcagatatgatgataattataacatagtcattaaagcggaggttacttacctaaagaacaaaacaatacttctttgttaatgatgaagagaaagttgtaagtaatttagaggtgaacataaagatggaagaagtgaagctgtgccgggatcctggggatgagggagaagacatcacaggcttctgtaacactcaaaataacaaatgatgcataaatagtacagcaatatttaataagcattttgatatctttgatgaccacttcagaaaatgaacattattgaacaaagtataaagcatatttaaaatattgaatcaaatgacaaggaccaagaattgacagtaccagattatacatactaaaaagaaaacaaaaaattaagtaattatttgagagaaaaagtctcaaaatggatgtatctttaaaaaactacactgaattaatagaagttggtatagattcaaaccaggaactggaaattctttttaatttatttttttgttttatatttttttgagacagagtcccactctgtcactcaggctggagtacagtggcacaatctctgctcattgtgacctttgcctcctgggttcaagcgattctcatgcctcagcctcctgagtaactgggactacaggcgtacgccaccacgcccagctaatttttgtgtctttagtagagagaggatttcaccatgttgcccaggctagtctcgaactcctggcctcaagtggtctgcctgcctcagcctcctaaagtgctgggattacaggcatgagccactacacctgggggaaattctcaccctaaacatgagcacaaagtttatctgataattgctcatataaataatctacttccatgcaaaaagtttagatcagtgtgagaaactatatttaaatttcacaagttagaaattttaaatacaatttattatattttaattataatgtacttatttataatttaattttcattcagagaatatcataaaaaaacttgtatgtgtttcttaagctcaaagggcacaaaatcttattattttgtaatcaaagaacaaaataggaaaaacaaaacaatgtatatgagtacaaggcatttttcaccttcaatttaatgcttataatgtagtccaggtcttcaaagtagcctaagcaccatggtgcaaccacttaatatattttgatttatgtttatttgtttctacaaatcacacgatgtgtagatgagtattctcaggacactgtgtcagtagtaatttgtattggaaaaattattttgctagatttattaacatttactacatttttttcaagaaattgttcattttgtcataaaagaatttttccatcagtctataatatcaagaagaaagaatgcaaaaacagaaataaaaaggtgcatggtgagtgaatgaacaaactgtagagtgtaagatttttaggaagaaattaaggaactgattcataaataaaagaaaatggtaatgaaaacaaagtgaattgattgcaaacatgctgttgatataaccatagaatactggatatccatgggagagcttataaatgctactggacatttgtacacaactgtgtgtatatgtgtctgtgtgtgtgtctgtgtgtgtgtgtgatgaggagtggggggagaaaggatgcatcattgtattttttattctaggtttgttttttatttgtatgtagttaccacaatgatattcaaattttaggggaaaatgagaatttttttacttctgcaaatatatttaatacaacccatccaaatttattctaaatacattttgatacaatttgtcaacctataattcttcaagaagtggaatcagcagttggtaataattgcacatctgtggttaattagctcagttggttgaatcatggagctaatgaggccaaagcctgggtttgatctctgcgtgggctggtgagttttgctctattcctgggtcgtagactgcagttcaaacccaggccaagtatctcatggatgcatgccactgaccataagaaactgggcaagagaaagtaacttcaacaggtccggaacacatcttcaaactatatacagcatctgcttgttaatgtatgaagagaagcattagttatgaactcagtactctcacaaaaagacacacaggaaactttctgtggcctcaaatgaaacattgaggaataagtaatattaggaattacctaacgagcacatgggaaatagctaattcataaccacaaatagaatctatttcaaatggcaagggaagcaaaatccctgtcattcccacacattgatttttccttggtagattgtaaaggtctttaaggtgttggatgaagagttctgaatcagctgtgaaataagacaaaagagggaggagagaaagcagatggaaagccaaaatgtcacattcgttttagataaagactagaggatgtagtttagacccacaggtaagtgggctccttaacactaacctcagaattagagacatttcccaccaacatagagtaagaaaacacaggtctccccagtgcgaccagcctcactttgtggcctgataacgctttttgtaggaaggtcatccccaaggagaaaaagggaagagaaagggagtgttgtcatatatggacagatcgtttttcttacaaacatataaatcagattgggccactggttaacactgagtgagagaaggagagaggcctggattgttccatatgaaaaaaaaaatcaagagtggaaaataattcctgccacctccatcttcaactatatattttatttttaaattggataaatggccagtgtaagatgaaaaccaagaaaaatgccagaaactgagacttagactgtatgtccattgtggtagatagaaacttgtgaacttactaagaatcaatgtatctctgttgcagtgtgatggtctttcctcatggtctcccaaatttctaagggtagttggttcccagtatgtctgccacattgtgatcacaaatatcatgatcatgaagaaatgctttgtttggaaatgcctacaaataatgatggaagggcccaattgaaagtaaatattttgctgaaattatccatttaccaattcattatcattaacaatgaactcaacataacattagtctaatgagatagctcatttttttttttaaaagttatgtgtcgaatatatcctttaaacatgtcagatatattccctttagggattcacaatgcacttcgtctctttaatgtttgactttatcacaatgtttttcatactttggtaagtaatcccatctaactgctgtttgataatttaagtttgggaaacactaatcaaaaccataatgtgagcaagttctttgtagtaatattttatgatgtttagtttactaataattatgaatagataatttatctttcaatgatgtttgcttttaaaaaagctataaattcatggcatagtaagttgaaataacattttagttgtagaaatgataattaacagctttttgtagatgctgttttgtattttttttactctgttatggtctatagagaaagactcttggagtgcatttgcattgctgccattgtgattttctttttttattattatgctttaaggtctagggtacatgtgcacaacgtgcaggtttgttacataggcatacatgtgccatgttggtttgctgcacccatcaacttgtcatttacattaggtatttctcctaatgctatccctcccccagcaccccctgcaacaggccacagtgtgtgatgttgcctgccccgtgtccaagtgttctcattgttcacttcccacctatgagtgagaacatgcggtgtttggttttctgtccttgtgatagtttgctgagaatgatggtttccagcttcatctatgtccttgcaaaggacatgaactcatccttttttatggctgcatagtattccatggtgtatatgtgccacattttctttatctggtctatcattgatgaacattgggctggttccaagactttgctgtgaatagtaccacagtaaacctacgtgtgcatgtgtctttatagtagaatgatttataatcttttgggtatatactcagtaatgggattgctgggtcaaatggtatttctagttctagatccttgaggaatcaccacactgtcttccacaatggttgaactagtttacactcccaccaagtgtaaaagggttcatttttctccacatcctctccatcatctgttgtttcctgactttttaatgattgccattctaaatggcatgagatggtatcttattttggttttgatttgcatttctctgatgaccagtgatgatgagcattttttcatgtgtattttggctgcacaaatgtctttttttgagaagtgtgtgttcatatcctttggctactttttgatggggttgtttgtttttatcttgtaaatttctttaagttcttagtagattctttaagaatcctacatgttatttgtggcttacaaaaaactttaaccttagcttatatagagatattgattgagtttagatctcaacctcaagattccattgaaagtggttatacagacatctaagttcatttattcctctttaataatacatacagtcctattattatttatacagttaatttatcttcggggaagtcgtcaacaaaatgacatcacaaaaattaatcaattacattcaaatggaataaaatgtaatcatggagattccaaattatattaaaaacatctgtatacaaaatactgtttaaaattaggccttttgttgcaaaaaaagaatttttaatttgtcgcccaggctggagtgcagtggcaggatcttgactcactgcaacctccacctccctggctcaggcaatccttctaacctaggcctcctgagtagctgggactacaggtgtgtgtcaccatgcccaaccaacatttttggatttttggtagagacagggttttaccatgttgcccaggctgggaaaataattccttttttaaaaaagccatcttttggtatgtttgtttattatgattctacttaaattctcactgaattcttttccagaagttattgcaaaacagaactctgaacattcttcctgttcttttctgcacaagcaaacagtccatccagataatccggatttcgccaaactcaaactttacttttacttattgtcagtgaattttactcccctcttaaaaatctagtgatctaaaccagactaaaaaaaaagtgttctataaaattatacagggaaaatcattttatattgtatgcctcctcttatcttcatcaccctcataggggcaggcaggctggagcgagagagaaatagaggaagagataaaggaagaaaaatgcaatagaatgtatgttttccctgaaaagcacactcagtgaacaaaattagcccttgggttgcacggaccctgggttttacatcatggctattgtttattacttggaagtaagtattatttcagtttattgatttgtaaaagagaataatagcatctaccctgctaaactttcaaagatattaactgacataatatatgtagcatcatataaatgtacagtcatgtaatatgtgcatatagatgtacaataatgtacatgatataaatgtataatggtagcatcatcgccctttttaagaaatgatgctgagaaatttttctagatagctttctgtttataaatattttcaatgtaggtataaagtcctgaggtgtaaaaaaatgactgtgatggctaatatttaatttttagtatgtgctagacatgttctgactcttttagatgaatatatttttatttaattatttcaatgacccaattaggtaattatttccttttattcttattgcaaaggagaggaaagtgaacacacgttgactaaatggcttaccccaggttacaatgcaaaaaggggttcaggttatctcgtctacccttagttttgacaggcaatctcttctatagaatcctttcacacaatgttccagcctcttgtgaaatttattccggtaaatgaggcagggcatgctagtatgctcatttttctgtgcagactcccttccacagtaactccatagatttaaaacaaacttttgtccttttttttttttcaacttttattttagatccaggggtaacatgtacaggtttgttacctggctgtattgcataatgctgaggtttggggccaaatgatcccatcactcaggtactgagcctcgtacccaatagctagttttacagccattgacctcctcccttcctcccacctttagagtcccaagtgtctatcattgccatctttatgtccatgcgtaccgaatatttagctcccacttataagtgaaaacatgtgatatttggttttctatttggcaaaaaattaacttgggacagtgtcctccagctgcatccatgttgctgcaaaggataggatctcattgttttttacggctgcatagtagtccatgtaccacattttctttatgcagtcctctgttgttgggcccgtaggtagattccatgtctttgctattgtgaatagtgctctgatgaacatgccagtgcatgtgtctttttcatagaatgctttgttttcttttggctatatagccagtaatgggatcgctgggtagaatgatagtccaggttctttgagaaattaccagactgctttccacagtggctgaactcatttacattcccatgaccagtgtgtaagtgttcccttttcccgcagtcttagcagcatctgttgtttcttacttttagacaatagccattctgactggcctgagacagtacctcattgtggttttaatttgcatttctgtgatgattagtgatgtggaacattttttcatatatttcttggccacttgtatgtctttcaagatgtgtctgttcatgttttttgcctactttttaatagcttttttaattattcaattgtataagttccatatagatcctggatatcaggcctttgtttgatgcataatttgtaaatgttttctcccattctgtaggttgtctgtttcctctgttgatagtttcttttgctgtgcagaagctctttaggtcccactttgtcaatttttgtttatgttgtgattgcttctgagaacttagtcataaatttttttcccaaggccaatgtccaaatggtgtcgcctaggttttcttctagcattcttatagtttgaagtcttaacatttacatttttatttcatcttgagttaaatttttgtatatggtgaaaagtaaaggtccagttttattctgctgcatatggctagccagcatcaagaataggaagtcctttctcccttgcttacttttcaaatcaattttgttgaatatcagataggctgtaggtgtgccactttatttttggggtcttgattctgttccattgatctttgtgtctatttttctactaggaccatgttgtttggttactatagccttatagtataaagtcaggtcattgtgatgcctccagatttgttcattttgcttaggattgctttgcctatttaggctcttttatggttccatgtgaattttagaatagttttttcaaatcctgtgaaaaatgacattggtagtttaataggaatatctctgaatctgtagattgctttgggcagtctggccattttaacgatactgatgctttcaatccatgagcctggagtgtttttccatttctttgtcttttagtagtgttttgtagttctccttgtagagatctttcacactctgggttagatgtattcggaaatattttattttttgtgtgactattgtaaatgggattgcatttttaatttggctctcagcttgagctttattgatgtatagaaattctactggtttttatacatttattttttatcttgaaactctatttaagttatttatcagttccaggagtcttttggtggcctctatggttttctactagttataatggaaataactatgattattaaaataatcactactataataattatgattctaataaagaatcatatcatatatgaagagagatagcttgacttattttcctatttggctgccttttatttctttctcttgtttgattgctttggctagcacttccagttgtatgttgaataggagtggtgagagcgggcatcattgttttgttctacttctcaaagggaatgcttccagtttttgcccattcagtatgatgttggttgtgagtttgtcataggtagcttctattattttgaggtatgttctttcagtgtctagcttcttgagggtttttatcatgaaaggattttggattttatcaaaagctttgaagaagcattttgttgaattaagttgatacttattttttacttattactaacaagcataaatacctgaaactgtagaataaaacacttctacaatatatcacttctattgaaaaaaggaatttcagtaataatttggacaaatgatagtgaagggagtaggaggggatatttctaaaaaaaattctgatacatcacaacaagactttataagtgtaaaattagatgctgcttattatgtacatggagaaaggcattttgtagtgtagtctgagcaataaccttttgaaatgaaacatattaatcatgcttgctcaacatatgtaagaaatctttgtaaacacatatgcacgtgttatcatttcagaagctcaggctaaatagttaaatagatccattctccacatcctagataaatttctgggtaaataaactatcatctagatttatctagttacatttttagataaatttatctggatacatttttagataaatttatctagatacatttttagataaatttatctggatacatttttaggtaaatttatctagatacatttttaggtaaatttatctagataagtttctggataaactatcatctttatcaaattcacatatctgtagttaaacactatgatcacagatccattgtctgtaaagtaaataatgcaaatgaaattcagaagtcaattctgaccccagctctactatagacaaagttgtttccaaaaacaagtttgatttcaagttgttggattgaaaaaaacaaaaaacaaaaaagtatatactctgcatatctagatattacttttagctttgctaatctagttctcttttctatcttaaaataacaaatagaaagatagtcttctttttaaattgaaaacataatataaaaagttgtaattgtttaactgtatacatacacacatatatacatatagacatgcacaaatacatttatgtacacacattcttcccttttcatatcactttccatttttatttttctttaaaagcattttttgagacatggctatcactgtatcacccagtctttaatcaaactcatgggttcaagtgatcctcccacctcagcctcccaagtagctggaactgcaaggatgtaccactatgcctggctccattttcaagtaataaggaaacacagatttgaccaagtagtgctgggatttgttcattagaaatccatttcaaaaatattttgaaaacatggtcaagacacataatgcacctgatagcgtacttgaattattctatcaaaaatatgcaaataataaatttattgatgtatatacattacacctagctttgtgttttctcctttctatcttctgcccaaagtgggatatgttactgcctatgagccaccatagagcaaacactagagtgactgcttactttttttgtagccttctagatattacatcattggaatgtcagacaaagccttgaaattcatactccatcaagtatgtgatttttgtaatactttaggaacagaataaattttaaaatatttcacaggattgtgaaatttttacccaccagtgtctaggtgtacatgaaactcttcagattttgttttcaccccttctcacccaacctcctttttacaactgctctcagttatgaccagcactttacacttttaaaagtacacatgacttaactgtcataagccatcagaggaaaaacatttggccttatgttaaagaactttttcacatgttttatcatttctacaagattttaagctttttgaagacatggaactatttctcgtgtagcactttacacatatgcagtactcattttttattaaatattaaaggagtgaaagccatcttcacactattctatgattggattatctgtatgttttttctgggccactgaagattaagttgaataaacgaggagctggcacaaaccctgacagatagtagaaagttgacatcctaacagagacaaagaaagaagtataaatgaagataatgaaactcaaaatataaataaaaaataaatataacataatataataaagaatataaaatataaagacgatgtagattaggggtaaataaattctattttttaaaaactgtatggaccttctactttgggcagtaggctacatagacattgaatattacagcaatttaaaggatcatattcttttttgtgaaagactatcttgttccattaaggagatgggacactctgttcaatcaaagtgcaaaatcaaagcctataatcatgacacctagaaaactaaatttacctagaaagctaaaattatgataatgttttctgttttgtaactccaaatatgcaatagtttctaaatatatataatatatatatttagatacatatatttagataaaataatatataatatatttaaaaacatattttttattttaaaaattattttaaatagtctttggttaagttaatttctaggtatttctttggttagtttctacatactgaattttatgtgtggcttttgtaaatggaattttttaaatttcattttcaggttgtttactgttcgcgtatagaaatgctactggtttttgtgtattgattttgtatcctgcgattttactgaatcagtttatgtacaaatcacatacattcttttttttctttttagttacacaggtattttgtaaaatgaagttattcttcacaaacataatatgaatgaaattatccttgcattactctaaaaatgaatgttatagataaacaaaaatcaatgttttcacccatattagtatggtaatctagaaaagtttgtatgcagaacatggacagtaaactccttctatagtccatgagatgattgcaagtataaatcttacgagatttccatttggttctcctggagataagggatgcttaaaaactgacgtattcagtccagtggccattaatatggggataatctggaatattccattgtggatctggaacaaatttaacacaattcactacagacggcagtgtatgaataatccatgtgttttgctaattctgcctgctcttggttcagtgacatgctttttaaggagaatctgtcattacacatgcagaagacattcaggcctgggggatatcactactccagcataacctcaagttagtggggagattaaagtctgaagtcaaaattatttcatctgaagtcaaaattgttataaaattgaaaacacatacttgagggtaaagtgaggtcatagagtgacttttcaaaagcagaatatactctctataactgagaaaagacagaggaagagtgcctggtgggctgtggtaaacagaaaaccgaggtgcagctccttttgtgcactcagacaccatactgggttgttcactggattcactctacctttctaggatggcattaattaattattattcatttttcattcttcaaaacacccacatttgcacctagatattgcttgagcatattcatttgactgtggagaaacatacttatcaaataatccagttgcaataagggaataatgaacaggtattttcagttctgggggtcatgccctacccagcagtactcccaattaatggttcaaatatgggattggctcttcactgggcagctctggctcaagcttcacttctttccaaaggcttttccacttacttgaggtgatgcaattgatgatgtcatatgtacatttgatattgaatcaagaaagccctgatgatgcctcccattaaatagaaagaaatgtcttgaatatttatgattttgttatttaagtctgaataaaacctttcatttgctaaatggttgttcttatagcccatcctttcctttaaatctgaaattagttaatacataaaatataactcctaagtggtcaagaaagatgccagacttcctagactgctatacttaacatgcaaacctcacttggcatgtaaaccagaaaatgaaatattgtgaatggttaccgtaaatgtcttcttaaacgaagtccaattaataaaacaactaatagttttactggtctgcaacatctttgactacccaaatttattcattttaaacttgacgtgatttatcatttttaactcaatacagcactaggacctctttaaaatttcatagaaagaaaggatttatgacatatatttaaaatttattggctaattttttttaaaaatttcaaatcaatttatttcaggccattgtaatctggtttatatggtcccagagggatgactgtggaaacccaaattcttagaccagtcaaaaccccactgaatctgccagacaaagattgaatgaagacctgaaggccaaatctctagatctgagaagacaaaatatctaaaagcagcagaagaggcattatacaaaattacttagaaaaagcccttatattaaaaattacatattattcagtttctctgttttggaaaattaaaaattaaatgtacaatttttatatttattacaaaagtaagggttaaaaccctaaaccacttaaaacaccagttttaccacacacttaaacacagaactcttccccaatgcgtgatgggtagcattatactagcaaagataaccgtactttatgaacttcatacttgtgtaagttgattagggaaactatttttagagttatcaatcgaatcaattcacataaattgcttggcacaatatctgtactttagaggtgcttaaaactattattatttttctatttgtgtgtgtgtgtgtgtgtgtgtgtgtgtgtgtgtgtgtgttttttgagatggagtcttgctctgtcgcccaggctgaagtgcagtggcatgatctccgctcactgcaagctccgcctcctgggttcacgccattctcctgcctcagcctcccaggtagctgggactacaggtgcccgccaccacgcccagctaattttttgtatttttagtagagacggggtttcaccgtgttagccaggatggtctcgatctcctgacctcgtgatccgcctgtctcggcctcccaaggtgctgggattacaggtgtgagccaccacgcctggccctatttgtgtttattaactaaaatgttttaactataacttttaagtgtgttaatacatattgactcatgtcagtaatgataaaacctcatttcactttttggttggtgttttaagaacttatgtttatttaaaattcatcattccactatgcagccatcaaaaggaatgagatcatgtcctttgcaggggcatggatgaagccattatcctcagcatatatacattattacctcaaaatatacattattacctactatcattacctgcatttaggccttgcttttaaatttctctttgtgatcgacatggttttctttctttctgacaaattaatttcaatatccttattattgtcatcaactactttaccctcctgctttgcatgccatctctgcccctccatccatccctgtcaagtgccacctacaaccacagcacaccataccacagtgtttcttataggcttttttatttttttctgttgcctaggctggagtgcagtggcaccgtctcaggtcacttcaacctccgcctcctgggctcaagcgagtctcccgcctcagcctcctgagtacctggaattgcaggtgcccatcaccatgctcagctaatttttgtatttttagtagagacgaggtttcaccatgtaggccaggctggtctcgaactcccaacctcaagtgatctacctgcctcagcctcccaaagtactgggattacaggtgtgagccactatgccctgcttcttatagccttttttattaatctattttttcccaacttcttggtctaaataaatctgaatttttcaactagtttgcctcatgcaattttctcctctattgattctcaaggcatgaatcatcaaagcggtcttgtcaaaaggaaacattatttttttactaaaattatgaagaaattgaagcaaatgtgatttcaaagacctaactttatccaattttctacttttttccaagctctacattttcacagtaaaacttctgttttatcttttaacaacatgataaagaaaaacacagatggaagaacattgagggggaattcctaaatgggagcagttagcagctatgaaaatgtagatattcaagaagaaaagaaaaagtaagcaaaactgaatcatgagaccatagaagagtcaaaaaaatgtcaatttatctcagctttctgcaaactacaacccatgggccaaattcaaggtctgtttttgtacaatctacacattaagaatggtttttacaatgatacgtgttagaaaaatgtttagaaagtcatattttatgatgtgaaaattgataaaatgttgttgtccataaataaagttttattggaacaccatcacactttcatttatgtattttctatgactgtttttatgctgtaacagcagaattaagcagttgcgacagagatcatatgacatgcagcatgtaaaacatgtattatctagcccttcatagagaagtttgctgtctccagatttagaacattcccctaagttaattttcccagctgattacatcactgtttattgagtatcagctctggaatttcaagttcaaataaaccaaggagtaccttcagattttttcattagagtttttctttacagtaacacaaggtgggagcaaataaccagtaagagcagttaccttcgtgtatctgtcattttacaaaaaattaactgttcattttgggataactgtagacttatgcagttgtaagaaataaaacagagttaggttaatctttatccagtttctccagtgctaaaatcttgaaaactgtagtacaattggaaaacaacgaaacagttgtacaaaacagtacaactgaaaacaatattatagcccagatgttaacattgatatagacaagatacagaatgtttccattactattagaatcccttgtgttgcccttctatagatacacctgcttctctctcaatcccatctctgccttcactccttagcaacttacctgttttccatttctataattttaacatttcaggagtatgaaaatgtaatcacagaatgtgatctttggggattggcctttttcactcagcataattctcttgaaatcaaccacattgctgagtttatcaatagtttgcttcttattgagtagtattccagggtatgaatatactacattttaaccactcatcagctgaaatacatcaaggtggtttccagtttggggctattgtgaataaagcttcatgtatagatttttcatgtaaatagaaatttttattttgggggaatacattcccatgagtcaaattgctggaccatatgttaagtgtttgtttcatttttaaaataatttggcaaacaatccccagagtggctgtatcattttacgcttttgttagtaatatatgaatgatccaatatactcacctacatttggtgttgccactactgttttgtttgtttatgttagaccttctaacaggtatgtggtgatatctcattgtggttttaatttgcatttccctaatgtgcttgtttgtcatccatatagcctcttgggtagaatgtgtcttatatgttttgcccatttgccatttagactgtttgattttttgactgttgagttgtgagaagtctttatgttttctagatactggtcctttttcagatagatggtttgaaaagatattcttccaatctgtggcttgtcttttcattctcttaatggaattgttgggtaggaagtgtaatttctcctcgacgctcataaattcatagttcaaacagacttcagtagcaaaagacaaacaagagaaaaacaatcaagtttattaatatgcacagtgcctatcactcgggagaaacttcaatgaaaggtaacacaagggagtggcttagaaatctggtttatatagaatcttcgacaaacaacaatgtattttagagaaatgacatgacaaagaaaagcagttttaggcttccagaggcaggaagctgtgggaagttaaatatatagaaaaaaactaatggagtaagatttgtttgtagattcctctggtgccatctctcagctgataagagttgtttccagaaaggatttataccttctccttacatggaaaagggtgaggatagacagagctcttcctttgttggctgtttcgtgattgcctttagctcaacaatatttgtgtcacagaggcacattttggggtgacatctctggtttccttcagagtattttatggagcaaaagtgtttaattttgatgaatcaacttaccaatttttctttatgtatagtgattttgttatgaattccagtaactctttgcctagttccaggtcctaaagatcttgttttgttattttctaaaagttttatagttcaatgttttacatttaggcctgtgatccattttgagttaatttgtatgtaagatgtgttatgtagatcaaaattctccctctcttccccttcactcccctcctctctttatttgtctctctctcttcctctctctctctctgtctctcctgtggctgtccaattgctgtgacaccatttgctgaaatgactatcttttttctattgaattggttttgggtcagtcatggctgtaatcccagtactttgggaggccgaggcgggtggatcatttgaggccaggagttcgagaccagccaggccaacatggcaaaaccccgtctctactaaaaatacaaaaagttagccaggcatggtggcacacgcctgtaatctcagctactcgggaggctgaggcaggagaatagcttgaacttgggaagtggaggttgcagtgaaccaagatcgtgccattgcactccagcctgggtgacagagcaagactccgtatcaaaaaaaaaaaaaatggttttgtatctttgtcaaaaatcagttgtttcttgggcatgtatatacgagcctcgttctaggttccctgttctattccgttgattggtgtgtctgtctctctgccaatactgccacacagtcttgattagagtcacacagtaacctactactatttttattattactaatttattttacatatattattaggtctaatgttagtatattatactagttaaaaatcagtctttacatcaaatagactaattcctgctgctatatattttttcccaaaattgtttcagttattctagttccattacatttccaaatacatttggaatacttttatctatatctataataaatcttgctggggttttggtcagaattgaattaaacgtgtatatcaatttggagagaactaacatctttgttgagacttgcaatccatgaacataacaatatctctctccagatctcttaggtttcttatcagcattttgcagttttcatcacacaagtcctgtacatgttcttttatctacacctaaccagttcatttttttagcaattctagataatattgtgtttttatcttcttggcttattgctgatcttagggagaaagcatttagttttttaccattaagtataatgttaattataggattttttttgtaaaagatctttatcgagttgagaaagttcacctgtgttcctagtggtctgagaatttttagtcatgaatgggtgctgaattttgtcaagcgcttttttttaatttttgctttgattgatattattatgtgatgtttcttttttagcctgttgatgtggtgaattgtactgattgatatttgaatattaaactggctttgcatccctagaatatacctcaccaggtcactgtgtactaggttggtgcaaaagtgcttgccattttggaccatgaattttgaatcattaaaactaggctcaaacacatctgtattaatcaaagtaagaaccattacaatcaacacaattttgccaacaagaaataagtttgtttactcctgtagcataaaaatccgtgctttgagattcgaggaacttttggaaagcactttctgcatcctgctggttgtggaagcgttttccctgcaaaaagttgtcaagatgcttgaagaagtggtagtcggttggtgagaggtcaggtgaatatggtggataaggcaaaacttcatagcccaattagttcaacttttgaagcgttggttgtgcaacatgcagtcaggcattattgtggagaataactcggccctttctgttgactaatgccagctgcagggattacagttttcagtgcatcctatcgatttgctgagcaaacttctcagctataatggtttcaccaggaatcagaaagctgtagtggatcagaccggcagcagaccaccaaacagtgaccatgacctattttgggtgcaagtttggcttggggaattgctttggagcttcttctcagtccaaccctgagctggtcatcacaggttgttgtataaaatccacttttcgtcacacgtcacaatctgatcaagaaatggctcattgatgttgtgtaaaataagtgaagatgacactccaaaacgacgatttctttgattttcactcagctcatgagacacccacttatcgagattttcacctttccaatttgcttcaaatgccaaaagaccatagaatggtcgacgtcgagttctttggcaacttctcatatagttgtaagaggatcagcttctcaattggtcattgttaactcccaatggccagccaatatgctcctcatcttcaaggctcttgtctcctgtgcaaaacttcttgaacatgactgtactgtaggcttattagcagttcctgggccaaatgtattgttgtcgttgatgtattacccattttgaactcaaataagaaaattgcttgaatttgcttgttgattaatgttatttccatagtctaaaataaatgtaaaataaacagcaagtaataagtcattagtaaaaaacataaagtgagaaatgcccattaaaatgatgtataacataaccacatttatttaagaatgtatttcttttttttttttttctttttttttgagacagagtcttgctctgtcgcccagggtggagtgcggtggcgcgatctcggctcactgcaaactccgcctcctaggttcacgccattctcctgcctcagcctcccaagtagctgggactacaggtgcccaccaccacgcccagctaattttttgtatttttttttttttagtagagacggggtttcaccatgttggccaggatggtctcgatctccagacctcgtgatctgcccacctcggccagccaaagtactgggattacaggcgtgagccaccaagcccggccaagaatgtatttcaatacaaatggcaaattccaaccatgtactcacctaatataattcttttttatatattgatgaattttatttgctaatattttgttaagaaattttgtgtccatatagattcctcctcttacactgtcttgtctgatttaagtatcgcaataatgtcaacttcataaaataaattgtgaaacgttccctcttccctattttctcaaaaagtttatgtagaattggtgataaaactttcaataatggccagatgcagtggctcatgcctgtaatcccagcactttgggatgccgaggcaggtggatcacctgaagtcaggagttcgagaccagcctcgcccacatagtgaaaccccatcgatactaaaaatacaaaaattagctgggtgtggtggcgggcgcctataatcccagctactaggcaggttgaggcagaagtattgcttgaacctaggaggcagagtttgcagtgagccaagattgcaccattgcactccagcctgggcaacaagagcgaaactccatctcaaaaaaaaaaaaaaaaaaaaaaaacctttcaatatttgttacaattatccagctaaattatctaggcctggagatttctttttgagagagttgttaaattacatattcaatctctttctttctttctttttttaaaatagagacagggtcttgctttgtcacccaggctggagtgtagtggcatggtcatagcccactgcagcctcaaactctggggccaaagccatcctcccacctcagcctcctaattaggtaggattacaggtgtgcatcaccacaactagctaatttttaaattttttcgtagagatggtgtctcactatgttgcccagcctggtctcaaactcctggcctcaagtgatcctcctgccttagcctcccaaagcactgggatcacagacatgagccaccatgcctggccttcagttttcttaatagttataggactcatttcattatagggatcagtcaagtgatctaattcatgttgagtgagttgtggtaatatgtgtttttaaataattggttcatttcatctaagatattcaatttatgtgtttagtgtagtttgcagtgttcccttattatgttttgctgtgtgatatgccctgtttcatttctgatattgataatttgtatattcttatttctcagtcttgctgaggggatgccgattttattaatcttttcaaatacgcatgttgttcatcgatttctccctgttgtgctgttttcatttttgcgtacttgtgctcttattttctttctcttctgctttaggctgattttgctcttcttactcttgttttttgatattagacctttgattatagatttgagacttttcctcttttctagtttatacatttattgctattacttttgctgtgagcactgctgtagctgtgtcccacaaattttgatatgtggtattttcattttcattcactccaatttctttttctttcacttgagacttcctctttgactcattaattatttaggagtgtgttaattagtttccaagtgtttggagattttcctgttatctttctgttattgattgctattttgatcatattgtggtctgaaaacactttctgtatgatttcagttatttttaatttgttgagatgtgctttacgtgctatataatgtgacctatcttggaatatgtttgtttgtgggcacttgaaaataatgtgtatacttctgtggttgggtggtatggttaataaatgtcaactagattctgttgatgaatgatttgttggattctatatccttgataattatctgtttaattgttctgcccattattgggagatgtgtgtcaaagtatacaactataaatgtgaacttgtcggccgggagcggtggctcacccctgtaatcccagcactttgggaggccaaggcggggggatcacgaggtcaggagttggagaccagcctgaccaacatggtgaaaccccgtctctactaaaaatacaaaaattagccaggtgtagtggcatgcacctgtaatcccagctactcaggaggctgaggcaggagtattgcttgaacctgggaggcagaggttgcagtgagccgagattgcaccactgcgctccagcctgggtgacagtgagactccatctcaaaaataaaaataaaaataaaaataaaaaaataaaaataaatgaaggtgaacttgtctgtttctcttttctgtttcatactctacatattgagcagctttgttttggtgcatacacattcagggatgctatgtcttcttgctggattgtttcttttatcattgtgtgatgtctacctgtgtctctggtaattttctgtccttggaagtctattttatttgatattattaaagacacttctgttttctaatgtttgactaatatgcttactttaatcattttactttcaacctgtttatattgttatatttaaattttcattgtagacagcatataattgggccatggtttttaaatccactgtgcaaatctctgccatttcattggtatattcaaacaattcacatttacttcaataatttatttatatgatttaagcctgccatttgaatagttcttttttgtttgttctttctgttttttatttctctgagttttttctcctgcctttttgtggtttacttaaacaaattttaacatttttagaattttgacatatctagaatttttttttactaaatttcgttatgtaattttttagtggctgctttatgtattatgttacatatacataacttatcacagtctactagtatcctcattttaccatttcaagcagttaaaaaatcttacctacttttgtaccttcactcttacccatttataatataattaattgtcttagatatttcctccacatgcgtttagcactataccagacagtgctctatttatgtttccacaatcaaacataatttagaaaactccagaaaaggaaagtctgttctatttatccatatttgtatgtactgaattctttcttcctttctaaacttccaagattccctcttttgtcttttccattctgtgtggacaacttccttagccattctgtcaggttaggcctgctagttgaaaattattctagttttctttatctaacaatgttttcctttccccttcatttctaaaggatattttctatggatataaaactctaggttgatagttctttgctttcagcaagtgaaacggtcatgtcctttccttttggctcccatggtttctgatgggaaacccactgtctgaatcatttttcctctatagataagactgtgttttttcctgctcttttcagattttttctttaagtttttgtaagtttgactatgatatgctttggtataaatttctttggttttattctgtttgcggtttgctcagcttcttgaatctgtgtcctttttgctatattttggaagtttccagccactatagccactatttctttgaggatattttaagcattgccctttttctcctctctttctgggattctagtgacacagatacaaatgttttattttttgttatagtttcacagttgcctaagtctctgtttttaagtatagtttatttctgttgttcagattaagttatttccattattctttcttccagttcactgattctttcttctgccttctccactctgctgtcaagtacatcctcttagtttttgataatttcaattattttatttttctgttctaaaattttatctgattattctttgtatcttctatttctttgtcaaaacttttacctttttcgtttgtttccactatgcttataattgcctcttggagcattttcatgacagctgctttaaaatctttgtcagataattctaacatctctgtcatctcaatgttcacatgtatcaatagccttgtaaaaattcagtttgagatcttctttctgttttgggtgacaaatgattttcggttgaaacctggacatcttaggtattaggtatgaggttctaattcttatttaaaccttctgttttatctggcttcttcttacaccacgccggccgggaaaagggagcatgccgccttgttactgccagatatggatagaagtagctcctgctcttcaatgaacctccgttggtttctgctaccaaactgacctccactgatatcttcctggcaagaaaaaatggagtagtttgttgctgctcttattgtggtcttcaccagtgctttagaagttgagggatagcatggtagcctcattacagctggacagtttcaaatgttctcaatctccaccaaacctcctctcatactacctcagtggagagggagatggatacctcattattgttgagtttggggtggaagtctagactgcccatttagtcaacatagacactgcatgtagggtaagagaagaatcttgctaacccccggcagggatgaaactcctagattcctgctcagacttcttttacactactctgggtgctggaaggagagggtgttggaataccctggcaaggatcagcgtctgggcttgccactttgcctttgcaggtgtacatggggatgggaccataattctttttgtggtgttcaacgagagcaaaatgatattgctttctgtctttctaggctgcccctttcttgttcctttgactagagagaacagcctttcgttggaacttggtttttttgtctgaaccagttggcatttctgggttgcaggcttcttcagctctgaggttttgatgtataaggtaaaaattttaaatccatgtcattccttgagtccttcagtctctagctagtttttcatcttctctcagcttttcagagtctctttaaatttctttgatatgtaatgtggagagattttagttgtacctagaaggggaattagaaaaaactacgtctactccatctttctacaagtgaaagtctcccattactttgcttctttttaaaaattgtttttaattgggaagacagcatacaattttcacatcagattctttcaggaagttcaacagaattatacaaaactaaccatgaatttagtattaaaaaggaaaccttcagacagagaaaacatctctaatttattttttaatatccattttacttccactttgcaatttccatcggtttgtttcttgacaagtttgtctcttttaggacctgcaacatctctgtttagtagtgagcttttctcatttaaaagtacttactgaaagactcccacatgggagtcacatcagtttctttcactgatgttctcctatgcctatcagaaggcctggcacatactaggacttaataaataatctgctgaataagtgaatgagaactggaaatttaaatttttatgtcaatgaatgtgtcatctgctttcttgttttgctgaatcatggggcttaagtttctgccaagcactctttaaatatgtgcttaggacactagcagatttgtccagaattttgcaatctagaaaaaaagcaattttaattttagcccgtgtgtaaatttttagtttatggtttagaattgcattattttgaattacaaatggggaggacgacatgatggttctcacgtgtgtgtatgtgtgtgtacacattcactcctatcgttgctaaagaaagtcacctgaaggacatggcacaaaaacaaccacaaaccatttttagttatgtttcctagatgcctgaatcatttttcagatttttttctattagacaagtcacagtttgattatctttgaaagtcattgttatgtattgtgcagtgtatgtgtttacacatggaaaaggggcaacattaatccatcatttggggaagacactgaatataatgttaaattttttgcaaacaatcatactttagataaagattctccaattattgcaacatttttaaaaaataaagttaaaggacatggttctttttagtgccgctcagtatgtttggtttctgtactaataatgcttgctttcctgtttggctttaaattctgcttaaggaaattgtgaaaaatttaattcactctacttttgttagaaagtatagaaatgttcgtgcatgggattcattgcctgctagaatggaaattcattggggaggggaaccatttcattttactacctaagagctgttgacacagtccctgcatctttcaaaggcatctttcatgccacgcgggcaaactgtagccagcgaagaaacagaaagagcccttctcacatatgtcagtctcagaaaacttgcatagcagctgtgctaggtaccgatgaggattactatagacccagttgcagggttttatgtggataaagagacaactggctttctcaggggagcactttgttggagattgcagcaatagtgcatccctgctgttgctagaagacattgtgaccatgtagtacaaaatcagtgccagataaaatcagaaagtaacaaaaagcaagaagaaaactcggagtttttttaaatcttaaagtgagagacgaaaacaaatgttctgggcttgtttcattcacttgtaaggaaaaggagacagatgaagggatgcctttaactcagaaaacttgaagggctttcagtcttttcatttgagaaccatttgggtgtgttgagaaaaaaagttgccagagtaggcatgttcagacctttatttgctacatttggtaggaaagattttttttttcccctcttaactacaagaagccagagttttctgtgcaaacgaaacaggcgttgcaagaatcagattcactttggacgactcttcacattccaagtcatcattgcgttaggcagcacaattccatctctggttgatgggcagaaaaagtgggcagcttgccaggtagacgtttccatgactcccagcccccaaaggtgatgcgtttttcagctaattcaatgaagagtgggctgaactttgggtctaaacgagacaatagctgccttcgcagtatcagcagaatggttgatgggagtgcactctacatttggcagagaatcatgtgaccttacgactgagattttgtgatggtgccaacggagacttggaaagcagcaaccgtcctgacttttttcttcttttctaacatggctcagaaaatggtggatcttaatacttgactttagccagactcagcaagcgactgagctttgaagcacaacttcgcctttattctgggtttttggcaggccaccaggaggctgtccctttcacgcctgataaattctgctgcttatctctaaatagaaaaaaaaaaaaaggaaaataataatagaatattgaggcataacaagtgaattctaaaattgtatgtgctttttgttttttttttttgttttttttgccttttctgactggtgatttgtatttttgttttatttatttatttattttttaggttactacctttctgcttgtagaagaatccaagtagttgggtctttttttttttggtttataatgaacaggcatttgaactgggcaaacaggacgacagcagcagtgagcatgagatcattgcattgcagcactgtagcaaactggcaccctgcctttgcacccctttggttcaggagacaaacgtgtgtaatcctcatttctaaagtcagcacagcctggaaggattcctggtctctcccaccttctaccattctgctgccagtgacggcaaggattggtgtagcttctgcgcagtgctttgtgcctggaataccgagaaggaagaaaaagaagacaagcaccctggtccttttctaagaaattacaggcgcccttgaagaaaaaatctgagtgtgtcctactacatgcaagagtgctggaaaaaaaaaaaaaaaaaaaaaaaaaaagagacgctcctgctcaaaaacaaaaacaaaagcaaacaaacaaaaatccaaaccaaaacaaaccaaaaaaagcaaacattggctgtataactacagagacatcgggctttgtaaatcagctttttaaggcaacataaccaaatgagccttctttatttttattatttcaaaccatatggcataattagcaatatattgcacttggtgaaatcgcacctttcatatcaggtataactttttttgttgtttttcttttaaaggctactgttatataaaagggaatccttgaacttttaatttacttttatttaactcattgcccactttactcttattaactttttccttttcctctcttgctctaatcttgattaaaatagaaacttaaggaaagatagaaaaatctctatgaaaaagacaatacatgtttttatgtggggtatacacagaagttttggaaagatattaatatatctgtgctttttgtgtccagtattagtttttgctatctaagaaaagtgaatgtttagacctagtgggtaaaaaaagtaaatctttcatgtgacttataatttgaaatgtgaaagaagaaactttttaaacttgtagaaaagggttatattagaatatgcgttgaatgactgataaataagattgcttttggggaagttatattcaaattatttacaaagatttcagtagaacaaaaataggaatgagaagagcatgttctcagttgctaggtagaaaagaagcttctttcataataatatgctcttttaaaatacattttaaaagaagtacttgtcctagagcagttgcaaaaagcattggaaatatcaagtgtattagaaaaagtacatgcaaacttgttttaagttcagagcaatgtattggctcagcagataactgcattgcattataattattttgtctgtttgtagaagtaaattgctaagcaatttaagcattttattaaaaaaacagttttgcctggttcagtgtgaaaggattagcagatgcattccagctattttagttttgataaaaaatgtttctaaacaagtgtaaaaataatttttaaaagagaatgcttttgaaaaattcagcaagtatcaatgaaaactataatttgcatactaagaattgacgttataatatttcggtaaaaatatactttggtaatctgttatgcttttaaaatcatattttcttatattacaaatatgtagggtaaacaatgaaaaatgtagaactgattaattctgcctttgtgtttgctattctatgaacaattacaggaaattgcaaaatccctatatactgataacattcaaataaaacgttctgttggttattgttcactaattatttacaaaatagctcttgtacctccatgctgcctcagctaatggtacaccaactttcactggcttaattaatattgataaacctgtttccatgtttcaagatccgtttaaaaacattattttaaatgttatttttagcagccattaatctctacactcttaattatcttattaagctccatgccaaatccaaatctcttttcagctttcgctacttcattgtgcaaaacctagtcgcttctttaacagccatcgtcctttcactttcaaaactgttactgtgaaaacaacacgaaccaaaatgaacgcataaatgcaaactatgaaaccactttatatgtcatatgagtagcctgggtggggccctgtgagtcttccaaggctttaaaaaaaaaatactttaaaaggttttgcccattttgatatcgtgttttcttctcgatcgtctaccctcattcccacgatccactcagatgctcctcctagacagcagttgtctgatatttctccttttgtggttgttttagggaaaaacttaaaatggatatgaaaagtgaagaaagtgatcataggagaaaaccatttcaggtaaaaataaaaaacaaagagcaaataagatttactgtttttaaagaaaaacaacattcttttgactgtgttttgttataagaattaatttcatattctttatgagtgtaactgttgaaattttattgatggttttcatttgaaaatgtgtgctatgacctacctttgtgaaaaatttcttgtggtcaattgggcagtttgtgtcccattgaatatatgtctgtgtatccatacgcttaagataggtgcaatacggtttactagaaagctttataggaaaagaaaaaaattatattttcttatttgttgtaccatataaaaggaagtgaaatcaggaggaggggaataaggtcatgctttttcatcttttttacatgacctgataagacaatgaaaccaaaacatgctttcttatagttatggtaaaactaaacccaatgctgcctcttatttcacatttgcatttataaatatatgttgaaatatttttactacaactgaatgtatgattgttgattatttactatagtttttaataattatgaggacaatttaagaataaataatggtttaaaattatgtagaacacatgatctatataaaggctataaaacgtatttatttcaaaatatgcaaaatcactaagcaattagtatgtagtattattttacacaataaagatataattaggaaatgctaagtgattatagatgtgaaatgattaatgattgtacaacttatcattttgttgcagttgagtttacaatcttaaaaaaacgtgtatgtggctggctttatgtttactcgtttgtgtgtttgcttgttgtctggtggtttaaaacattttttagtaatattttatttttgcccaacctgttgaccagatgagagttgtatgtagccatgcattttaagtgtatcttttttgaacaataagtttaaatatattttatttaggaaagaagatatcctatgtcatgtaatacatctggagtataaatgttagtgtggagtattagtaatcatgccattatcgtgccatttagtttagttttatattaactcatccaaatattgtaaattttagcaccattccgactatagacacagatgtatatatttaaggctgataataacttcctgtattctctagctagtgaacaagatcttactgttttatgagaaagttataatgttaccaattccttgaaaccagtaactaaactagttttataaaaattaaaataagcacggtctaactcatacacaattaacttaatagttaatttggttttaattataggctcgtaatactacattcatgcctcacaattatataattcatacatgcatgtatggattcttttttcttttaaaactcaattagaatagtttaattccaaaatatttactattgaaacaaaagcagttcgtgaaaaatttttcaataaactactttttaaattctcatgcatataaatttgtatttagttttgaatatttatgaaggcctttaatggagaatatgcatccttagaactcagcatttaaaacatttatactaaaggatcaatattatttttgactcttaattgcatcagatatttacaacaaattctatattaatagggggcccatgcaagatgttgcccattggcataaacccgtagatccgatcttgtggtgaagtggaccgcacaagctcgcttctatgggtctgtgtcagtgtggtaatctgacaaaatgctatacacagtgccgttcaacaatagttcagtaaaatcctgttaaactccagttgattatatacttttgaagtcattatattttcctttgtttttaatgtttattttaatcattgtctgtcttacaaggcaggcttcaattctcaacaacttggaagcgtttatatcacacccattcaagttcgattccatgtacagtaaattgcataagaaagttgaacctttatagcagggtttggaccaggatctgaatagattctgttcagaaacttcagtgcatactgtagtgcttagtgtacctcttcaacttcagtaagaaaattaaagactaccattggatttatatgtttttattgagcctatttctcctgaaaaaatgaggctgaatgcaattgacttttactattaattgcgactagaactatggcaggttagatggtcagaagacattttacgtgacctatgctggaaacccaagtgtttaggttagtcctatgagaaacagttagcagcaaagtttactggtaaaatgttagaatattatatctatatccttgccaagcccttaggtgtatggctgccatatttggaggagctgactgaagatatgataaggagtttgaagcaacattggaagctgtgtgcatccgggttgaggtagtaggttgtatggtttagagttacaccctgggagttaactgtacaaccttctagctttccttggagcacacttgagccgtcgaggaattcttcatcactttaacctgattgagccaatttgtgtgcaagaaggtaatgtgtcatgagtatcttggatcattgatttgggcctttattacattaaaatgatcatttcagccctattagattattccatttgtatctgcttatgaacaatgtcaaaatggtatttctaatgggttgtcactccatgttcaaacattttaagaaaattgtaggtagtgacttaaattgcattaatattaaagctttttatcatctatagattaacaaaattcagaccttaattttcaaatggatcattggtctatttatattggctgcttagacactataataaaaaatgtctgctagagttaatagctcccatagcacattatttgcgttttccttatgacacatcactttctaccttatgttatggctatttatgtgcttgctgattttttccgcactagactgtaagccccttgagggcaaagtccatgttttatttttcactgtatcccctccaatgccttactcataatgagcactaactatttattggattagtgaatggagtgtaagacctcactctgtgatgagtttctattgaatatttgaatgagttatggcagtggtcaaacatctgagttttatttattgctcctaaaactgtttaaatttaattcctggactgctccgcatcagtaatacatgtgtcgatttttgactgtgttgaatgtgttcattcattctaaacagataagttaaaatttagaagtactttttatctagaataaaaataatagagtaaattcatttttactaattagttcatgacagtttatgatcctacacttagataattcatatttctgttgaatttaaatacctttctttccagatgaatcgtttttcttttagcatcaatttcaactaaatattctattttaagtctcatttaacaatatgatttttaaaaattagatttgtgtcttttgtgtatttccctcgtctcctgccctttatttttgtacagctatatctgttgaataaaccagaagcaactaaaccagaaacatgtcaataaattaataataaatatgtatataaagtataatttgagaatgtgaacacatttttgtttaaaggaaaggcactttataatattctttgtgttacaaagcaaatgggactctttggaaccttagtttgctgtcaactttagcagctgttagtggtgtaatttgtgtagtgaggctatcttacatagatcatctttcagacacaggattaagtagttgttgatgttagaactttaatttaagactccaaatatgaaacatggaattcattaaagagacgtttagatgcaaatatatattaaggacctcaagatactggctatgtggtgctgacctttctagaatgctcaggcatccaaaatatcttaatacctagaacttgctaacaatgtagtgaagaaggaatggctacccccaacacgtagaacatgtgagccttagaaagtgaataccagtcacttcaagcaaaataatttgattggtctacagtagtaaagactctttctctctgtgaaagaaaaatatttgcaaggactaatcaagaagcaatgaataagaggcagtagacatagacctaaaacaaacaaacaaaaagacatgaagagatgaaaaggaaagtgactcatagcaaataggaacaccattgtgtctaatgatggcagttcaacccacggatgaaagaaagggacaactaaatgggtaaacaattgtatctttataaatagttttttccttgagagcctaggatccctttcctatgtgtttctatgtatgtatctcccaatactaggtgtatttatttagaagccaaatctattgatgggccaaatagaatatgattgccaataaatgtctatttccttacagtgtaatggagttaagtgcctcacagaggtcaagtaagatgtgcagtttaaggataatcttacaaaagtactataatgaattgttagaattacagcctcttttatatactatcacctaaagtgaatgagtataatagaagaataattgaagaatggtgaagatgtctctatgattcattatgttagttatgtagaaatcataagaaaaaatctgaccaggtgtggtggctcatgcctgtaatcccagcactttgggagtctgaggcaggtggatcacttgaggtcaggagttcgagatcagcctgaccaaaatggtgaaaccccatctctactaaaaatacaaaattaactgggcatggtggcacacacctgtaatcgcagctacttgggaggctggggcaggagaataacttgaactcgggaagcggaggttgcagtgagcctagatcatgccattgcactgcagcctgggcgacagaatgagactccgttctcaacaacacaaaacaaacaaaacaataagacagaaaaaaacctgcaaggtggaggatatagttagtaccaatgaagaaaatttttaaaacttctctgtaggacaagaacactacgtggaagaattgtatgtttgcctttgattcataataaattttgctactccaggtatgagggctatgtaacttgctacaggtttataaataaatggcaaatgtcagatatagaaattgataggattttttgagaaaccaagatataggaccactgctgatgtcagtaattaaaaatagttaaattatgtctaagaaatcaaagcgaaagattgttcatatagagggcttatgttcagctatggggaaacaactaaccagactgaataatttccttaagaattttaagtggtcaagtttaactgtagactggggttttcacatctggtaacagagtatgacaattcaggaaattattaaatatcagtgaatcatacttcgtttaaccaatatttcttttgatattttggggcacaaagttggatatgtctttatgttcatactggttgatttacctcaaatgctttgtgggatgaggcaggaaggagttttagagtgggaagggagggagggagagaagaagggaaggagggaagaaaagtaaaatcaagtgcaaagcaatcgattgagcctcaccagaaaagtccattattagattataagaactaatgagagaaagtaactatgagagaatcagataaattacttggcaattggactgggtctttttgaaaaacatccaatagtccatgaactatgttattagaataaatgaatgatttctgtaaataataatttagattctcttattccctattatcaaatgctgactaatgagcacaggtgattcctcaagattacccaaatgatctgatacaggattccgtcttcctgagcattatttcacacccatggctagtttctctgctacaggatagaggaataactcctgaggtaacttatcttaactctacctatacttgacctctaaaaccctttgggaatgcttgtgaaagatataccagaagaatactttattcttactttaatgcctactgcccaagcaaaactaatacctgttattattatgtcatttaacatgataatatcatgttcacctacaaatcctttactgattctctaagatagaatttctcagttttgaatcctcaaggcccttgccactttcattcccacagggatttctctgacttctattagtagtatttacaagtgtccaaagggactgtgacttgcctttgtacctcttgtaatgtacatgctttacttttttaactatggatatattgaatcaatgcctgtcgtcttgagttgaactttagatcatttatgggcaatgatgagaactgctacacaccttacgataaacttggtttcagcagtaaagtcatgggttacccaagacatctctagactctccagaatgtattgtcatggtattaggagtattctaacggtgcctaggtctgcagcccactcttgattaagcatgtgatataccagtggaaatgatttaggcaaccagccaatcactataatttgtagtaaatctaagcccctttatgtaagaaatccatgtctgtttcaaactgacagctcctaccataatgtttagcttataggatccattcaccactccattttggtgaatgagcaaaaattttttaaacaaaataaaaaagtgttatatattggagcaattctatatttaagtagacttcttcaaacttttaaagtttagaatttaaaataaattagaaatatcacttttggggggaattctgtttgatgataattcttttttttttttttataagccataattaatatagatttaatgcatttttccatgtattacatgatttaagtacagtcttcaaaagtgaaggagtctttacttgaaagatgttaaagtgtatatgtttgtgactctagaattttctttttttgttgtttttttttttttttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgcctcaataaacatacgtgtgcatgtgtctttatagcagcatgatttatagtcctttgggtatatacccagtaatgggatggctgggataattcttgatctcttaaaattggcattgtcttgtgtgtcccttaatttttaaccttattctatgctatgtgaaggcgtgaattaaatcatatttctctcctacatccaatatctcttaaatcccaattttgtttctcttcatctgaactcttagagtacttatttgacaacaatcatagtcagtctgtgtttctaattactttttatatgtttatatagtatataagaagattagatcatatgctgtataatttgtgtaaatttgtacacaataggcacttaataaattgtgctttattgaaattaaaaataaaattgacacttattaatgataagaaccttagagatcaaatggcccattttccagatgaccaaactgaggcccagtttctttaatgattctgccaaggtcaatctactagttacggacataactcagatttcaaaccatttcagtgacctatccaagaagaaatattttagaattgctgtcattagatttttagttagtactccattttaatgtgtcattaaacaaattttaataaagttgattgaaattagagaatagacttttgtttccgaaaggctataaatcacatagtaatttagcttcaagctcaaatatgatagacatataattaaaatgatttaaaataaactcatcccttcaattatttctttccaagtaccattgcaccctcattcttctaggcaaagagaggaagttatctacctcagttacattctgatatttctcctccttctagaacacttctccaagagaggagagtatggcctagcagttggtggtgtatcttaagcaaaaaggaaaaaaacaaactatatattgttcaatctgttagcactgtgttgctcagaaaaatgaaagttaatattaaatggtaaccgtaactaaatccaacttcaagtttcaattgttcatgccctccatgagataggcaagatattatgtaaggtgctttcacagggatcataaacttaagtaacttctgggtccaggtagtataagccagacttttaagacaaggggaagtaatggggactgtggtagaccaaagaaggcatatttacctttaagatatttcaaaataggccaacgccgtggctcacgcctgtaattccagcattttggggggccgaggtgggcggatcacctgaggtgaagagttcaagatcagcctggcccacatggtaaaaccccctcgctactgaaaacacaaaaattaactgggcgcgatggtgggcactcgtaatcccaactactcaggaggctgaggcaggagagtcgcttgaactgggaggcagaggttgcagtgagttgagatcacgccactgcactccaggctgggccacagagcgagactgtctcaaaaaaaaaaaaaaaaaaaaaaagatattttaaaataactcttgttagtatgaatttggatcccaagggcagccagttttccatttctgatatgaaggtatcagatagtaaagcaaaatttcaaaaaacttattattttgatgaagctaacagcatcttttcataaagttaaactagataatttgggatcgttttactactctcaagtcattataaagttcatataaaagacaacttctatgctgacattgttatttcaaatagatatgtatgttgcatgacagtcgacatggtttcttgaatttaactgactaatgaaaaatattcattcatcaagcaataattagcaaccacaatattattttgatgtcattttaataaaagaagtgtagtagtagtagtaattgtaatattcttggtaggaatatataattttcagtttgtatttgcatataaaccgcaatgtacaaaaaatgaaattcttataattcttatgctcaggtaattgatgctatagatggataaatatatagcattttcaagttagaaaaaacaaaatgttaaatagaatgaagactaagttcaagtattctcatctccatataaagtcgggcaactgagtagagttcaaaagtaaagaaacattggtattgttaattatattttattgtgttataattaaaagaccaattatacataaatctggaattagatcaggttcctgtccataaattttcgatataatttaatccagtgaatctaaatgtgtaaaagagaaatgacaaaaccacttatgaaaacacagagtttctagtagtaaaaaaacatgtattgtcaattttgttgtctgttgtagaagccctcttatttaatataattgggatcaatagtcaatgagttaatgcactcagatattaaaataaattgatcttaaaaacaaatacatacacacaacctacattttatttaaattttaaacacttgattatatatttatttgccaataattttatgtaaaccaagaacttttttttttggtttacgttgttggttacagattatagtcatccttcctttcaataaatcctataatgcatcatatatgatttctaatttttcatcgcgtcatgaatgtctttaagtaagttcaaatccaatgcaaagaaatctaagagcagaattctactttctccaatttttttctaagcttctgaaattgtctttcccacatgttattctatagcattgtgggtttttttaagtgactgaattttattaaatcttccctaaatattcaacttagaggtatagaacaacaattctcattttctttacaattatatttcaatttgtttatgtgatatttaattaaattgtgcaattcggtatatgcaaaactggcataaactggtttgggagcaaacgtaatggactccagggaggcatgtaaaccacttggtgggagcagacatgttcaactgggtgttccagaaatcttgatggcgacggaactgttctctctgcactgtccaaaacaatagccactggccacatgaagctattgagcacttgaagtacgtctagtgtgactgaaaaatgaattttaaattttagttaattttagttgactcaaatttaaatagctacatgtggtttgcagttaaggcagtaggctgtgcagttctagagagtagctcacttgcatttagcatttagcagccaggatatctgttaagaatatcagataatctgcaaagtggctaatggttaagaatactactgtagttgaattaagatacacttaggaaatgcagattgatttggaatgtgtttgttttgctttttttgtttcattttatcatcttttacatttgtctttttttatatttgagtctaaatttagttttgaggaattttttaaactttattcgaaataaggaagccaatgagtaaaacgttaaacactacagagatttacagctctttatgtagcattcaattcaaccgaaaactaatcagaaagtaatgacattccttctcatattggcaaaaaaaaagttcttaattcagcataatagatccataggaaccataggatgaatttgttgagtctttagaacctttgaaatatttatattaatagtttaaatgtatgcgaatgtgcttgtgtttgttttgtttgtttgtttgtttttgagttggagtctcactctgttgcccaggctggagtgcaatgacacaatctccgctcactgtaacctctgcctcccgggttcaggtgattctcctgcctcagcctcctgagtagctgggattacaggtgtgtaccaccacacccggctaatttctgtatttttagtggagatggggtttcaccatgttggttaggctggtcttgaactcctgaccttgtgatccacctgcctcagcctcccaaagtgctgggattacaggcgtgagccaccacaccctgcccaacgtgctggtatttctaaggaaaacccaggctctgtcagattttcaagagagtgcataatttcctcaaaaagttaataataactccatgaggttactgtttaatactttttgaggtgcctgaatttaattcagtgtaaactgtgatagaatcgaaagccttcatttacaaatattgtaaatctatcaatccacatatatgttaaattataaaatgtatacatgttattaaatatgtaaaaattttatgtattgcacaatatataatttatatgtaattaataatacatttataatttaattacttagataaacctgtggaacaaagttgacataagaaaaaaggtagcttaattctttggaaggactaaattaaattggataggtaaaattggtattatattaagtttgaacatttaactctaaattactggacatatcataaaaatgtagactgaagccacacatggtggcatgcgcctgtagtctcagctattcaggagacagaggtaacaggattgtttgcgtccaggagtttgagggtgttgtgagctgtcatctccaacctgggtgatggagggagatcccatctctaaaaaaaataaaataaaatagattgagccatctctcagttttacaatataagtacatttactttttattaatgaataactgggcttattaaagtggtgctttacgagtgaggtttatgaaacataaaaagatagtcatcagtttcatgctaaatgagagaacttgcctcatgtgaaaacatcgggaaaattagaaaactgtacttttatatgtttttaaaataaaatatttgttttaatgtatttgtatgtttccctttttaatcacagttggtccttgaacatcacaggggttaggggtcctcacccccggatgtagttgaaaatttgggtataacttttgactcctcaaaagcttaagtactaatagcctacttactgataacataaacagtcttactgataacataaacagttaattaacatatattttgtatgttatatgcattatatactatattcttactctaaagtatacttgaggctggacacagtggctcatgcctgtaatcctagcactttgggaggccaaggtgggaggatcacctgaaggcgggagtttgggagttcgagaccagcctgacaaacatggagataccccatctctactaaaaatacaaaattagctgggcgtggtagctcatgcctgtaatcccaactacttgggaggctgaggcaggagtattgcttgaacccgggaggtggaagttgtggtgagccaagatcgctccattgcactccagcctgggcaacaagagcgaaactctgtctcaaaaaaaaaaaaagtattcttgagaagagaaaatgttattaagaaaattgtatgagaaaatattccactgctcattaagttaaagtggataatcataaaagcctttatcttaattgtcttcaagttgagtaagccaaagaggaggagggagaggaggaattggccttgtcgcctcaggggtgggagaggcgagggcagaggcaggagaggcaggcacactcgttgtaagttttattgaataaaattcacatataagggaacctgtacaattccaacctgtgttgttcaagagtcaactgtgacatttttaatctatcaactaccaattccaaagacatcaagtaggatggcttccactgcaatagtattagtcttcttataaaagtgagaaaaccagggtcagggagttacacatataaattccttacagccacataaaaggtaaatcccagactgaagcagatatatcttactccaaaggatttgattttaatcatcttgttataatgtctcctgtgacagagaattagaaacttgaaagcattaggtatccacagtaaaaatttgcaagtaaggtttttctctgttttatttagaatgaatgtgcagcctccccagtccaactgaccagcttcctgtgctttcagagaccttttctagaccagtattacaatttggagatccacacaataaaagttcaaggagctgtcttctctttctgagtttttaaaatatagactagcatatggttactaaacctaacctatctaaaaacagcaaatatatttgcttctaactggggatttatcaggttaatgtggtaatatgtttatttgaggattaaaaaaaaattgtgcattatcactcagtcttttaacttcagattatttccatttaaaaattctaagtatttcaaaacatgggagaacaataaactttacgtcacagactacttgagattaactgactaatatttgggaagcatctagataacacagtttcttacataatataggggcccagagaagactccgtttttccttcccccgcttaagaattaagaatcttaagaattaagaatgattaagaatcacttgaccctcacttactgttttccttcctgctctgggttttaagaccttttagaacaatgaccctcagctgggcatgaatgggaggggaatgtgaggcgggaggtgggtgtggttggaaaagtcttcaatactattcagattttacctctgcatgggcacccatttcggtaagaatccattctgtgatattatttcagaggcgaaggaaaggctacccctccttcaaaatagcttggtcttacattgcacatttaacttagagcacaatgactatcccttgttctccagtaatatagtggttgaactccaccctggagtcaggatccctgagtttatagtgagtgtgagtcaacaccaactataaaagctgaccttttcatcagtgctttgtggtctttatctgtaatgtgaaaattataacaccaatgttgcaagattttcgagagaattaaaagattatatgcacatgacctttagcaaccatgatgcctagtaggtaataggagttgaataaaaggtaattactatcattaggcatattaactgaggcagtgtattgtttgcttataaaggttccgcatgctcagtgctgcagaatttatataggcagagccgtcgcaagaaatgttgggaggtggttttttttgtttttgtttttgttttttctgacggtcctcttatcttcaaaacatcatggcactgctgcctggatttgctggtttgaataggccacatttcagctattcttctcattgtcaggtcatggcaaataataagtctcaccttttctttctgaaattgcattcccgcttcattcatctgaagttaattcttttcttttttgtatcatgcttattttgcaaacatgaacaatcttgtcactaccgtgtatatgcaaataaagtgaaatgataaattgcttaagtgtctccgtttttctatctgtagaataggggtcataatcccttcctgttgcacttttccagacagttgagaaaataaaaacacgtaatgtagagaaaagagcatcagtattctcataaatagaaaattaagccatttagactatgtacaggaagtttgataagtagacttccagaaaagaagtggcaaagtattctttaattgttcattccctaagaaaaagctgtctctctcaatcttttgatacctctgtctttctttccctctctgtctacccgcctctgttctgtgtgcctagatcctgttaatattttctctcctctactattttcatgtctgcatgtaattttttttcatatctagccaagtgccaaaataacattatgtttgatatatcaattaattttttaattaaatcaattaatgagaacagctagagaaatgtagattttagttcacatgaaactggagggtactggctacgttgtaattaatatattaatagtttgtcagtcttggtcattgtcttggtcagaggatgccataggaagctagatcagtcctgtaatttcttcctattttttttttttaaataaagccaattatttccatataagctaggtatgcactccatacctgtttgataagattgattacattaaacatttctcacaggaaaatgagtctatattttatgtttaattttaattttcactttgtagaaactaagttcagtgtgccgtgctgatccagtgaaagcatgtgcagtaatttcattgtaaccagttttcactttagatagtggccaggagatgtttgaaccgggttatgagtttgtgaggttttgagcatggttcttccttctttccctaggctggatagagtactatagcagggtattggatggtttcccaaagcaggataacttccagggaggaagcatcacagatgtctgaagttcagtggtataatgcacttttattactcctctgttcctggcctacaaatctgcagaaaagacatatgagggcatcaatactctccaagaaatagcatcttttttttacacccccttttttttttttcttttttgagatggagtctcactctgtcacccaggctggagtgcagtggtatgatctcggctcactgcaacctccgtctcctgggttcaagcgattctcctgcctcagcctcccgagtagctgggattacaggtgtgtgccaccacacccggttaatttgttatttttaggagagatggggttttgccatgttgaccaggcttgtctcaaactgctgacctcaggtgatctgcccgccttggccttccaaagtgctgggattacaggtgtgagtcaacacgcctggccgaaaatagcatcttcatccacttttatctaagcttaacatctattctgtttatggtgttgtcagagatttggggaactgggataatgagtttgtccatttcaactgttgattattttactaatggctatgaaagtgctatgatgttcagagcaggtcttttcacatttgatggataattttgggagcagggaagatagaccttatttccttgcttagagtttcatttcaaaacatggattttagatataggactgccagtttagcaaaataaaaatatgagacatgcagttaagtctgaattttagctagacaataaataattttagaatattagtatgtccaatatgtcatattgtttttactgcttattggaaattcaattttgactatacatcttctatttttatttggcaactttatttagatagtattttccataatgaagtgtcttactcctgtttctccatatatttccactcacagtaagtaaaggaatagaaactaacgaataaaattcatgtatgaaatatcaggggaaaaatacaaaattaaaataatttatattaaattaatagaaaatcaaagaaaatgccctttttctaaatgccagaatcatataaaatttgtattaggctatgtttattttatatgattaaacaaaatggtttagcaaatggcatttaataaacaaaagccagtttataacattagcataaacttcagaggattaaaaatttgttacagtgtctaagccatatttctggtgggtttctgtgatattctatgtggtctttgcattagttactacagagtatttttcggtgcaagttctggagggaaagttttctaagaaatgaacattcccattaaaggaatttcactcttcaattaatagaaagcatcatttgtttttcacatgatctgttgctatcggttcctttaaaatgtttgttagctttttaaacatctgttgctgtaagaagataaatcttacacacattacttgtgctgtgtgtttgccccagagtcaagtcaatgttttacatggcgcctagagatctgtgataacagctcactggctgtgttcctgcacgtcataatctaaccctttcccgtatcctgatctcttccttcctgaccatcctcaccatcctcagctcagtggctctccccatttcctgttttgctcagaccctcaccagagccaagctctccagccaggtcttctccctacattcatcagccaccgccctccgtccgcccggctgcggcaattctgtcctacttttgcagcctgaaccctgagcagagaataacaaacctggaaactttcatagtgtcacccaaagtcacaccgcacacacatgtgcttggccacgtattcacacataatgatttttttttaatttaatgagggaattgttatgtaaatttggcaccatttctttttgttttatatggatggacatgagcacttaaagattaagaggttattttcggccggtcgcggtggctcacacctataatcccagcactttggcaggccaaggcaggtggatcacctgaggtcaggggttcgagaccaccgtggccaacatggtgaaacctcatctctactaaaaataccaaaaattagccgggcttagtggcagacacctataatcccagctactcaggaggctgagacaggagaatcgcttgaacccgggaggcagaggttgcagtgaaccgagatcgcgccactgcactccagcctggtcaacaagagtgaaactccttctcaaaaacaaaaaacaaacaaacaaaaaaacccaaagaggttattttcaaacttgcatagtcacacgtcaaggcaggaacccaagccctgccatcaaatcaaagttttgagatttaagttcttcctctgtaatacaggatcgtatggtcccagagttaaaatagaacttaaaatacctagctgaagtgcttatagttatcagaaaatgtttgtttcttccctgcaattttcactaaagtgaagaagacgtgtgagagacaatttgtgagacctaattctggttgaggctaagaattccattcgttttccagtcactgacaaatttatttaactcttttgcttttggacatgtttctttgtcacacaaggttgttctgtgattatatgtttctataatcttttcagtttaaaatttgacttaataattagcatatagcaagtcaagaattttttttttttgcaagtcaacaattttcaaatgaataaatgcatgagtaaatggtggtatcccttgctttactacaaataatacaaaatattttgcaattgtttaatgacacatttgagagtgacataggtattttattgtttctgtggatttttgtttgtttgtttttctagatggagtctcgctctgccgcccaggctggagtgcagtggcgctatctcagctcactgcaggccccgcctcccgggttcacgccattctcctgcctcagcctcctgagtagctgggactacatgcgcccgccaccacgcctggctaattttttgtattggtagagacggggtttcaccgttctgtgggtattttaaagtaaactctaggacatttttaagtagttggatttttaaaaattgtcccacatactaagttacattttttacacagttgcagcacagtacttacctttgatcctcgtttgagcctctggctttctttagcctgcttaagctctgtcctctctctctttactcttctattcaaagagtagtatgtattttgtaaagattttgtaatcttgcctactaataaagtttacattcctcagcaggagagtaaggaactttacaatctgcttccaatgcaccaacataaactcgtatcaggctgtctcttcatctcctgtgtccaccatttcccagcccctacgtgtacaccactactttatatttcactcacactggggctccatgcaccaacgtagcacatgagcagtggtgtgtagcagaaggcaagaaagtccataagcgtaggctttggaatgaggcaatcagagctcaaatgtagctgtagctgtatcattttgtagctacacggctatctctgtctccatcaacctcacttgttttacctatgactaaaataatatgccgggcacggtggctcacgcctgtagtcccagcactttgggaggccgaggagggcagatcacaaggtcaggagatcgggatcatcctggctaacacggtgaaaccccatctttactaaaaatacaaaaaattagccgggcgcggtggcgggcgcctgaagtcccagctactcgggaggctgaggcaggagaatggcgtgaacctgggaggcggagcttgcagtgagccgagatcgcgccactgcactccagcctgggcgacagagcgagactccgtctcaaaaaaaaaaaaaaaaaaaaaaaaaaaaaaaaagataataacacagtatagagctcctataggattaaatgatataacataatttaaattatgttatgaagtgtttggtacagggaaggcaataagtgtaagctattgtgatacaataaagatggacatgaaagtttttgcttattttggttattctgtctaaaaaggtttgaattacttttatttgtggcaaaattgcataatctttgagatctgctaacctttatattcacattaaaatgtaattaataatgattatgttgcatgccactctcttatttcttagttgacattgtatcttttcctagtctgacttttctccagattaacactttaaaaaaagtcatacgcaatcagagtaaagggaatttgtcagtcatttactccaatatcctcatctaataattaacaaaactgaagttcaaactcgttgataactaacatatttttgtgagattgttgtataatgtctgccttcgtagtagcctgtgaatttccaaaaagtagaaaaccacgtctgtgtgaatggcttagtatcaacaatgattgatatagggtgaactctcagtgatgaatatttctggaataagagaatgttgtggaactacttctggccagacttcttaattgtaggctggtgctttttgtgttatactatgtttcttttcactcaaacctcatcttgttttgcagattcacttattaaaaatctctcctgaaagtttttgtatatcctggagtggcccacataaaactgatcgttatgagatccaggaactctcctggttgtataatgtgatcacctgcttttggaggtctaatgatgcatacccccagagacagaccaaggaaaaagtaaagctgaagcaataacttatttatttacttacttacttacttactttttcctggctaagatgatctagacatgtggatcttctatccttggcatcaaatttggtgctcctttcttgtgtctaacaattaattgcttcaaccttaatttcacagtagtaccaattttgtgttaaccttggctgtctgcagactactttcattcttgttgcttatttctactctttagtaacccggagagaagcagaaaagtttataggacttgtgttctataaatgagggaactaaggctttgtctgaattcagataccctctctgccatcatactgtttttacgttgtgcagttttgcctcccttcactgggttggggctgccttagaactatggttgagctaaggatgaggtggcctccacctgtaatcccggcactttgggaggccaaggaatgtggatagcttgaggtcaggagttcgagaccagcataggcaacatcgtgaaaccctgtctctactaaaaatacaaaaactagctgggtgtgatggtgcatgcctatagtcccacctacttgagagactgaggcaggagaagtgcttgaatctgggaggcagaggttgcaatgagccaagactgtgccactgtactccagcctgggcgacagaacaagactctgtcttaaaaaaaaaaaaaaaaaaaaaaaaaaggaaactgggcctcagtttggtcatctggaaaatgagccagatggtctctaaggttcttaccattaataagtctcttccaaaaatacaaaaaaattagctgggcatggtgccacacacctgtggtcctagctactctggaggctgaggtgggaggattgcttgagcccaggaagcaggtgttgtagtgagccaagatcatgccactgcattccagcctggacaacacagcaagactctgtcttaaaaataaataaataaataactatggctgagatattttaccacagtgaaagaaatctaaccattctccccgtaagttctagcaaagttcctagagcagccttgggctataggaccactgaattcccatgctaaagtccccccccacaccaccccccatggagtcctgaagttaaacagctggctagttcaaattgtggtttagggctgcaaggtctgtgtttagtaattagcacttgaacctagcaataaccttcaatgagtctctcattttcctgctctggggagagaaaaaatcaacaaatacagactaagtgtgctctagtgtcagatggtcagagtctggatcacttgttggatgtatggaactaaacaagttctttcatttctttgtacttcagatgcctcatctgcaaagcagtgtcaatctcaaagtttcttggaaagggtaaatgaaattataaatgtaatagcacggggcctgactcataggagtgctccgtaaatattagctcctaatcattattattattcagtacttggcaaaaatcaagttacagtttcatctaatctgagttgatcacatgcatatttttctttatttaaaaaaaatttctttacaaacatgaaataaatggggtggaatttactttcttcatttataactagatgatttcaattaatttgattttcagcaaaagcatctttatcagttttgaccatgttggaaactgaacacagcccatctggcattattggcaccacattggaaatgtatataatcttatggtgaaagtacaattacaagtgtaattctgtcttgacgtttgcttgaaattcatctcttttgggttatatgttaataatgagggcggaaatttgctgtgagcatttacatttgatctagacacaggctaatattgtttgcctgcaatatatttaacattccaaaactgctttctgatttatcttatgtatcttaaaacttacagctattaattcttctcatttttccactaaagctagcataccacaaagcaaaatatgaatatattctataagttgtagaatttcttaagatttatctctaccattggatgaggcatcataggcccttttcctcaaggaagtggaaaatattctgtgccagtagttgtcagtaaaagaggatatctgtccctaaagtttatttcatatgaatattaatattccttatatggccatcattttcagtgtttcattttccaaatgcactttctaaaaacatgttaaattatggtccattactaaccactaatggatgattttatgactgaattctgcaccaaaaatgattatttgctgtgtgaggacagatttgcaaaacaagatgtggtagcatttaaacggccacttatttttagtagaagactgccctgactgtggcctaaaacttagatttccatttcatggcatcattatcttcagacccagatgggcgtctcttgcacttaaggagcatgaggaaaaccaatttgattaaaataagctgtttcgtatcattaggaaatttggagatggaaaaataaagatttgtgtaataaatgtatgatctgaagccacgttcatcctccaaggtaattagcaattctgtatttgcaggaaccaggaaggcaacagatttttcttcaggatgctctttttgtggaaaattgtgggtataatacttgatgggtcaaactgaacaaagtgaactatttgatttatggtgtgaatattatgagaattattctgtagttcatttcttcccatcaattcatgaaatcaatcttttaagcttattttgcaatcaaaattcctaaaaaaaaaacctaaggatcttatcttataataacatcacaattctttctatattattttcattcaatatactgcatatctagatccattaaagtaattttaaaaatttcttctattgatatggctacagtctatttcaaatattggcacctgaagataattgtgaagtcagcaatgattcagcaaaacagaatttaaatagtgctgaaagcataaatagtacccaaggagatgtgggtcttttctaaaaaaatttaagatctaggatttacccatacttaaataaactttaagtatttattttttaactaatctccactcaaagctccttcaaacgctgtttccatgttgtttacagtgtaaatgaataggataatgaaaataactattaaataaaatagaggttaagtgacctgcctgcagccacagagttagttcatggctatgccaagaatcaaacttagattttctggtttgcccatgttcttttaactgctttttttgatgaagtcaaggctttgagataactgacctcaatacatagttcagtatctccgtttgtcagcacaaaatacacttcatgctattgtggtgtttagataaaatatacaaaatataaatgctaatgagatgcccaatatgtgatgatgaatcgcaaaaagcaatataatgtgacaaatatttattaaatagctaattctgtcaatataaatatttctgaggagagtattcttttcaccttcagaaagccgtataataccaacaatttatgaggggtgaaaccaatcaatggtaaaatactttcggatttttaaaaactaatttagtaattggcaatatattcaggaacattattaagttggtttttttgcatcacaaagattgaattctgctatttctgttgatagaacatgtactaaatgataacactgattaataagggtaagttaggtaatttttagaagtgcggttccaggaagaaaacttcctaaatgatggaagaaaaaaataagttaacttagatatttttctgtacaatttagaaacagacgaaccacagattacaaagcatgacttcatgatctctggaacaaggctatgacatgaggaatttaagaagctccccttacatacattgtatcagactcttgcccctccctccaggaccttgtgctgcctgttccattgcctgaaatatttatgtgacccaaagaagactgggtcttagatgttagattctccaagaatcctccccagactcccggtgtctgtgggaaggatggtccagtgcgccccttagagtctgtactttgtcagcctttgtcacaatataatcagcacatcgaatgctgtgggctgtttacctggcgtcatttcgctggagagacaacttcccaagaacaggaactgagtgtccagtggtctagctgtgtttcacccatagtaagtgatcaactctgattgaatgaagggatactcaagttaactagtccctgtgcaagtccctatagcgtagagtcacaggctctcttttgaagctctttactacactttatttcactcagatgacaggcaaggaaactgagactcaggcaggctaagagatcacacaccataaatggcagagtgaggaaatcaagcccattctctttccttgcttattctttcattcaacacatttatgctgagcatcctctatgtgtcagacattatgtcaaagctgagaatccaaagataaataggttaagatttcctgaagctccctgcctagtcagagatagactataaacagtaattataattcaatatgataagggctttgacagaaccatgtactctgtgctgtagaatttctaaagaaggaatcagtgtctgtgcatattaaatcgctccattttattttaatattcttttaatactcttttatgtctgactttagtatataactaccctcatttagaagaaggtaggcaaaggcctattcaatttaatgaaagtttaaatattgcaatgttatttctaaactaattagttttcatgattgttcatattgtacattaatttgaatatcaaacagaagtctaatagttttaagtggattgcttagaaaaattagtattgtcatttatataacttggaatccaaagaagattctctgaagagaatgatcataagcacattaccagagtagatgagtgaagaactggggtaggagtacactatggcatggagatggcttagggtgaatcaggaactagcaacacccttcgataaagcagctgtgtgcctgagttttgatcagaagttcatctgctgttgttaaagatcttttaaagaataactggatgaatagttattttacttctcatagttgcctggattaatagatttattttacttctcatagtttttaaattattcttcagacaaaagaaaatagccatggcagattatggcatttaataatggtaattcaaaatattttatcaaatgaatttaaaaaaaagtaaatgtcaataggcaacatcagtttatttccatttcttaataatcaccaagctattcaaaccgagagcaatgagaagctcataaaaaacaagccatgaacctaccaggaaattcgagggaggggatctccctttatcaatctgtgtatctccagtgctaagcacgatggcttatctcatatgtggttgaaaggcttcaaccacaacaagaagactcccaactgaagacttttttttttttttttttttttttttgggatggagtctctgtcgcctgggctggagtgcagtggcatgatctcggctcactgtaacctccagctcccaggttcatgcgattctcctgcctcagcctcccgagtagctgggattaccatgcccagctaatttttgtattttcaatagagaccgggtttggccatgctggccagactggtctctaactcctgacctcaagtgatccacccccctcggcctcccaaagtgctgggattataggcatgagccaacacgcccggcctaaaacttcgttctttaaaaataagtaaacaaaccaaaaattgaatagacataaaccaaataaggataaaagaaaactctgctttaaaagcctaattccaaaaacctatgagctgcaagtcatcagtgattaaaagctaggaggcacactggatgtttaaaagtagtacctgtgcccttctaaagcagccaaaccagtgaaaatgggtagaagccaataagggggcattcacccctttcaagcatctaaggaatgcacattcaacacattccaagcacacctcccccgctgcaggctgctcaggccagtggccttccacctctagccacattgcacaaaaattaataggaaaacaaaagagatgcctttctggatttgtcacattgcttcacactggtgcccctttctcttgtaatcaggataaagaaagtctctgccgggcggggtggctcgcgcctgtaatcccagcacttgggaggccaaggccggtggatcaccggaggccaggagttcaagaccagcctgaccaacatggcgaaaccctgtctctactgaaaacacaaaattaactgggcgtggtggtgcatgcctgtaatcccagctactcaggaggctggggcaggagaatcacatgaacctgggagctggaggttgcagtgagcagagatcacaccactgtactccagcttgggcaacaagagcaaaactccgtctcaaaaaacaaacaaacaaacaaacaaaacattgcagccccattgtgaaaagcaggaatgtgtgaacccaaaagttctgacaaaggaagtggacggggcagcaggcatagatgaggtagcccgtgtagaaaaactccagaatttgctaggtattttttttcttctggtcactatttagaattctttgcttaaactcccacttccaacttattgtatatatattgtcagctcaagaatggagaagaaggtgtttaactctagattagactacccaacctgtggtttagtagggtaaatagagttcataaacaaaaagccctgtccttaccagtgttcatcaaccacctgcttggactaattgtactatgtcactcgtttttactatacagatatctgtggatatctctccagaacttcatgtatatgtaagtgacttgctcccaattctttcacattttatcaatatcagctgtgttttgcttaaaaaatgagccttacctaactaaaatttctactgtaataaagcaagttaattgtagtgaaatctaattatctgtttactatgatttcattataaatcttgtgggtttttttttcttacattgtccttatgtattagcacctgtggtaagatatattgatcacagtttcatcagataggcatactgcttcaatattgtttgaaaaaaatctttatctttcagcttcatattctaggaggaaccaaatgtaacatttacttttcattttgattgcatattaacttgaggtcataatcttgctttaacaatccatctcttctaattatagatataggaggtatggaagtatgtgtttgccacagaacaaaccctggatatatttccatcttgcttataaaacttgtctttatgtaaatgtttaaataagatattttaggataaatggtttttatcattgcctattatgtcattttctattaaaagtgaattttatacttaattgactctgattcttaaggcattaaattctagtccattcttcttatgagatagggttagtaaaataagttagttttatgggatcaaaagctacaaacaggctgggcatgctggctcatacctgtaatgcctgcactttgggagactaaggcaggaggatcgcttgaggctagaagtttgagaccagccagtgcaatatagcaagacccctgtctctataaagaaaaaaaatcaagtaaaaatatctagaaatatactttccccaaaatgtgtatatttccttatgccattctgccaattaaaaattgtcagttcctggatgttacttggatggtgttttcctaatactaaagctacttattctaggcatttgtgagttttatcattctcaggaagaataaattaactcaagtgtcttgcctttactaataatctatagaagatataatacattacaaaacgagatcttcaaaggcaatttatctatgtctgtgggtcagcggagagacatcaagagttaggagggagtgtacctgtaacattctgaataagattttgatgttaaaaccaatgtggcttgttagtccgatatgtcccctctatgccactaaagatggtgcctactccttaccactcatacttgccatattctttacccatttttacttgactttgtaccccaaagttcctcttgtgggctatgtgtggaatgtgatggcttttaaaaacataaattggggaacaagtgtgaaaataaatatatggacaacattttaaatattctaaatattataatttaaacatcaaaagagttattgtatatgttcaagattgaaagttaaaaagtgaatataaaattctaaataataataactatttcaacatgaacctaaaactgtgcctgttgaacagtgcatagaatattaaatagaattagtaaagagttacttgagtagtgaattacatcctgcattgtcagcctatgatatctatgtccatatattttgtagcctagattcataaaatgtatattttttaaaatcttaacacttttcatcaaatggaatgatttgtttttaatttgattatggatcaatttttaatttgattctagagcctacttaatcattgctttaggttcttaaatttcttttatagaacataggtgagcagatttttagggtttccttttagatggttctgaggtttctgtccatgttcaatactatgagtttataactttacaatattcttttgtcacttgcctaaaagcaggtttgttatttttctttttctcaaggaaagctttagagagagaatctagatcttttaaatttgaaaggcattcatgatacccagttacttcctctaatgattgactactgttgtgaaacctaatgttaatatttaagaagtggaaaattatggattgtattgtaaaatagtcaattaaaagaaaagtatttttgtgtgtgggaatctagcaactttcatcccataatccttaaatcaagtttaatgtatactaaaaatatcaagttttactttgaactattaagattaatacaagactcccatgttttttcagattttcccaatcttcaatgttctaagggatttactctgagactacttaaaccttaacatttttgatgttctcatttactcactggctgttaaaatctcaaaccttgtgcatcaatactaggagctcttacttaaaatgattaattgtaatgttttcaacagtgagcactaatgtttttccttgggggaaaaaaaatcttccttatatgtttatgtggttctcttgcctctgtagttgacttagattaatttctttgctaattttcttgttcagttggataaaagaaagcttcgggctttgtatttcttgaaaaccaagaaaagtaagtattacacataagaaaatatccaattttaccacttcttcccttgggcagttgacccgtgtgcacatgtgcatgcatagcaatcttttgcaatgaactcagtttatatatgagatctgtttttcagtattgtagaaagatatctaatctatttgaaaatacattgtcagcacctagtgttccaaaacatagattgaatttagtgtgggaataccgcatagtattggaagaaaagtaattaaaatcatttagaaattgttttgaagaatgcattgctgcaaggtgtcatagccatataaacatgacaccaccatcttatggaatgtacagaaaaggggtgtctcttgtgccaaataaacattctttaattaacgcttcacaatatgtagtgtgaactttcctagtctgtgtttatccctcctggggctgctacttttaatgcctcaaaaactgttgcctgtatatattctctttctgctggatcttgggatgaagaattgattacaggtgcattttctccttgaatctgtctaataagctgaactaaaactacactaatacaagaaagcaacaagaaaggtcttcttatgatgaattagttgtgcttatatacatataagagttagtgagggccacaagaataaactggcacaataaactatttgtatttgaacactactatttgtattttaatataataattactttgaattccataattaatatacctatacgtgaaacgttttccgctcagcaaagtcatagactttggggggaaaatgttattttattttattgtgagggtttgaataggcattttgctattcattatctatttgcagggaaatgacaagttttcaaaatgaaacagtctttgttacctgtctcttttgaaagacttactctcatgttgtttatttaattgttttgttggcattaatcttgcttttttttaaataatgcatattccttttaattatgtctacttatttaaataaaacttttaaattgtgaatagctatgaatcaccatatccatataactagaatatgaaaatcttaaaaaattaatgtgctgataattataatattcctgtttcttgcatttgttttacattaatacacattctgaaaaagaggaaatgcttatcttgggagtggcttaagttgttttgggcactttttctcagtgatagtcatatattttggagcagccaaaattcatatctctttgccagtgtacagacccaaaatgtcaagttattatgcactagtagaaggacatattttcttcacactttattaattaatctatttcgtgaatttttcttttcaaatgtctatcactgtaattatctttgcttataccaaattcagtttcactggattacttagaatgctgatattcaaatagttttttgaagctcagatttcaggctttgttcagttctacttacagtatttattacgattaatcattattccacctgcctctgagcaccttttacctagtagtagcagaggtgagtccagtctcgtgcaggaagaacaaggatgtgtttggcaggtaagctgattagtgagtctacatcaagtgattgagtcaacagttcataccaacatagctagagcaatgctttttgaactatgggcagctgtccttcctcttgatgcatgcctctttaatcatttccagcattttcttttccatttgttattttcaccagggaagagagagccttataatattagtctgttatgttagctttccatagatgtacacattatttaaatcatatgtaaattagatccatccttcaataaaaattttaaaactagtaaatcatctcctaataatttttcaaaatttaaattactgttaatttcagataaggctaataggcaatggttttcttgttctacaatactcttaacctagaactaagccatgttctctaataaccagatctcaaggtatatgaattttctttcattattggaaacatggttagagtgacctaaagctccaacttattattacatacatggaacccaatctagctagttctttcttatttaaattatctttccttagagccctttcattgttcctcttggggaggacttaaaggttttcttggttctagtcacaatcagaaaatatataatgaattttttacatataaggtgaaagaagtagaggtacattattgcttgaaaacaaggtgtagcacatttttaaaaattactatgttaaatagaatcagcatatgtaaacagaacaccagctaaactacccccacctaaactttaaatgaagacaactgagtaaaatgagtaagatgttttctgacgtaatcactgaagtctcaaaggaaaacaggacagtcacaaaattaccaggtctgatgagttaactacttaaaagtgtgattaaaagccaatggaaatgataggaatggcagcaaaaaagcatcctgaatgtagaaatagaggtacattcaactggccaactggagtaggatttctgttatccaaggctgcgttaagtgattaagaatgcacactagaaggcatggttttcacattatctcaacacatctgctcagtggatgagtagtggatgatatggaggttgtctggtaatcttaaatggaagaggatataagccatgaaacaggagagtgaggaatgtgatagaaatatgtttgaacctcacatgttgttaagttctgaagcccttaggaatttcatcttttaaaattattattatgttccattgttatttctcctcaagaatagactgtgacttttctttcttatcttcatatttttaaaaatagtctctaacacgttttgtacaaaatctctaaggaaattttagggtttctttaaattcttaactcagtatttttcaaggcaaaccattccgaataaaggaacacaacatttctgacatatttgaagtatgtaaaaactctaaattacgtggatcctaatgaatcatagttgcagtttaggtagctatcctaaaaattaggaaggtcaaatactacctctttgtttggaaattccacctccgtgatttgttcatgatagcctttttgtgagaagggttttgactgtaaagaatgaatgaatgagtaagcagtttttattaaacaagctcaactttgttctgttgctgctgtctctttgttgttgtaatgtatgcttctaattcacgcaataccaacatgttttccctctcttcaagaaacaagctttactaaaatactttcacttctaaacaacgtgatacatatatttgaaattttctttgagttaatagaggcctactttagagtgttgtctagaatattgataaaaatctttttaagtatcctcaaagctgcctgaacaggggatgaagggtagtcagaaatagaaatatgccttctattttctcatactatttattgagtattttctaaataataaagggggaaagaagatataaatattatccaaaagaaatacgaaggagaaatgcttgacgtgatggataccctgtttaccctgatgtgattacacagtgcatgcctatgtcaaaatatttcctgtaatccataaatatatatacctactatgtacccataaaaattaaaaactaaacaaatttttccaaggtatatgggcgtatactttcactttacagttgtagaagttggatgcctgaggtttggataaattactgctttcacaagtcagattcctttaaaactggttggggattttgagaatgcatccaatgtatctgctcctgctctagtgaagaagtcctcggctgctgctactcaggacaaaatcatcatggtgcatggaagaaaccagtaaaaggacccgtaaatattagatttttctgacttgttcacttgcctcttcctccttcccataagtgtactcttttttttagggtctatgtgcaagcagttttttttaaatataatcataaaagttgctttttcaaaggagtctaaaatgcatttcatatttgtcattgttttctttaaatctagaactcttttggaagggatatgtaacttgagatggcattgttatagtttggaaactgtattcatctgcttcttcaactcaaaataacagtgccttcagatcctgaaaacttaactacttgtctttatttatttttaccccactacagcttatgtaccgtaatcaataggagttcagactttatcctcgtttttgctgcatttcacatcttcaaaaatcaacaactctgtcaaagaattccagacacataaagccaagtttaagaaatagtcatgaattgggatttttttttctccatttaacaaaatttactttaaaaatagcagggaaaataactccaaatcaatctgttacaaggaaatgttattttatgtttgtatggcgctttttgttttcaatggttttaaagttgcaaaattgatgttccattccacggtggtagtgtaatgcattttcaaaggaagaaaccgaagccttgaggtgttaagtatcctgtctgtagttgcacaatgaacatggcagagagaaaattagaactcagtttctaagttttgttttctttcatctgtctctctttcacatattaaattctcaaattagaagtgtgatgtgctttcaaatttaatttagacccctaaaaaatactttttctgtgatacatttatgcttacttttctatagtctaagtgattattttcaaaaagtttaaaaaagtagttagaaatatgaatgacccaggaatgcaaaaagaagcctccagactgatagattttattctggtaaaactaaaacgctcctggaagttttgttataaatttttttccaagaactgactttattcctctggaaatgacatcatgatgtatcactaagtggtctactttgtcatgaaacttgagactaccacatgggatagaatatttaagttcctgaacttcttaatgacttaagttttcttgaacattaaggtattcagtgactactctcacaggcttactagataatgaaaagtctaatctttagctgaatcttcagtcatataatgtgtagtcagataagaagtgaatagacaacacaatagttaagtaatgagccaatggaaaaatgaatgaatgaaactgacaagcaaagacttgaatgaattcatattagatattatggttttatgcttgatacattatagaattcaaataaaaatggaaaatatctctaggatatcaattattcagttatgccaaagttattcagctgctttaaatcattataaccttctcacttctacagtgttatacaaaggagagaattcaaatagaggaaaaagacacatggaaaaaagtattcattttaacactatacatttgatccccaatatttttggggggtgggggggacggagtctcactccgttgcccaggctggagtgcagtggcactatctcggctcactgcaacctctgcctcccaggttcaagccattctcctgcctcagcctcctgagtagctgagactgcaggatcgtgccaccacacccggctgattttttgtatttttagtagagacggtgtttcaccatgttagccaggatggtctcgatctcctgacctcatgatccacccgcctcggcctcccaaagtgctgggattatgggcgtgagccactgtgcctggccatgttcccaaatttgaagccttagagattctcaacatttgcgaattcgttaaacaaatacattcctgagatgaaatttttcacagctacttaaaatattgattagtccaatagtaacataaaagaaagaacatgagctttgagatcagaaaaacctatatttgcgtcctctgtcacttgcaaaatgttccaaatataaagaaactcctggaatctgtgcgcactgttagtttctttgtagaatcctctctgacctgacacagactacttatcctatggtgtactgagatttaacactgtgcttgcagagagaccaatttaattttgggaggtaatctgactgaagacttaagaaaggaatgaatggaatcagataggccacaatcaaattctggccacttactagtggtaacacattgggtacattacttctttgaagctcagatttcttgtcaataaattgctaacaattaaatactgtttacccagtggatgataaaatgccattatatgtactagcaccgagctaggtatggatttggtattaactacatagtaattgttagcattgttgttgtgtgtcttatgctaatctaaaacttttactcaaaaagattttagtcggtcatttatgcccaaagtattacttcttagtacaccaaacaccctgtctgaccaaacccccaatccaactgcctggccatttttcctagtaacattccttgtataagccagcatttttgcagttctagtcatttcccccaaactgtgtgaattcccagcctgagcctttcctcctgctcagcccacagactatgtcttttctccctcttctagattttcctgttgaacagtccttttccttcaaggtttaactcaagtggagcttcctgctggaagccttctataaagcactcagtatttactgtctttttctcctgtgcttttatagcactttgcatttgatagaatgcttcacactttccatagatcataatttctatatctgactctctaccatatattaaacttcttgaagacagaagctatttttcccttcatttttgtaattcttttagcaacttggtaacttgtgctcagtggatatttataaaatatatgtcaaattaaattcaagtgactgaaagctctagaaataaccttgtgtaacccttcttgacacagatgtgccatttgaagtgcccatttgaatatgattttttaaatttttacatattgaattttcacatacataaagttggttctaaaaggctaaaagtactggtatacttgacacagaatctctcccccctcacatttcattttaatttattgcacagatagaaaactaatgggtacaattatatggatataatctttccatctgggctagttcatgaacaaagcatattaggtaatttacaagctatatcctggcttgcttaaaacagtatctgtaacattttgggaaattttactagttcaagagagggagagataagtgaattgatttacatggtcgatttggaagacttatggatcctctggaaagaaaataaactcaagagttttcaaatataatgtcttacaattctctctttagaaaggaagaaattgtagttctttaaaactgattaactatgaggatggtaagactgggggaaaggataggccaaaacttggcctgaacacgagtgtcagctgatcttgaaagagtttctaattttagtgtaattaaaataaaaatttttaatagcttcacctattgccacataatattaattaggcctccaaagacaagaaaagctcctctatgaaccacttttacgggaatctctgtgccctcttagagtttcaagtgtgcgacttgaaagatttaaactacaaaattctgtgtgtatgtgtgtgtctctctctctgtctctctttctctctctatgtgtgtgtgtctgtctctcacacagacacacacacagacacaaacacacacacacacacacgtaattttctcccaaaaaatttacacccaaattaatggcgtgttcctttttgacaaagactttggctaaaccctcttgtaaaacattctaaaatggctagtgatatctacctactgacaaggagtcagtgtaatcaataacccaatcaaacactcaaaatgcttaactataatcttaggatttttaaatatcctgatcattttcacttggtacttcatattgaatgaatatcaccaagatccaacttgataggctgggcgcagtggctcacgcctgtaaatcacagcactttgggaggccgaggcgggcagatcacgggaggtcaggactttgagacaagcctggccaacatggtgaaaccctgcctctactaaaaatacaaaaattagctgggcgtggtggcaggcgcatgtaatcccagctactgggaggctgaggcaggaagtcacttgaacccggtaggcggagatcgcagtaagccgagttctagccactgcatttcagtctgggcaacagagagagactccgtctcaaaaaacaaaacaaaacaaaacaaaacaaaaaaaacaaagatccaacttgatttaaaaaaaaaaaaaaaaggtggggctggggctggactggccgggcgcagtggctcacgcctgtaatcccggcactttgggagaccgaggtgggtggataaccaggtcaggagatcgagaccatcctggccaacatgatgaaaccccgtctctactgaaaatgcaaaaattagctgggcatggtggctggtgcttgtaatcccagctactcgggaggctgaggcagaacccgggaggcggagcttgcagtgagctgagatagtgccactgcactccatcctggagacggagctagactccgtctcaaaaaaaaagtggctggacttgccagagttgggttggcaaagaaaacccatccaattttaaaatgatcaaggtcattgtagactttgaaaaatctttatttctgtttgtatacaatggtgaacttaaacaattcgtgagaattttgcaagtcagtataagctccaattctccttcttcagaaatggagaagaacttttttaatattacatatttttctttaaataataaagagacaaattaattcctattaaatcttaatttggaagtattgtttgattgtggaagattctagaatgcatgttaagaatctgattttgtctatgagctccttccctgtttccatggttctctccagttctaccttccaatattctcatcatgttatactttatccaaaaagactaaacttttcacccttctctgaatatacattttcattactttccaccaaactacttttaaatatctaaaattctaccactttccaaggagacttatgtgctattacaaacaaaataggcctataaacaaataactaatataaatgaaagctgccttaatcattacaaaaccattattaggattaaaaagcccttactaaatagtaatcaaacataattttagagctagtttaatggcaattatatttcaatacatactttaaaaatgtatgttgtgtctctttaacacctagctctaagaaattaaaattattattatcacaatattttatatatatgactaacaaaaaactcgcaatattaataaaatgccatgtttctctactctttaaaaagagttaagctaatatcaatgtactaagtaataagagtaaaatatgtttgcaaatggacatggaatattcacctatgttagaactttctccttcagtctaccagctcaaatctatatgagaaacctatttttagttcttgtaaaagaataaagcctggcacccatttttagtttagcaagctcatagtgacacatagagcatttttctatagcgttttcatagcatatgttgtatggatcacatactaaatatttattttgtaatttacagtctagaggaattatgaaaaaagaaactgggtaaaaaatattagatcaaactttgataataataagtttaagtaagaaactaacttttgaaatttacatgttagctgggcatatttcaagatatcatctgttgggaaacacctaaaacaagttgttttctagtaagatttaccccccaccgcccccgttttttttcttttagctgaattgttatgtttttttctgaacaagtatttgtgtgacagtttctactgctactggttcagctgacattctatcataaataataaaaattcttggatatttttactcttacaaatatagtaaatcttcacttatattaatatatgtaaattgtacatatataatatatgtaaattgtacatatataatatatgtaaattgtacatatataatatatgtaaattgtacatatataatatatgtaaattgtacatatataatatatgtaaattgtacatatataatatatgtaaattgtacatatatatgtaaattgtacatatataagatatgtaaattgtacatatattatatatgtaaattgtacatatataatatatgtaaattgcacatatataatatatgtaaattgtacatatataatatatgtaaattgtacatatataatatatgtaaattgcacatatattatatgtgtaaattgtacatatataatatgtgtaaattgtacatatataatatatgtaaattgtcatatgttacagatgctttagaaacattgtatatttgaataactatacatcacaggaccacagaattctggaatacgtgtgaattaaaatcattaaaatgtttataaactgaaaactcagtcatgtgaatttacttatgaagaataccttaatatcacagtagagaacagagtatgggagatgtttaattttagtccagttttaaaacaatgatatgtttaactggctgcttacttttaaatgatatattcataaagtttagcaatgttcattcacaaattttccctgtaaatttaactttccctgcactaatcaacaatataagttagtagactctagttacttctggattgcttggttcatatcttaaaaaggagagatttttttaaatggtgtttactcagaaagtaatgacatcttttaagggagaaaatttggcattttacatttcagaagcaacagtattggcagatgtatatcaggattttaaaaattccttgcaaaaatatgcatattccagccagctggaaacaacatgagacctttattctacgggagatctagagaggttgtgtgcctctctagatccccttcctccatatcctacagtgagttaataaccagtggtgggcaagaatgcagatcacctgccttttgggtaggtgtaatttttcattaccttgaaagtcttaaaggtaatcctcgaatatcgaatactttattatttattaaatcacatttctaactgttccagaccatgtttctatagcctgtgtacacagtgattgacacataaaaatcagtcacatttaacaagtgcatgaacttaaacatctttatatgaatttaatatctaattgtgaattgctactcactatgtgatcgccatctgtcattcagcatgaactgagaactatacattatcactatttattggttcaatctttttcaaggcacaatgcctaaggaagttactgattattgatccaccgtaattgaaatgcccacacatttgaaaaaagatggttaatgaaaataacttgtttccctgtatattgatttaactaaagaaagtaaaacgcatttgtgattcgcttgtacattgttttctaaccacaataaaaactgacttgagaagtttgtcagacgtatatatttatttcacaaataggtatctttttgatggcttttgtgaagaaaatgatgcattggaattgatatattgtgcataatataaatgccaataatacacttattcttctagatttttatttattctaagtttatccaattattatgtagggctgtttacatcaaagattgactgcctctggttttgctctggggagtcttagcttttgccctatgtacagctctgtgcttctaaggcagagcaaaagttgttggtgctcgtgggtttctctccttcttgtgccagaatcacttccctgcaagactgcttatggaacattcctaacccacatttgtttctcccaggactctggctcctttgagggatttgccggcctagctggatggaggtattccagctctgctttctttcagataatatttctattcattttatctaaataaaggattatattagctaaaaacgattgaacttgagatatgagtaggtacctttctagtatctggttttgttacaggttcttatggttgattttctgcctgtaatgtagtattttaatagaaccgtctttaaatagcaacaactcctaggaaaaagtttcgaggaaacctatgcaagctttttgaaagaaattggcatttaagtgcttaattcagttagcaactcataaagtctatattgactgggatgcaaatagcctttataagcattaatttcatgacatgaacattttgtagaagtgaatgtagagtttgtagatccttaggcaaatcttcactgtcagttgaatttatttaaagagcttttctggtcacctttgaacctcaatgatttctccagatgtacagaagtgaacaatgtaaaaatcttgctgtttcagcagaactgattccagctggctgggaactggatctgcaagtcattggttacagctgtgtttcgatttatgtgatggttgaaaaaataaattacccgattagatggctggaaagaggactctttgtttagcccttgtgtggggactgaaagtgtttatggtgctgttttctacgcagtctttgcaaagtaagctggacaaatagacttattcaatgcttctaagaaatgttgcatattcagctttaattcttctactaaagaaactgtatttttttatagtgctgtcatccagcaaatgttttaaaggtctagcatttaagagaagcagtacgttttctgtcctactgagcactgcatttagtaattgaaaagcagttttcttttgtttaatgtgtactttaaaacatgtctttgtcaggcacgggaatgggaatacattttctcttaaactcaatactttataatagcaaagtatctgaacataagttctaacttaacccttttcctcagtgagttatggctagtgtcacataagagaaaatacattaattaaattgctgtataaagaaatatagtcaaacattactgtaaaaaattaacatgcctgtgggccacttaggctattaggcttttgaatttgtgaatgttttatttgttataaaagtaaagttttgtatggagagtttggaagagcgttaatcagcatataactttccaggctagtaaaagtcaaaatgctaactcttggagctttggtatacagagcctaacaaaatacctccccaaagagactaatatactaacactatcttgtgtgaggagttttttgtttgttctattgcattatttttttaaggtaacttaacttggatcattctgtttcctaagttataagctgtcagaaccaatgaattgtttacagctcacccagttccactgtggcattaaaaaagtgagcggtggctctggaacagatagctacgatgatatgtcttcatcattattttctcaaacactgatttgctaaatgatttcaatattttttggaaatttatttttttctttaatgctttctaaactcctgaaaagggcccacattcttcagtgaacttgagactgaggccaagcacttgactaggtgtcacaaggtctcctaagttcagtagcagttcagtgtggggaacacccaggaatgtgttatattttccaagaaaatagacaattctttgctatttcctttcttaaacagctatatattatggaatttaaagatgcagaataaataagcataatatatctaataggagacaaaggtgggattgatctgtcttgaattgaaagtcagttttgctatgttacgctattttcttgatcaatgaaagtataccttctaacccttaacaaaatcaatacaattgattggaaaagatagaacaaagcatgagaatgcagaatacacttgaaccttcattattcagaaatatttaaatgatgtttataatgcttagaagcattttccactaactccatgtaatggaagcttctttaaccaagattgaagacctgagtaatagagtttgagaatatgctatagtggcatccttcatagaataacatggtttttgttttttttttttaagttaaactcatctcacattacttatacttctaaaagtgagagcaatttctattactgagcatagagatagcaaagtgaaattcaatcttgaaaataaagtatataaattaatatgaaaaacttagaaaagaaaaaagtatctataaagagagagcactttttaatttaaaataatttactctatattttgtgctcctgctaactgtcataattagtagataaagcattttcttttcttatgaaaagaaccctacaaaattagcatattttttacatgaaagaaaactctaaaaatctagaataaaaatgattatacacagtcagtataataccaatccattaataactttattccccttcaattaaggagcacttgaaaaatgaatattttttgaaaccaaaaaagatgtttttaaagtttttgcaagttgatagagaatttttaacctatgattcacctgtttttctggtttcctttgtattccaaatttcagaaatccacttaaggaggttttataaactatatatcttatcctgacaaattttaaatgccttattaaagctaaagtgtgtctattagatcaatgaatcctaaaatgtttttttaatccacattggctaatttttgcagtcatccaatgaaattatgaggttttctccccagtgcctatgccataactgtgtttacacatttttaaatcttagaaaattactatctagttataaaatgaaaatactttatatagtatttcaaataattaaaaatttcagtgggaataaagtaatctacataaaagatctagtataacattttgaagttgccatattatgcagctaatgtgaaatggtacaattttttttttttttttttttttgagatggagtctcactctgttgcccaggctagagtgcagtggcctgatctcggctcggtgcaacctctgcctcctggctcaagcaattctcctgtttcagcctcctgaatatctgggactacaggcgcacaccacaacgcccagctaatttttgtatttttagtagagatggggtttcaccatattggtcagactggtctcgaactcctgacctcaggtgattgacctgcctcagcctcccaaagtgctgcaattacaggaatgagccaccacgcctggcctgagatcatacacatttttgaaattcagctactaggtgagataccacagggatataggaagaggctatgttattagctttactggggataaatgttactggacagttattatgagggttaaattagataattatgtaaacagatatctaaatagcagatagtaattaccaggatgtgtttccaattgtactgtccttccattgcacaggatttagggctaaattgggctttggagataacctagtcctctctcctcattttaaaaataagagaacttaggttccaagagttaaatgacttatccaagatgatagacattattaattacagaattggcactagaaccagtttttctcactcttagatcagttatttttctactttctcacttcgtttcatggtgttgtacatggcctaccatatggaaaatagtacttttctatagttacgttacttaaaacataaatttttattgatcctgtaccataatattcacagtctaaatacaacagtgattctgaagtcatttgaaggcttctcacttatattcattcttaaaaagccaggattaattattttctctctcacctgttaggaagcacatcaacccagcagaaacattacttattagtatgtacaatatggagaactattgaaaaatactcttccagatttgtgtgtgtatatatatatatatttttttattttatttatttatttttttgagacagaatctcgctctgttacccagggtggcgtgatctcggctcactgcagcatctgcctcctgagttcaagcaattctcctgcctcagcctctagagtagctgtaactacaggtgtgcaccaacaagctcggctaatttttatatttttagtaggatgggttttcaccatgttggccaggctggtcttgagctccttacctcaggtgatccacccgcctctgcctcccaaagtgctgggattacaggagtgagccaccgtgcctggcctcagatttgtatataatttgttagggtataatttttgtggtctccaaattgccccttattatcattccctgccttttccctgaaagagaaacactccaccagcatcctcaagacctagttgttcctatgtgtggttgcacaacaaagttcacatcacttttaactcaagaccttcctcaagttcctcttcttgctctgttccctcatctcagtgtcatctctgtagtgtgctttgaatgaggtccccttgtggatactggtgactaacagactagactggaaagtaggttgtacacttccggagagcagaagaggggagagggcaagaggaaagaaaacagggaagggaagccatgaaaaagagattgctacaatgaattacaacttttttgtattactaaatgcaagaatgaacattagatttttacatgccaggatcattcctaaaaggaggagaaatctctgattatttgtttttccatggtagttgtgatattctacacttacatatatcaaaagaaagagaaagaaagtaatttcaggttggcaaacctattgcatcctggtcataaagtgcctgaatttaacactgagtcattttcttgtccaaatacaaaaatcttgaaagaaaatataggtcaagttttttttttccttgttaaaaaccaatgatctctttcatcgtgaaccttttaaagtaataactcatataaatttacattttacattatttaatttggcttaaaataattattagttctagaatctgatttgtaaatcaaaattgtcataccaaggtacacacacacacacacacacacacacacacactcacaaacacactcgtatcatctgggattttttctcagttaattctgtagaaaattcctaaccagggctgggagtggtggctcatgcctgtaatcccagcactttgggaggacgaggtgggcagaccacaaggtcaggagttcgagaccagcctggccaacatggtgaaacccccgtctcaactaaaaatacaaaaattagacagtcatggtggcatgctcctgtaatcccagctactcacgaggctgaggcaggagaatcacttgaacccgggaagctgaggttgcagtgagccagatcgtgccattgcactccagcctgggcgacagagcaactttccatctgaaaaacaaaaacagaaaaaaagaaaattcccaaccagttcatcctagtccacaagaatctgatttttgtctcccttgtcctttaattactcttccttgtctcctaaaaaaaaaacaaaaaaaaaaaacaaaaaaacagttttgtatgctcctaactgctgattgctccttattttaactggatttttagaaaagacttttttttttttgaatttttgctactcacactactattacatcacttctttattgaaagcagaaatatgtaatatgtgttgtttggctctaaaaagagaatgactgtcatttctggaaaagttagacaagtaaacacctcatatttattcggagactttagcttgagtagtttttttgtgtcttctgatagtattgttatcaactatttcaaagttagtatctatataccctttttccttaagtaatcatgcatatttccagactattagtaaataaaaataatagatactcttcagtcaaaagaaattctattttagatcttcaaataaatcaacatagtttcattctcttaaaagagacttgaaagaaaatattgagatcccataatcaattatgctataaaacttttcacaaggaaaatttaagtcaacagtctcctataaaactttctgcagggttggaaatgttttatatccaggctgttcaaaatggtatccaccaccatgtgcccttctacacatttgaaatatggctagggcaacagaaaaaaaaatgaattttcactttaatttaaatttaaatagctacacgtggctggtcacagcttattggagaatgcaggttaagtaaaacaaagaaaaaatgcaagtaataaacaataaattctgcacatccatgaattttgagtcaaaatttgaactgtagttgattttttgtcttttgtcttctatccttcttactccaaatctcactaaataatttaaatatgatccccttcttagcactgatttcaaatggcgtttataagaaataaaagattcctgccttagtagtcaggtagaaggcaggttgtattaaagtatttcagagtagtcagttattacttcctttaactgaaaatattttttgacattaaattcatatctatcttacttattttttagaaagttaacagaacaaatctccaaaatcacaaaaatagttgatctagcaaggcaatacttgcattatactacttaaattaaatgtaaaacagcatcaaaattttactttgtaaatattttagccatagtcaaagtataaactctgatttagggatgcttttgtattgatgataagatgttaagaattagaagagaccttaaacctgtatatatgacagtggtaattggactaattgattgcaacatcttctttcaaataaatattgatttaatcaagtctgcattcccattggccttaacggaagtcctaccagaagcctgtgcactcggatctggctaacctctatctggatataaatattttaaatgcatggccattcagttctaagtatgaattttttggcgagtatttattcctcttgattttctaaattcctcagttaacattgttatgccttctgtaaagttaaggcctgtgtgtgtgtatatctctgtatgtaatagagagatagcatggattaggggaaaaaaaagttgtatttgcatttgttgtttctgattcacagagctaggagtgcagtgttcatgtggagtccacagagctggaatatcagtaggcagttgctgtaagcacatgttcaattattaaaatagtcaacattttatgtctgatagccatagcgaggtcatgacattaatttatccaaagtattgtgggcaactgtctagaaaaataaatagcataaaggacacagatgccagagaactaaaaaagaaaaaaaaaaaaaggtgggtctgagcaaagagagattaagagatgaccaatttatttaatccacatagaacaggaagaagtcagcaggtgtctcaacgttaatgacaagtattttaagctatgctgcacatgagttaatttttgctttagtttttcattagattctaagcttgttgaatactactcctattcttccatgtcagaaacttaatttcatattttattgttgcttcaatgcttagggattctttgctacctgtttctttctctcctttttcattcttcccttccctcttcccatttctgtgtttccctttcttcttccctgttattattttccttcttgcttttctctctcatgagagtatattcttaattctgtttccttctggtgccaacttctttttctatttttattcttgcgtttgagaggtttctttttccttttgctttcaaatcaggagcctgtaggaactgatcttagagatacataccctactaccgatgcttctatctctttataggttgtgtgatgttttctttggaacctctgcgaatggttgtccttcttgtttgttgccacagatctgttgccaatctgctaccttagttgagcctgcagtgccgcactgcatgctgggatctgtctgtgtgagtaaactgaaatttctacagcaccagacagcattagagttggcttgagaattgccgtactttgcttccctttgtatgtatttcttgtatgctgccgagtcactgatggctagctctgtctggcaagtaattcaaaaatgctgtttatgtagaaaggaaaggtagggactttaccacactctgtcattaaagggagcaattgaagaacaaaggaactgagtaaatacctatatattgccttttgtgttgcgaaacactgtagcacaaacacatttgtgttcagccaaatgttttacttccttttgtaataacgcatatagtaggttgtctccacatatgtacaagaatccatattttatttaaacgtatatagtcaattgttcatatttataggctgcaaacatttctcaatctcaaagacttttacatatccactcccacacagctatttgttattattttaaaagttcttaaattaaaaaaaaaaataaaatatactaatatctctgttggttgattttattaagcaacttaggatttcaacacagtttaaatcatattgatgactcagatcctggcaggtcttacaattcctgtgaaatgagagcacagctaataaaaatattaagcaattacttttattaaaatcatagggtttttttcattatcacatagaaatgattgatctatacagattggtctcactcatgtgtcttttgggctgcttgggagcttcatgtagaagtggaaagtcccctttgctcttccttcgaccaaggtggggaaaatgaaggcatagaatacaatctagggctattaaagaattgctggcattacttctctctatcacgtgtgagcctggctgcctgcttcctgaggtaggggatccaggatgagactgtgccggagcctgtttccacaactgcatttggagatccgtcttattgattagcgggggaaaggggtggggatcaggagtgtgaggtgaggggaggaccaactgacgactggctcaatgaagcacaagacattttcttccggaaagatgtcaaacaactgagaaacagccagagaggaagtagaaaggtggaaaaatgaggagaccctggaagaaatgaaggcatttcctatgagacagccttggggcttttttcttttctttctttttttttgcttccatcatctgacctgcaaaggctagagtgacagcgtcatgcaaatgctgcagtccagcaggtctgggagagggtggatgctagactgtgagttaatgttaatgatgagcgcagtgaaaataccagccgctgccaccccctgctcacagaagcgctctgagtcagcatcagatgctttgcctcgcctctcgctgtgtatctgtatgcctgtgtgcgcgcgcgtgctcgctcgggcatccgtgtctagccgaggggagggggtggcgtgtgagtgcgtggagggtaaaagccagtcagtcagtgagaagcaaaggtacgttggagagcaactaaaatctgactgatttccatctttggagcatcagatgtattccctaaggaggatgggtctccgtgatgggggtggtataattatgttaatgtcatttttatggaggggtgagatttttcattctgataattggttgaatgctatggtcaaaaattgtaaagccatattcagttttagggaaaagcatggacttagatctaagggctgttttattttttcgctttttgtgagtgctgcttttttgtttttttggtttttgttttttaactatttattttaagccataagtgattcagtatgggaaatcaaatgataaacagaaagagatcttatataatgatgcattacatcatggagcagaatatttaaagtcttacaaggcagagtaaagatctggacagggggtggggggtggtggttggaaaggggtgtggtactagggtggaggaggggggccaattaccaaatattttgtgcagtatagctttccttgcagcttacttggaaatggatgattcacctgttctacaggaaaacattctaattctttccatttttttttttttcctcctcttttcccttttaagatcaaccacctcagaagagccagattccacttctgtggccaggacttttacattatggctggtccgattgttttaccctgcgttctatgctactaaaccttggatcattcctaaagtacaaattctgttctcgaaccacaaacaaggctaaaagatcggaggaaattcagtgaatatacaggattggggttgtgtatttttaaaagtattgagctttataatgtaattattcaagaaatagaatcatggtttttttatgatgttgccagcattttaaattacatgtttattaagtggcattgctcaaataactacagagtatgcgtggaaatatttgctgtctgaatagtttggagattcaaagagaaaaatcaagcttcagaggtattaaattatgacatgcagaaaagtttttgttttgttcttaactgcaacggtatatatttaaatccgatttaaagtattatatgtcctgggcccaccttaccagttgtgctgtatagcagtgtaatgggaagcaaaatttcaattagggtcccattaactggcatataatccttctttaatgtaatagaggctatggtgttgctgtacaaatctgctagaagcagattttaacccatgtttagtctctttctttggatctaatggaatgactcttaactgttcattgtctgcattgtttctcatattcttcattattttaaggtctggaattagtctataaatggtcgtcgtgattactcagctcatcctaacttttatatatcatatatatttctactgaagtattttaaatagtatttagaggtaaaagtctaagtgaacccaactgtaatttctaagctatccttatttctggaagaagaattctaccgcatcaaaccagacttttcctagtccctgagaccctaacttgtgaggtattttagtaacatcacaagtcaggctcttgggacctaggcggaggggaaccagcagctttggaccttattgattgtctgcagttaccaccagaacaaaagaacatacatagattctgcctaggagaaaagaacaatgcttttctttatcatcagcaacgttttcaccatgacccatccccaaaaatactattgtcagaaactgtactctaaagtgattacacagttgcactgaaatagcgtttgtattataacgatcatacaaaagcaatataagaaacctgtgtaagaagcaaaattaaaatataagtgttttaaaatgcttcttttggtgcattttaaggtggctagtataagaggatatctcttcagttaatgaagagaggggattatatttataacttttcatatgcattgaaatatatacattagctacttaaataaatcctgtatgcctccatataactatggctcagactatgtcatatacagctataagcatgcttgaggcctagaaataacatgatttacaatcttctttattgaccctattagattttactaccgatttaagaagaatgctgttttatactttgtatttattgccagggcttttctgagtcttctatccaaccaacatactttatatgtcttaacaattctaacaattattttgttacgagagtccaagagtgaaagtttcaccaataatctgggaaaatatgtctttttaaaattttttacagtttactgtgtacatatcatgggcctacgtgagataaaacagtaaacgccacctatgaagtcaaactgctttgactagcaactgcatatgaactgcatagttttagttttataagaattttagctttatcggaggtaactattccaaccataagtaatatgtcatatttgaaagtttaatagccattgccacatcagatatgtctttcttggagatagaatcagtatgctaaatctatttaaaaattttacaataatgttacaaatatcaagattcaaaatggagatgacagactttccttaatagaagcaacaaagtggcttcattcttttaactattgccttagatgggtgccataaattatgtgtcttctgcattgttaaaataaatttatgaatgtattttagaatactgtacggagtctttgttcatctttttaaaaatttcttataatacctacttgaaatattacagaatacaaatcatctattagtcatagttattaaaaattactataacaatatcataaacatacacatctatataaagcatgcagaatatgtttaagcatgtatgcacactgtacctattcagattctttatttatatcatctacttcatttatctagaagttctgaaattttaggtgtgtgtatgtatatgtataaatataagttttaaagctccaaatgaaaggaggtaatataaacagtaaagagctttggtagtatttatcttttatttcttttgacctcattctcattggaattgagtattttttaaaaccataagtttcttaatacaaagaaatctatgtatgtgtgtctacatgtacacagaagcttgattacatttaatagcaatgttcacacaatggatctgaaagtacttcttgtaaaaaagaatatcacatacaagtatgtgtttactaacatctgttttaacatgatcataaataatatctgtgaaaggttccatcaagttagttccaaaacaatgtaaggggtagatgtttattggctatagtgatatcagatataggttattcaaacgtgaaaattttttaatgttatcatattcatgaaccacactatatattaacttctgtctcataaaagaaatataccaaaactgaattgagaatgcagtcatgtttgttcattttcaccataaacatataaaatgttttttactgataatcctgcacaattggaacttctctatgtaaccctcctatatgaacagtctttcaagagcgtcattgacaaagcttttcttttacttcataaaggtgtatatagatttaagtgggtgactttgcttatgtaggctactttatgctgtatgtgcatagacagatgccactttttctgcatttctatctcagctgtcacaggataatattgttttagggctttatgatatgatttggaaaatcagatcatactaagcttaaaataaaaaggagagatctacaacaaagagcgagaaaatgatgtgtgttgcatgcaaaaaaaacagtgatattaacaattcgatggcttcctggttgggagaccagcctgagccagacgcatatattaagggctgtctgctgccgatgtgagcttgctcaatgcggtggaaatgaggaatcatctcctttctgacaccagcttatttgtacattttaattttgaaatagccaatcactgttttacataaatatactaacccctgcctgattcattttctttcccatattgtttgttaatttactgtgaacttcaagttcctttttttggcaaaaaaaatcatcattcaacttcaacatctaccaaagaccaatgaagtattagcttttcttttgtctcttttgtattgctctgataatattgtgatattcatgcttttaacttttaatctctgtaaggaaaacatcaattttccaaaatagcattttttaaagccttttaggatccatcaaggaagccactctggaattttgccaaatctaaatatgattatatttcatttcagggttcatgggatcaatatctttttcagtataaaagtcccaaacactttagtattccagtggagctacagaagaggtgtagagatattcttaaatcatttaagcattaggctacattaatagtgtcttgaagagaaataagtatctcaggagaattatagtacaagttaattactaatgaaattagaaagggtatgttctgccttaaactcctcttcaaatggacaggctggtacatgtgcctaggcttggtctaatacaccttaaatatataaacggttttacaagctgtcatgtttggatgagtttgagaaaagcagtatataaagggttagctaacgcccaaattttcttgccatttacacatgcaatgcagcctacatttctgtaggcagcaaatgcaggcatcattttgattgcttgaattcttttgtttaattttttactagacatttaacttagcactcaaatcccactgatcccttagagactgcatttggataaggaaaacaaagttcctaatatagagaagtttaaaaaaaaaaaaaatcctgggcccttgtaaacatttgagaaatagacttttagtgtagcgctgcaaatacatatttagagtgcagaaacttaggtacctttattatctatcatcatcctggttttcttatctttcagtgaccaactatagagtcggtcacatatttatttcctatatgtctttatttcttgaaaggtttagtaaaaacagtgtaaaaattgacatatcttcataaaatgattcacaccatttcttcaatgagctagcttcaattttcattaaatgttgcttttctccacgtctctacatgttaaatgtaactttatgaagtacattagcagccaataatattaacttgtatgtaatagtttacttgtaggaatttgaaagcaggtggaacttgaaggtaattgagattaagtgaatttaagattaaatagcttcattttatataaacagttaatttcatgcatattttatggacaacttaaaagtgaaaaattctgataaggtgaactaaatttttcattattgatataagtaacgtgactttaaatctgttaccttaataattaatttctaaacaaacaaaacaggtataaaaataatcatggactatattcattaggtcaagtaaataagaataaaaacttcctaggttttgtcttggccatataaggtctttgaggtgttttgggttcttttgtgttgattgatagatttaactttgcctctcttctgagaagtttctccctctttgtcaataggtgtctgatgatttgtgagcctcaagtgactactctgtggaatcatctgtccttgcctttgaattagctttccctaggccatgagtcaacattagtagtttatacatccaaattggtaggtctttatgaaattcttctatgtattcgttctagacatataagtgaagtataagaaattatagatttacattgtggttgtttttacagcttctggacatctttgagaaaatacttgggtggcattgaaacactagccaatggaagcatttgattttgtagaattttgaaatgtagtgccttactcatagtacacttcctagtcttgggggtgggaagaccagtctgtagctaacttattactgtcttatacatcatgctaaagcccagcctgggcatttgtaaacctcggggaggtttctactttagacaacagtttttgttgagggattacaccacagtcagttccctccatttctccctctcttcctggcccccctcccacccaacatggagccttttcaactcttcaaagaagtgggaaaaaaaagtagactctttattaatggcagaaaacaaactggctgctgtacttccgaggcagctctctaataataaagcagagtaggcactgcaacaaagaattcttgaatgtactaaatatatagggaagcctatttaaattcaccagaggggcttagaggacaagcagcagaaagtttagaattcaattcaagccatgccagaaaatgaaaatgtacttaaaaaaggatttctgaaacaattgttcaaagaaatgtcaacttttaaggttctttctagaagaatgaaatttgtactctaatttatgtggtgactttttcaattagagaggaaaagtgattaacagaatctcaaaggaattgtatcttatgtttaaagaaaacgtgttttctttccataggatgttctctagtgagggccacctagtgcactgactaaaaacaaccaaatatatttatgggacaaacagataatgtatttttttttttttttagcaattagacataacaaatgctcatcttactttgacagaaaaatattcaactttatattctttctagttcattttctcacattcagctctacgatttaaaatattttaattgtaactctgaaagagcaatttgctgataaataataggactatgtgtttctaaatttaagagataaaaaagtgatccctaccttatctcttagtgattgagtcaagaaattatcgttgcccattatttacctatctataagacatgtgtttctataaggaatacccacatctataagaatatatattttattaatcacaatgttcactttctttataaaaactgcttataaagatcccagcactttgggaggccgaggtgggcggatcacgaggtcaggagatggagaccatcctggctaacacggtgaaaccccatctctactaaaaatacaaaaaattagccaggcgtggtggcgggtgcctgttgtcccagctactcgggaggctgaggcaggagaatggcgtgaacccgggaggcggagcttgcagtgagccgagatcgcgccactgcactccagcctgggcggcagagcgagactccgtctcaaaaaaaaaaaaaaaaaaaaaaaaaaaactgcttataaattttattcaaggccagtatggtcttgactgatgaatgaaatttcatacaggctttccttaataccttcttttagaagtaacatagatattggaaaaaaaagatcgtttttctttgtcctcaaggattgcaagttttaaagagaatggaggcttggacttgctagtgaccatctttgttgccattgtggagagattctacctgagaatgaaacccacatggaattcatcagttccacagtataatttgtcagcttaaaataagatatttatttattaatgcatctattcttcccaccctcccccaagttctctctgctggctctgcctctccctctcacctgatatgttctccctctttctttctctttctctccagtgttgacttcattctcaggtaagctttctgaatgtggtggcaaagatggccacatacaacttcagacttgcatcatgcgtcatcctacagcctgtgaatccaggaaaaataaacaaacaaaaagattctctttatgccaacatcaatttcagttgtcagaaaatcttggattggctctgttttggtgacatgcccatatgtggatccacttatttgataaacaaggactactctgattggatggccaatgtagggaggcaaaagacgactagcctatcaaggtcatgaggaatgagtgagggtctgtcagtcgtagaaagtgaaaggaatttaaagcaggcgggaatgtaatggaacacacaaccaccactacacattttttaattactgagtataatgatgattgataggcttttgaaaatgtttgtcttggtaaactcactggtacctatcaatgtgtaggcaacattagtttattttgccaaatgtcctcttacagcatggaaactataaaacatctgctgcagcaaatctcaaccttgagtgtcatgagattaattacttttattaacactttccataagcatgtaatatatgacatataccaggaaagtcagcatttggtctcatttaggaatttgaaattttaaaaattatttaagattactagaaattgtttggtaaagaagagatgattatttttttctgtagcctattgtgtctatccttaaccaccatatgatcagaccatttccttacagcaaattttatatcctccccacttttacctctaatgttagagataattagtgctgattcttggaaatttttatttttgtttatgaattaatttcttcctctactactattatacatatatatatgcattatatatacatatgtgtgtgtgtgtttgtgtgtatgatgtatatatgatggctacagttataaaataaggatgttagattcttattccatatcctttaccttgttgctcttttgtttatcatagtatgacctgggtggtttttaacattttaccatcaagaactactatttaggaatctttctcaatgaaaaagagattaatttactatgaataatggttctaatgcaaaacattttgggcttttgttgtgatgcagatgagcaaagccataaatataatttagagagtttgaaaatgtattttaacattcacaattcttcttactaattaatcaaattacaaaattatgctgtggcttccagtatattaaaataagttgtcatatttggaacatctgtttatggtcctattatgaatatgtatttctaaagggctgaaatatagattgccataaataatgtttgcaatttagtccgtggaaaaatgatacctacttcccttcacaatgcttgtttatttcccacgaagtaaatcttccagattgtattttatcattttcttatcaagacggaggaaaaaagactcgggtcttacttaagccttgctgattggttaagaaaagagatggctgtcatcggcagccttgccagacactgtaccgtggctccagacagtcagctggtactatcgctttgtctcaactataaatcacagtctcgtaatggccaaggctgacaccttgacattttcaagaagagtaaaagacctgatttgaatggaaatcaatttcatttcacaaatcttgggtgactactccaagccttttcttgtgtcttcttgagacttatttgggattttcatgatcatcagaggattatttgagtgttatattatgactttttaaagctataaaaccatattcttacttccttcttcattcctaacatgagaaaattgatttttaaagttttatgtaagaaaaatcactaataagcactgatagtttttaaaatggcaatagcagccaatgctgtttagttttgcaaaacttttgtaaaatgttctctgatttaaaagtacaagctgtgtacacacgtatccagattaacctttgattacctgataataaatattagcaattatcaagtgattttgcacttcaatcaagcaggtctcaatgaaacttaaaatcttttgaaaagtattttcacttttacgttcttagacataacaagaaagttttaagccttaaattttaagtattctagagccaatgatgagtaaaaagtacttaattatgttagatgggaccttgcattaaattgcatccgatcttttgaccattcgacccaagtgacacagaaataatttcatactttactagtatgaaaagaaattctttttggggcttttaggagcttggcattgaatgtttaaaatgtttaatatacttattctgttacatctttctcctttagaagaatactaccatttctttaaaagcacggaggggaagacatttcttctttcctggtattttgtcttgatccctctccaagagtgatctaagctcagtaaagccttggtcttctcgacacaatattaatggaaaatgttaaccttacctatctctcttttttaagtatggagggattaccacaatgccttgtgatgatttctcttcatcttcattgttagtcctcaactttgtctcaaatcataattttaaacagataaactttgattgttaaattcattattttgtaaagccctatgaacgagtgaaattacacacagttacaaacaggattcccaacccttaaatctttttattcatccttctatccatctactcattcattcataatctatacagaacatgatcctactgaggtcatgagttcgagaccagcccgaccaacatggaaaaaccccatctctactaaaaatacaaaattagccaggcatggtggcacatgcctgtaatcccagctactcgggaggctgaggcaggagaatcgcttgaacccaggaggcagagggtgtggtgagccgagattgcgccattgcactccagcctgggcaacaagagcaaaactccatcaaaaaaaaaaaaaaagaaaaagaaaaagaaaaagaaaaaagaacacgatcctatgctacgtaggtgggaaatacaaaataaaattagaattctttctttacaaaatacgttcttatgagaatttgtttaaaaaacaaaaaagttatcaagtcagaaagtgatctatccacaaaggagatgtaaacacaacgttctgatgttttgggattctagaaaaggcattttttgttgttgtttttttttttggttgtttgtttttttgatggagtcgctctgtcacccaggctagagtgcagtggcacgatcttggctcccttcaacctctgcctcctgagttcaagcgagtctcctgcttcagcctccagagtagctgggactacaggctcccaccaccacacctggctaattttttgtatttttagtagagatggggtttcaccgtgttagccaggatggtctcgatctcctgacctcatgatccgcctgcctcggcctcccaaagtgctgggtttacaggcgtgagccaccgcgctgggcctgaaaagtcatttattttagtcattgaaaatcaaggacaattccttggtggaggctgcatttagctggtccctagataggaaggatttctagagaaagtgatggaagggcttgggtttctgggagactatacagtatatacaaatgtgcaggaacaggaaagctgggctatgtttggcaatgaatgttgttgcaaagttaggtgcattgttggaaagttagtaattgagtgcctaataaaaagtaagctgaaatcagttgatggagtagctacagagttcagggaggttgtcctggggattgtgcaattttacaatggagtaggcactgaggaccttttaaatatttggggacagacgcaaggatgtaaagtgcaagattaatctgtttccagtcaatatggcttaatactccaatccagaggacctgtcagaattactgagcaagctttatgtagacacaccatttttcctaccccttaaattctgactcactaggtctggggtagagaatgtgcaggtgtgttttgtaaaagctcctagatgactggctaacacacaaattgagaaagagttggatagagaatgctgaaatgagaaaatataagggattattagatagaaataaagactattgcaatgtgtaggaagaacaaaaatggagatataaaccagggtttcctaacatgaatttcacatgcccctagacttttggggttttatattcctatgagagtgcatgtaatattttgagtgtatgtctattttttttctggaaaaggtgatctaaccatgtatataatattttcaaagactaaaatcacccaaaattaagaactactagggccagttagtatgaagtaaatgggagaaagttcatgaatctacaattggaagtatttaatgacagagtagattgcatagggatgaaatttgtggcaagaaagaaaggcagagaagatttcataaagtttttctacctgttgatactaaaagaattagaatcatcatattccttttgtgaattagcattaacttcctcttacacttgtatttcagttaatagaactttgatattaggcatggtgtgaatgtggcaccacaggaagttgttgaagcagtagtgaaaaatttagagatgactacatagcttcagaaatcattcttctagaaacatagttgaacacttttgaagttagggatcaggttgcttccatcttgttgctctagtagaaatgcaaggagaaaaataaaggcactgcactcccttttaaggaaacaatttggatttttataaacagaatctactatgtccttagaacttaatcacaagttacacaaagttttggagcggaggggtgcatgaaaatgcagacttaattctaggtagttatttacccagctaaaaatcagaagaaaaaaagcagtagatattgaagaaaaactatcaacctgtcatagtgaacatcaacaattttgaagcatctgataataaatgaacccaaccataatatgaggacatttatctcaaccttctccttaaataatatattttgcttagaaagatgtacagatttctttataacatatcttatgacacattttaacacctgtcttatacaggtgattcatatcctgaaaagattagaacacttccatgttcaactggaaagataatattactggttgcaaatgcagttaaacctattccaatgttactaagcctactagtcttgaaccattttaaaacaatttaagatattttcacattatctaaagataactaggttttttacaaaataaagtctggggaaggacaaaagaaaaagtaacaaactcttagagatcgatgatagcaaatcttcattttataaaattataaaatgaaaaattccagactaaatagaaaaacaaaaacaactattagtctcatcagccagagaatatctcctattatcatacaatgtaaactcatgtgctctatctctctccaccatcacatacatgcactcaatatttttataatcttttgtaacttgtttttcaattgttatatactgaatactttgccacatattattttatcatatgcttattatgttattgttttatgatacactaatataatttatttaaccagtcagctcacaggtgtacattgaatttactttcaccttatttttaactaatataaacactactatgttgataaatacacatacatataattatatgtagtgattccctgggtatattcattggaacagatgataatggcctgaatgaaggtgatggcagtgggattagcaaggcaaagagggatcagagaaaatttagaaggtagaattaacagagtcaagtgattgactgtatagttgaatgatatctggaaaacttaaaccaaaataattacctcctaacattatgctgttgctctattgttctccgctcatttgatctataacatttctttctttcatgggaaggaagatgcaatcaagaatagaataaacagaagatttgaagtgactggtagattattttttaaacttatagcaagtgtaatgagctctaaacaaattggtctggtttggaagagatagactcacaagaaaaaaaaatggttttacttttaatttctaaagttcatggccagaaatattagcctaatcctagagacctggatcatagaacttatcatagttaactatcaaatagagaagactttaggatatgatctgaaggtagtcatccatcatatagaacaccatgatactttctagactggggtcagtgaagagactagtgtcctagagagagaagaaaaaattgaatataggcaaatattccttatttcactcctagttttacactagtggtcgttagtgtcctagagagaaaagagaaaattgaatataggcaaatattccctatttcactgctagttttacaacctctaggggagggagtgaaaatcagagatgtgtaattccacctttattatacactaaattctcatacattctagaatattctagtccattttaatattgtagatacaatagtaataactattgttctagattttcttttccttttcaagattccttgaaaactggaatctttttttcatggagcttatccaggggtagcataggacatagtcttttttgtttttcctaagtttcattcagactttactttttcttctgtctttatgcagataatcaagtacttgatccttagcagataggctcatttattcacttagtcaacaaatacattaaataccttccatatggaaagcaaattattttaagttgtaaaattaatttcagctacaatttattgtattacatttttttaatgttaattgaacatatcaaggcctttatgcgggttggagcatatgcttcacacagatcgcacttagtattttaagattataattagaaataaacaaagcaggccaggcgcagtaacttatgcctgtaatcctcgcactttgggaggctgaggcaggtggatcacctgaggtcaggagtttgagaccagcctggccaacatggcgaaactccatctctactaaaaatacaaaaattagccaggcgtggtggcgcatgactcccagctacttgggaggctgaggcaggagaattgcttgaacctgggaggcagaggttgcagtgagccaagatcgcaccactgcactccagcttgggtgacagcgagacttttaaaaacaaacacactacaacaacagaacacaaagcacaaacacacagagacacacctacccacaagcctgtaagaaatattgatgatggtgctaaagaaaatgtgtgaagaaacagttcagaaagactgtcgtggcacatcttttcaaaatcattgactaaacacaccaagagaaaaaaaagaatgatttatttgttagtgcttctagtatctttcccaagaattcaagtggaacagagaatccagtgaaatttggtgctttgcatcattactaaactcatatctgcaaggtaatcatgtgtgataaggctaaaatgtaaaagcatttaaatcaatagctctttcagatgttcttctgataaaattgcttcatttactttcctaactaatttatgtaagtgaaaagattaagagaaaaactaatattaggagtaacaggatccaaagaatgtattgaacttcattgttttagttggcatctttgcgagccttttaatgatctgatctcagaaacatctatcttagaaaggggtatactttctggcttcatttacttgaaaataaattaagttagggtcataagcagaggttaggttacttctacctggaaattaatcagaaatttgattttgccctttgtattgcttttctgcccccacatctcaacacaccttctgtcgtacaatcctaaagctccctttcttgcatcgtggcagtttaaaggaatttgaagttgtggatttccatatttacataattatatactgaatatataatataatagggtagggtaaagtgtttttaaaagatgtgacatcttaaagaaaatccacagatatcataagtgagtctaatttattggcaaatttcaggctatgttcttagtcatatttctgctagaagaaaactactttccattttgtgttttctcatttgcattactgcaaagttattcatgcatatgaaaaggatattattcatctctgtattcctttctctccttattccaaacccaatgattttatgagttatacataaagaaacacactgctatatctatatgtttatacatagatatctatgtgattcaaatttggtattacagctggatagcaaccccaagtgataacattatgtgctacatgtgtcttattacatcattaatgatataccaaaattgtcaaatatgttgaaatccaacaattgtaactgacaagctttagcatgatttgcctccattgggaatgaaaaagagatagaggaatgtatttctgaattcttcctcaaagtgcatatggctgtacgataagctcttgtttcttacctgctaatatttttagtgagatgctgttgtcacagtattcatggtaactggtttctgaagtttttatgtgcataaagccatatcatctcctaaattgaaattccagtgatattccagaaggaactatgaaggtgaactggcaagaagaaagatgaccaacctgacagggctttttcctttctctaatgtttgattcttcttatctcaatatcccaaggaaattatttcacttgaaagtttaggcagaatccgcagaaaaaaaaatttctcttttctactctccagttctactcctaccccttagaaaagcaaatggtattccttcaattcttgaaagtttttccttaaaatatcttggcatttgcaaggcagaggaaaatagggttgacagtgaatttcatggacacaaacctcattcatgacaatgatgaggtattcaagatttctcaccctttgtgtcctgctttatgtgtatttagggatggcatgaaggaggagaaagaggaagcttatacttttttctttaaaattaattcccatttagccgttaaagagtggaatcgtttttaagccgggaagacattgtatttgcattttccttttcaataattgtagcagatatgaaagtgaatagacaatggcagtcacatacagaataacctggtttcctagatggacccacttgtcggagatcaaacggctacagcacatttagggttacactctctttcccttcctccttattctcaactgcagtggagcttgttccaaagttgccatggtaacactatatctggctgctagctctgtcgtaagttattgaactgagactggcttttggtttagcagataattaggttctgtctcacaggttcattttcctgtgactgggacgtgaatatgacctacagctggcctcaatttcagtgtcacagacaaaactttaacccttccaagctcctctggcacactcctaagcaccgcttgtgtggtagaggaagtccagtgtatgtcacccataccttgaggaggattaccaagtcctcattttattttttatctttagcataacactaaagaaaatatagtgaaggttgtacacatagagcattttcaaaataaaaaatataacaatgtgatatatagttatgtattttatatatactacatgaaactttttgtagtcatattatttccttgagtctctaataatttttaagtcacactgaaatttcttctgttataattaggaatccacagaatttcaatttcaaaacctctgttctcagaaatattaggtgggtacttttattctcagctttgagaactgtctgccagttcattgacactcctctctctgctcttatataccctgaattatagctgacattaaaaggttccattggagtcacaggcagacccatatgacaggaaacaccgctaccactctactaaatgccaaaatgctcactcagggcttaaatcttgctggcttggaaaaccagctacttcttttgcatgttgtatttggaagatttcaatcagttaaatagctgccctttgtttaagacaaagaaagaaacataactttgggaacagatattgaattcacaatatccatggcaacacagagagctgtggaattgctaagagaagatgtacctttgtatgtcaaacaatgggaaagaccttcaaggaaatctgtttaaaatttttagtgtatgtcacctagaagcttaacatgaaaaggtaagaaaggaatagggagagttgagtttaccagaattaaaacatgagttaaaggaattccataccctaattggccgaaggatcacctaaccatgttaatagtgacaggtaaaatttgtgaaagggaagattagaagattcaacaattgcatattggacttatgatgtgtgtgtgtatgtgtgtgtgtgcgtgtgcgcatgtgcacaggcatatgtcccgcatagactgtactctattttaatccgtgcctttcattctcaaactctagatgacaagagcacctcaaaggcagcagcctcaaggagcagccatggccccagacttgtcgcacggatgcagaaaacttaatggaggaggctgaggtcagaatgggaagagtttttaaaaaataaaaaggggagctaatatgtgaggaactgattgctgtgcattattttccactgaacagaccttcttttaacttctaatctcaagcacatagcagctgttgttttcatattaaagatcagtaagtgtttgttgaatgaatgtataaattcttccccaatctctgttccatgtaataagaactaagttagcattcaattataaagaggacttagaaagtctgcagacatttttgatcaaaaatccttttaactgtcttcttatggttcccggtaacacctaagcccaaaaaactcaggtcatttcttgcctgtactgttgcaatagcctcataataactagtcttctcctttatcaaccacagtcgtctccgctacacaaagaagagagggtgctaatctaaagtgtaaattattttaaatcagcacccttcttgtaatttcccagtggtttttcctgtcataagaataacatgcaaaattccttgcttgcaaagccaggtatgaccttgccccgtctaccttactggcatcgtctctcatgactcttcccctttttcactctccatcttgccttttcccaaccatgcctgctagtgagccttagcccttgtgttttctctgccagggatgcatgactggcttctttactttattctgatctctctgctcaaatgtcatctttttagagatagctttcctaaacatctttaaaagtaccccatgaactgtgaaacacctttcctgctttttcttcatagtacttatcacttcctgatattatgttagacaacaagcaaataagtatatgctgttcccactaaaatataagctccatttgaacaggagccttgattattcctgagtatacccctagtgcccagaacctagtagggctttaataaatattagattcatttgttgaatgaaaaaatgaatgaataattgaataaagatatccaggtagagtgtccgggcagcccaacctatgtgaagccagtacaagaatgtttctgtgacatagtgagcgcaattattcctctaaatgatgaacttgcatgagtacacaaggataaaattaagcacgtagtttagatttctgcaagtctcttcctcagattgaggaaaaacaaagaaattgagcttattctcacctcattcttacatgaactaaatccagaataaagcatcatttaaataccaagcacatccctacctcagccactcatggaatactttatctgtaaagggacagatagatagtaaatatttttggctttggggaccgtacagtctgtgtcgccactactcagcacttctgttgaggtgtggaatcagccctagacaacacataaacaaatgggtgtggctgtgttccaataaaatgttatttataaaactaggaaatcagcagatttagtccacaggctgtagtttgctgacccttgaattagagagtcttccccaaatcctcttcccaagttattgaaagaatgcccataggaccatagctccctcacctggttctttcaagaaatgagacaaattcagggatggttggagggtggaacgcctacctgtgacatgactattgagcctgatttctttccttttatctctttaaagtgagtcaggtcttaactttaaactgtctctaaagtggcaataactgggccatgtcaaatactcccaatgacaaaatttcttcttggagaatgaatgagggttgcatacagtggtgtgttggtaaatgtttagcaactggctctcttactgatttctgtagtgtaaattctcccatcctggccatctgaaactaccaatatgatgtcacttgatgtagagttgggaaaagacagtctcttgaataagtatgagctggttccagcccactgctgaacacatatttaaaagctacaatagctctgctcactgccattgcagagtctggaggaaagagtagcaggcttgataggagcaattggctgaataatcttttgcaatgccaataaataatgaaaaagtatataaatataacgctgtatagaaagctctcaagttcagtgtttggttaaaatacatactcagtaaatggtagctattattgtcttagtttaagttattgcaagcattaaaattaaatgtttagctacagactcaatccagttttaatgtcattgtgttaataaggcctcttaacattgaagcaacaaagataaaggaatttttttgtagctattcacgattctgcccagctcaaggtaaagatagcaacaaaatactccaaccagaataaaagaagtctccacttgactgcagctcttcgcaacacttcacaagggtcaagctgtgttagtttccttcagtgttaaacagaatgcatcttaagagaatagttcaattattgattgaatagtaggttcaagttgactataatcccaactaatacactctaagaccagggatgggccgacagaagggtaaagttttccactcaagtctcgaggcaaacactcagatagaagtagtaatatggatgccttctattatttggtcaatacaatactgttccagcccagttgtgcaaaactggtgaaataaaaggcaaaaatattgacaacagtttgggtaactggattccaaaatgggcatccatctaagag

SEQ ID NO: 2721 - DNA, 281464 bp, Homo sapiens
tttttaaagaggccaaacaatacatttattattttcatttaagttgcttatcagggcaaccttccccatctgggaacaatctagcagtcatgtaagaagcacatgcccccacaattagtttgaactccatcctggaattgcagctggttgtgattctaaggtacaggcatgccaggagcctggatttgaatagtcagtgggattttgtcacttagtggaatggataataagccaaccaatggtcatcagtctcacacataaggagtgcaggctcgtagggtatacacagtactttctcaaaagcattgcaaatgactgatttctctatgttgaaatttgaaaacccaacatctatctctctaacaccaaaggattgagccttccttgcctggctggtgagtaagagtgagcctctataccaaggatgtaccctttggctgtgtgaggttttcagaagtatcagaagctgtatacatttcctgtggttgctgtaacaagtgactaccaatttgttggagccttaaaacaagaaagatttattctctctccgttctggggaccagaagtctaaagtcaagacgtcagaggggccaagattgctctgaggggtataagggagaatccttcctgcctgtcccagctcctggtggctccaggcattgcttggcttgtggtggcatcactccagtctctgtctgcatcatcacacgaatatcttgtcttctgtactcaaatctccctctacctgtctctgataagaaccctcgtgatggcattaggttcactgggatgatccataatgacccatctcaaaattcttaattctatctgcaaagattcttttccaaataaagtaatatttataggttctgagggttagggcatgaacatatcttttgagggctaccatttgatccatagctgttcagcggtttacattctcggatttgacagtggcatgcttcacttgtgactgtgccattctggaatgaggttgaccagatggtgctgctggccacgtcaaactcatcctacaggctgtagcaagcaaggctcacacctccccatgtctgacacctgtgaatcacagctgggtctctggaaaaatgagtgagtgcaggaacaaaatcaaacaggagacctcatccaccactaggtctcagagaggacattgcagcccctgaaaagagagcatctctcttggaacttttgtactcagttgtattaacgcggcaaggaaaatggcacatttatgttggaaaatgtaattatttatggcacctgtgacaactgggcactttggaatcacaaagtttatggttgaagaccacttggggtgattatcctccaaaatgtttatttggcttcttgaagttctgcagaggttgaggcagctgtctcaaaactagaggacagagccctgtgggcaggtgggtgtgagaaactcaaacaccgcagtcttcacagacccacaagctattggcaggtgcaatgtgtttcttggggcagcagctatcctgagacaggatatcacagggtcacatcaaggaccccagtcatctcacaactcttagaccacagctgctgctgcagtttctggttgtaggtgacgtggagggacttggtctctttctcgttgtataggtaatggccaccaactccttccagctctggggtgactgctgcgtagatggaagtccacgctccttcatcgggggtctggtggaagaagaaaagaaggctacgatgagtcaaatttctgagcaggaaacaggagtctcaggactcacatggatgctgcagggacaggtggaatatactcatcagctgcactgagaaatgtatgcaaaaagcgaggttgggtgatcaatctgaaccacagcttttctgctgttgggtttctttacaacaggcactgacaataacgtacccaagtgggttgcatttcagtggtgggttaatccatctcactaggcagatgcatattaaaatccctgatgtacgtatttaatcacgcactctttatgggaccgaaatgcttattaattgactagaagcagatgagtgagtgcttggcttctgtatttaataaacaatatttagcaattagatgaaacatcaggacatcaaaaagattcttgttttcaattcagcaaggcatgctacatcggagaattgaggcatttatgagctgtgatcgtatgtttcatggaaacagacgtttcaaaaaggaacttgagatgcagaaaaaggtttttcaaagactggggattttaccctagtggaaggcgataatcttgaaacacagcacaccctggttttctgcagtgggagttggcccttggtcatggtcagtgggatggaagaaatgtaggattctcagaggaattagaagttgtgggacctgagaaccttcagagctaggatgcaataatccaggaaccaacacagtgcatcttaacttctgtcacaatgaagatgtttcagaagttgtctcttgtaataagcttctgggaatctggtgaacgtatccaccatgtggggacacagtaatgaggcaccgtctgtgaaccagaaagcaggtcccttccagacacagaatctgccatgcattgatcttgaacttccagcctccagaactgtgagcaacaaatgtttaccggttgcccagcctatgttgttttgtgatagcaacacaaacagactaagacatttgatgtccagagtttttactggggtctcattgcataggtatgattaagtcattggccacataatcagattcaacctccagttcctctttcctccccagaggtcaggctggcctgaaattccaacctcctaatgacatggttggtgtttctggtggccagccccatcttgaagccatttaggaaacagcaaatatcacctcattatacaaccagggaattgctagcatttgtgaaattgcgagagttttagaagctcctccttgttacagaaccaggaataaagaccagatattgcctttgttatgtcccctctagtcttctgggagtgatgatccatttgcccgaactgatttcacctctcaccagtgcccctagcactgcagtggctcaggcctgtaatcccagtgctttgggagaacaaggcaggaggactgcttgagtccaggagttcaagatgagtgtgggccacatggcaaaacctagcactggtgagagttcaggcacacaccctccaaaaaggaaaagggtggactctgtggggtggcctgtgacacccagtcacttcagaaattctgctgctgtcagttcactgcctcctggtcttgacttcagcagccagtgtgacgtggaaaggcatggtagacaatccagtgtgcccaccagcccatcctctgggtgccgagcaaggggaacaggaaggctggaccccagtagaggaacagagctgccagactcctgagattgtttcccactgacttgcctctgctcttctgctgcctaaaaagaaatggatggagctagagaacttcccaagtctggaaatcacctaggggtgcccagagatcttgcaaacccaaagtgtcctgggagatttggaggctgatacggtttggctgtgtccccacccaaatttcatcttgaactgtagctcccataattcccatgtgtcaagggagggagccagtgggaggtaattgaatcatgggagatctttctcgtgctgttctcatgataatgaataagtcccatgacatctgatggttttataaaaggccgctcccctgcacacactctcttgcctgctgccatgtaagacatgcctttgctcctccttcaccttccgccatgattgtcaggcctccccagccacatggaactgagtccattaagcctctttcctctataaatcacccagtcttgggcatgtctttattagcagcatgagaacagactaatagagagactgtatctgaaaacatctcgggggcggatgcaggcgccatggcttggctcttgcaggggagccctgtgtcccgtgtcttgccctgggcatctaaagaccaaaagtaaaggcgaaagggatggaaagaggaagggaggaaggacagaacagagcaggaggaaagggagagggaaggcaggggccaagtgaaggcacccatggtgtttgagggtctttctctggggcagccttcaacgcagaaagaggttttattgatctgtttcatgcttctctcttttgcggctgtgttctgcccaatttccaggcaggatctgctcccaaagccggcattcttcttccttctccatcatcttgtagctggaaaatacggagtctttctggggcccagcccacttccatataaaaggcagggacaccaagcactgcagctgtgaatccaacatggtgccccttcccacactgctgctctggacaaagtgatcagagaggccagatgggggccaccctgggtccccaggagagaccatggttcctgctgcgcagaaatgagcatttacacctcacgctggtgcctgagatgttcacccacactgtgttatatttagtgctgtgccttctttgcaaacaaatccttaaatcagctcctggaacaagttttgtgttgttgtctgccatcattgacactgaggattcaggggctcatgccccaaatacccgacctgtgtcttgaccatgtagtatgatgcctccacccggagaggcccctgtgttctgcagctgcagcttaggccgctcctgggttctcctgcatcgtccctattgttgaacaaactcagcactctctggaaggaggcttcctctttgtggttcccctgtgggcagtgtctgggggcttctgtttctaccatattttgaaaaatcctcttatctgagtaagagttcttgggctatgcatattcaattgcgacacaagtactaccgttttagggggcaagataccacctgtgctatgttgaaaatgagcttgtgatttctagaagacagcaagcgcattgtgctgaaaatgtaggtatttctggggacacagagatgacgacgtgatgaagttctattggatgattttttttctgtaagaaaaacacacgcacacacatattcatgtgcgcatggtcacttacatgctgacatgcacacatacattcgtatgtactcacatgcacacaaatatatatacacatatggacacacacatactcatgcatacgcacacacacatgcacacttacttgcacatgcatactcacactcattcacatgcacacatgctcatttacatgtacacaaactcacatgaacacatgctcacatatactcattcacatgcacacaaattcgcatgcacacagctcacacgcacacatgctcacactcgcacacacacacgtacacacacattcacatgcactcattcacatgtacacagctcacacacatgctcacattcacatgcacactaattcacatgcacacacacatgctcacactcattcacatgcacacagctcacattcacacatgcattcacatttacatattcacatgcactcacatgctcactcattcacatgcacacagctcacacacatgcacacactcattcacatgcactcattcacatgtacacacattcacatgcactcacacacgcacacagctcacacatgcacacatttgcatgcacattcacatgtacacacattcacatgcagtcacacatgctcacactcattcacatgcacacagctcacacacatgcactttcacatgtacacacattcacatgcacacatacacatgcacgcaccctcattcacaagtacgcacatacacatgcacacatgctcacactcattcacatgcacacatgctcatccacgtgtacattcacatactcattcacatgcatacttatacacatgcaaacatgcttatatattcatttgcatgcacacactcatacacatgcacagattatttatcctaatattgcaaaatatgaaaccaaggagagaggcctcaggaggaaccagccctgcccacaccttgatcttagacctccagcctccaggactgtgggagaatcaatgtatgtcgtttctaagccacccagtctatggtattctgtgacagcagccagaactggactaagacatgtcataagaaaaggagatgaggacacagacacacacagagggacaaccctgtgaggacacagggaaaagacggcgtctccaagcccaggagagagacctcaggaggaaccagccctgcccacaccttgatgtcagacttccagcctccaggactgtgggagagtcaacgtctgttgtttataagccacccagtctatggtattctgtgatagcagcctgaaatggactgagacagctcataagaagaggagatgaggagaaaacagacatgcacagagggacgaccctgtgaggacacagtgagaagacagcatctacaacccaaggagagaggcctcgggaggagcccgcccagcccacaccttcatcttggacttccagcctccaggacggtgggaaaatcagtgtctgttgtctaagctgcccagtctatgggacgtcaggctggcaaccccggcagatggagaccaagcccaggtgacttctctcctgactgggattggcgcaggctgctgtgtgcatatgtcaagaaagcctcttttccaggaaacaggcaattatacccacacttacctgctacctcaagagtcagggaggggagagacttcaggagcatgagcaattactcgagttcccctcccaagtcatttcaatctcctgttggttacctggctcattcagtctgccccacagctctattgcaaacagagccctctgtgttcatgggactgttcaagaacaccaagggttcctgccagcatttgtctctctaatgccacgttctgcaaagcagaccttggactggcccagccctttgtgatctttttccccaaagaaaacacaggcgcggtagctcacgcctgtcaccccagcactttgggaggccgaggcaggcggatcgcgaggtcaggagatcaagaccatcctggctaacacagtgaaaccccgtctctactaaaaaacacaaaaaattagccgggcatggtggcgagcgcctgtagtcccagctactcgggaggcaggagaatggcgtgaacccgggaggcggggcttgcagtgagccgagatggcgccactgcactccagcctgggcgacagagcgagatgccatctcaaaaaaaaaagaaagaaaaaaaagaaaacacccagaccatgggcacggtttctcgtgttagggcagcacagagaatgtgacaggtagggaaaacagcaaagcaactcatcgttctcagagtcgcttttgttagaggggaagctctgggacctgtctcagagctgctgcagaataagaagggttcgagtcagccttcctcctgctgacaatgaatacctcagttttccctccggaggcagccccttttcctcctaactccatgaaatgtctttccggaaggtgcagctggagcaccctgcacctgcaccccagccagccctgcacccacatctgtacatgccaggcagtgctgagaaccgggcaggaagggaggggacagacgtgtctgcacagaatcctgcacctgctgggaacaactcagtgtcatcagctatggcctgggtcaaagcacctttgttttgggtattcaaaggtcagtgaagggttgagtgaaagggaaggagaaagacagagaaacaaaaaaaatcaatggaaggaagaaagagaaggagaaagaaaaagaggaagaagaaaggaggaaatagagaaaggaattaaggaaggaaagaaggaagcataatgggagggaaggaaggagtgacacagagagagagggagggaggcagtaagaaaggaaggaagcagagaacaagacagaaaagagggaaggaaggagagagaaaggaagcagagaagaaaggagggaggaagaaaaaagggagaaaggagggaagaagggaggaagggaaggatgaaaaaagaaaaaaaaacaggaaggaagcaaagaaggaagggaggcaggaagcaaagaaggaaaggaggaaggaaggaaaagagacagaaagaaaaaaaaagaagagaaacaaagaaccaaagagaaggaaggatgggagggagggagggagggaaggatgggaaggaggaaggaagggagggagggaggggggaagggaggggggaagggagggagggaagggagggagggagggagggagagagggagggagagagggagggagagagggagggagggagggagggagagagggagggagggagggagggagggagggagggaagggagggagggaggaagggagggagggaggaagggagggagggagggaagggagggagggagggagggaagggagggagggagggagggaagggagggagggagggagggagggagggaggaaggggggaagggagggagggagggagggaggaagggagaggggaagggagggagggaaggagggaggaagggagggagggagggaagggagggagggagggagggaagggagggagggagggagggaggggggaagggagggagggaggggggaaggggggaagggagggagggagggagggagagagggagggagagagggagggagagagggagggaggaagggagggagggagggagggaagggagggagggagggaggaagggagggagggaggaagggagggagggagggagggaggaagggagggagggagggaggaaggaagggagggagggagggaggaatgaagggagggagggaggaagggagggagggagggagggaggaaggaagggagggagggagggagggaagggagggagggagggagggagggaggaaggaaggaaggaagggaggaaggaaggaaaaaagggaggcaaaaggaaggactggaggaaaaaagagaagataagaggaaggaagggagggaggaatttattcctcagagcctttgctgcatttaccaattctggttctgcccctatttgaccaaatatctgtggtgactctgagaattctgatttctaagataaggcagatattgtgaatttgaaatagcaaatcccttttgtgtcattcaaaccacgatttcctttttgttagagctcctgttctccagatagcacccagggcacacagagatatttgcctgtgactcttcaaagagcttcagaaagctgttccctctgaactccacacttaacttgtattagacatgctgggctttgcagaagagacacacacagggcttccctttgtccttgggacggatcccctgtgctgtctgcaaggaaactacctaacgctccactgccaggagcagagggcagcaggaatggcatcacccgggatgtctcctagggaggaggctagcagggcttgggcggcaaacgctcagctctctgcaaggcacgcagaggctcgttcgccttctggaaatgttgctatttgaatgcagacgctgttagtagatccttgagttgtgctgagagagatctgagggcacatgtatttattttagcaccgtccacatcttagggcagaaactcacactcagggaagtggctggcaagtaaagagactcctagctgagcttcccaaggagagtttccacgccccaaagttgtggaagaggggacggagtaatgctgtggtcaaagagaaattcagagacttctgcccaggctcagctgccttcctggaagaatgttctgaacattctacaaaggcaacacttcctctccatacctctgctccagccacccagggatcctgctgcttctgccacgatgtcccctgcctcttgcctctctgtacctgctgcttgctccttctggaatgttctggaaaataggtttcggggctggatgttttctgggatgctgactcacacgcaaatcatagggtgacataatgtgtgcatgtgtgtgtgtgcacagatatgcataggtacgcatttatgtggatgtgtgtgtacttgtgggtagatgtgtattgtatgattgtatgtgcatgtctgtatgtatatgtatatgtatgtgcacgtgcatgaatgcacacgttaatgggtacgtgtgtgtattcatgcatgtgtttggataaatatatgtgcatgcatgtgtgtgggggcgcagatgtgcgggtatgggcctgcgtgtgtttgcacatgtgtatatgtatgcatgcatgtgaatgtgtacttgagggatgtgtattgtatgagtgtatgtgcatgtctgtatgtatatggatatgtgtgagtacatgtacgtacatgcatgtgcatgaatgcacatgtgaatatgtgcatgtgtcgataggaatatacatttgcataaatgtgtgcatgtgtgtttgctcatgcatatgtgcacacatgcatgtgggcacagatgtgtggatatacgcatgtctgtgtgcatgggtttgcacgtgtatatgtgcatgtgtgtctatgcatgtgaaggtgtgtgtgcatttatgcacgtgagcatgtgtgcacatactatgcatgtgtgggaggggtgcaggtgcgcgcatgtgtttgcatctatatgtgtgtatttgtacatgtgtgcatgtatgtgtgcatgagtgtgcacatgtgtacgtgcacacacgtgctctcaactccccaatgagagctgtgggttgtgctaaacttctagggatgtttcatggcctcagtgaccacctgaagcagagaggattaagaaaaccttcctttaactacaatctcgtaagacacacacacaaacctgctcttaccaggaataaacactcacctgacagacaacagagaggagatggcttgtgctgtttaatgtcaggtaacacaggtcttaagtgggctctgtgatgattgagttcacgtatcaattggctgggctatggtgcccagacatttggtcaagcaccagactgggtagtttgtggatatcattaacatttacaaatcagttgcatttaagcgaaggagaggacgcttcacaatgtgggtgggcctcacctcatcaggagaaggccttcacagcaaacactgacacttactagaaaaggaattccactccagactgtgacagggcaatcctgcctgagtgtccagcctgccctgcagattttaggctcaaggctgcaatgtcaaatcttggccaggtctccagcctgccagccagcctaccaattttggacttgcccgcccctacaatcccaagagtcaattaaactaaatctttctctatgcatagatcctattggtcctgtttttcttgagaactgcgactaatacaaaattgaacggtctcaatggcagagagtctgggcattctgaaaccaggaagaaatgccgggctccaggaatgatcttggctcatctcttagcttgagtcactggaaggtctcgcacagagaccttcaatcaaaagcacagagactgctggctggcttttaaggctaaaccaaaggagggcatttatccactcaagggaagaagtttcccatccaaagaggacacttctttttagggtggcagcctcagagcctatgatgtctttgttcctggggagtctgttagagccaccagagagtccatcacagacataccctgtggaaaggagagatggcatctccttggacaaaacggcccttcccagttctgtaacttctgtggcatttccaatgtgtacctcaaactgatctgggtggcatcacctctgagcctgagagaacctccctctttccctccctctctctcacacccttctccttcctcctttgcttcctcttcctttttctctttttctctctctattcctctttctcttcctcccccatcttatcctcctcctctttcatttcttccttctccttctctttcccccttatcctcctcctattcttctatcccttcctcttcctttttctctcttcttcctcctccatcgtatcctcctttttcttttttcccttattctcctttcccatctctttctccctttctcttctctctctgccttttcttctttttttctttctcctcttttctcttcttgccttttcactctctattcctctttttttctcctccatcttctcttcttcctcctccacctcgtcctcttcctcctttctgccttatcctcctcctgtttttctctctatccctctctctcccttcctcttcctttctttctcctctttctcattttctccctcttcttcctcctccatcttctccaacttcttcctcctcctcctctttctcttatcttcttcttttcctctatctttctcttcctcttctctcctccttctcttttctttctgcccttctttccttttctctattcctccctttttcctcctccttcatcttctcctccttcttccttctcctcctttttctctttctatccctctgtcttcctccttttattttttctccttttcctcatcttcctttttctctctctcccttcccttcctcctcttccccttcctctttctcctcctctctctctgccccctctattatcaatttacagtataatccagcttttcctaaaaaaaaactagacaaccttcacactacacccttctgtttctaaaagtcttcctctgaatcgaaatcactcttgttcacttgtgtgaggctgggggattcctgaatgaacttgtatccacttgttttgaaaacaacaacaactaaagcaacagaacttcctttaggattcatatagagcattcatatggaattaccgagaactatcttcttttgtccacagccccaaagctggggctcaatcccctgcagtcctggggtctggggtcctcacgcttagcactcaagagaatgggccagagagcttgtaaaaacaactgcacccctggtatttctaactcagtggatcttaggaggcccaagaatcagcatttttttttattttttattatttatttatttatttgagatgccagggctggagtgcagtggcatgatcttggctcactgcaacctccgcctcccaagttcaagcaattctcctgcctcagcctcccgagtagctgggattacaggtgcctgccactacatccagctaattttttgtatttttagtagagacaggatttcaccatgttggccaggctggtctcgaactcctgacctcatgattcgcccatgtcagcctccaaaagtgctgagattacaggcatgagccatcgtgcccgacccaagaatctgcatttctaacgagctcccagaggctgctggtctcagagaccacgctgggaacctcactcattctagcttcttatgcagctctgcaaactatacaccatgggcaaaattcagcctgtacctgtttctgtacaggctactagctaagaatggttttatactcttaaagtgttgttaagaaaaagaaagaaagaaagaaagaaagaaatatgccaaagagactagaggtggcccacgaagactaagacacttcctatctggccgacctcctgtgtagagcaaggaactgtggcttcgcggcagaatttcattatctgccgctgtgcagctgtggctgacagacgctgtcttccacacattctcggaatgatgaagtgggcttgcttggtgacgccttgtgcagggaaatgaaagttgtcttctgaatacacaagacggtcctgtaaatcatgctccctgtggcttaaataacacatcctgttttatctacagcttttttttttttttaaatgacaatctttagagactggcaagaggacagaagatgtataaatgtgaacccaaatccaagaacgcagtgtgttcccttttaacagacacaagagcatctttgaagttccagacgcccggctggggggcgctggggagacggtgcagcaccatttatggtaaaatctgcatcaagccactcttgagtcctggagagtgttggagctgcaagctacagaaaccatttcaacttcattcagtccaatgaatgtttattaaatgctcacccgtattttgccagctcttggggcaaaggaagagaatttcagaaataacccctgctgcccaggagcttccaatagacatgggcagtgggtggatggtgaggcacaagtgcaggaaaaaaaaaagatgaaacacacacaaaatagaagatagagtttcaagtgtactaaatagagccacaagcaatatagtcagagagaggaatgaatggctcataattacataattacacagagctttacagtggagaaaatggtttcccatatattctgtcggcaatgttcacaacactcttatgtgatattattatccagaattaacaaattagaaaaatgagaggcatagcagggaaggagaggagaagggagctgttgcaggaaatagccactgcctgattcttccagggacccctccctcgtcatctcccttctttctctgctttgctatcatgagccctgatccatgcacacagctggatccatgcacatgcattcaatatctccctccctgccttcacccatgcacacagccctgatccatgcacacagctggctccatacacatgcattctgcagctgcctccctgcctgcatccatgcacacagccctgatccacgcacacagctggctccatgcatgtgcattcaatatctccctccctgccttcacccatgcacacagccctgatccatgcacatgcattcaatatttccctccctgccttcatccatgcacacagccctgatccatgcacacagcccagatccatgcacacagctagacccacacacacacattcagtacctccttccctgccttccaggcacagagccctgatccacgcacacagctgttttaggttttttgcagtagtattcagaacagcaaagatatgcaatcaacctaagtgtctgtcagcagaggactggctaatataaagaaagtacagtatagtatatacacaccatggaatattatgcagtcatatcaaagaatgaaatcatgtcttttgcagtgacatggacaaacactgcacgtttccactttttattttattattttactttttattttttgagacggagtctcactctgttgcccaggctggagtgcagtggcacgatcccggcttactgcagtctctacctcccatgttcaagcgattctcctgcctcagcttcccgagtagctgggactacaggcgtgtgccaccatgctgagctaatttttgtatttttagtagagacggggtttcaccatattggtcaggctggtcttgaactcatgacctcaggtgatccacccgcctcagcctcccaaagtgctgggattacaggcatgatccaccatgcccagcctgtttccactttctaaggtccctagagtcatcagattcatcaagacagaaggcagaatggtgttgctaggagctaggaacagcagggaaattggaagttgtattttaatggaaacagagcttcagtttgaaaagcaggccgttctcctaacaaacaactcagatactgaaagtcaaacactgatcctgccatgttctcacttgcaagtgggagttcaccagtgggtctacacagacacagagggtggattgacgatgaggaccctgaaaggtgggaggttggcaggaggtggaggatgaaaaaaatcacctacaggtatagtattcacagctggggtgaggggttcactagaagccgggacttcaccgctgtgcaatgtctccatgcaagaaatccgcacctgtactccttaaatttataataaataagtgaatcaataaatacataagccgggctgggtacggtggctcacacctgtcatcccagcactctgggaggccgaggccggcggatcacaaggtcaagagatcaagaccatcccggccaacatggtgaaaccccacctctattaaaaatataaaaattagctgggtgtggtgagacatgcctataatcccagctactcgggaggctgaggcaggagaatggcttgaacccgggaggcaggtgttgcagtgagccaaaatcatgccactacactccagcctgggcaacagagcatctcaggggaaaaaaaaaaaaaaaagggaacaaaaaaagaaatccgcacctgtactctttaaatttataataaataagcaaatcaataaatacataagccaggacgggtgcggtggctcacacctgtcatcccagcactttgggagaccgaggcgggcggatcacgaggtcaagagatcaagaccatcccggccaacatggtgaaaccccatctctattaaaaatataaaaattagctgggtgtggtgggacatgcctataatcccagctactcgggaggctgaggcaggagaatcgcttgaacctgggacgcaggggttgcagtgagctgagatcgcgccattgtactccagcctgggtgacagggtgagactccgtctcaaagaaaaaaaataaataaataaaataaataaatccgcacctgtactccttaaatttataataaataagtgaatcgataaatacataagccaattggtgagatgacccataaagacaaacaaagctttgtgaggggaaagcaagcgcccaggagaagccctgtcttcggaggttttggcgcaggcctgaatgaagggaaggagagggattggatacctgggggaagggcgtgcgtggaggaggaaacagccagggctgaggcctgcacattgcagggaaagggtgaagtccctggtggctctacctggagcaatttcttcttattttttctttttttgagatggagtttcactcttgtcacccaggctggagtgcagtggcgcgatctcggctcactgcaacctcctgctcccgggttcaagcgattctcctgcctcagcctcccgagtagctgggattacaggcgtccgccaccatgcctggctaatttctgtatttttagtagagacggggtttcaccacgttggccaggctggtctcgaactcctggcctcatgtgatccacccgcctcagcctcccaaagtgctgggatgacaggtgtgagccactgcgcccggccacctggagcattttcagtggagcatgggggactggaagtgaattgtatgagcaattcctgtatggggatttgctgcagcggagactgtagtcagggacagtccccaggggaaatagaaggtccagagagggtggttagatttgtttattaataaaaaaaaaaaaagaaatgggggggctgggtagggtgtctcatgcctgtaatcccagcacttcggcaggccgaggcaggcggctcactcgagactgtgagttcgagatcagcctgagtaacatatcgaaaccccgtctctactgaaaatgtaaaaattagccaggcgtgctgggaggtagctgaggtcccagctacccaggaggatgaggccgaattgcttgaacccaggaggcggaggttgcagtgagccgagatcgcaccactgcactccagcctgggcaacagagagaggttccatcttaaaaaaaataaaaataaaaaaattcccagtacctgcatccttgatttgattaattaacctgtcaccctctcggcacatcaatccaagttccaatcaaccctaagacagactttcattagactgcatggcggatacaaatacatgcttaagacaagcaatgatacgagtggtctacttcatggtgaagtgggcgcagtctacactgcaaatttgttcattttgatggcaggcctgatcacatgatttcaaagtggtcaggacttgctggacatgagccctgaatggtggagctgatacactcagcatttacaatagctttctatttttttttttttttgagatggagtttcgctcttgtcgtccaggctggagtgcagtggcatgatctgggctcaccacaatttccgcccccgggttcaagcgattctcctgcctcagcctcctgagtagctgggattacaggtgactgccaccacgcctggctaatttctgtatttttagtagagactgggtttctccatgttggttaggctggtcttgaactcctaacctcacatgatcctccccctcagcctcccaaagtgttgggattacaggcatgagccaccactcccagccgatagctcttttttgtaacacccattgatcttgagacaactggggtgggaagagaggtaatagccacgttcatttgctccctaggaggggtatacattgtagggggtactgagtttcactgatgaagctgcgaggagcttcctagaggtctgaagagcacacatgccctctgaaatactaagctactctcctacggaggctgagaccatctgcatgtctcagcatgaagaatggcctgatgcatttgtatacaggacaaatcaaacctctcatctttataaatgcacaaatcataatcccaacactttgggaggccacagcaggaggatcgcttggggctaggaactggagacccggctggacaacatagcaagacctcggctctaccaaaaaattttaaaaaattagccaggcatgctggtgcattcgtgtagtcccagctactcgggaggtggaggtggggtgatcgtttcagtccagcaggtcgaggctgctgtgagctgtgattgtaccactgcactccagcctgggtgacagggcgagaccccatctcaaaaacaaaccaatcaacctcctagtttttcttctggtaccgactggtcgcccaggttactggccgtgaatttggaatcgagtccatgtgttctgatgagacagaggatagaggtttcagagtgacatacaaccatgccctcagatgatatgaaacatcacagagatatgtatgtcacacagattctccccagggaccctggacagatcctgcaaggtttttcttctttcttttttttttttttgagacggagtttcactcttttcacccaggctggagtgcaatggcgccatctcggcttactgcaacctccgcctcccaggttcaagcgattcccctgcctcagcctcccgagtagctggaatgacacacacgcgccaccacactcggctaattttttttttttttaatagagatggtgtttcaccatgtttgacagtctggtctcgaactcctgacctcaagtaatccactcaccttggcctcccaaagtgctgggattacaggcatgagacacggcacccagctgatcttccaagtcttaatatacaatgcatgcatgcatgcatgcatacacactagtaaataatacatacacagcaatacagaattatcattacaaagacagcatcaagctactgcagctgtatagccttttctttaaaattcttacattattttaatttcatttccaggctaatgcatattcttctgctctataattttaaagtttccacaatgttgtctcttatataaaggcagtatcactcgagcaatgccccgtggttatttttaatccaaatttgcagatgatgatcaaaggattaaagaatgattcatgtggctaaagttgcagtttgcttgttaaatatttagaaagaaataatgtcaaggccagccatggtggctcatgcctgtcatcccagcactttgggaggcagaggtgggagaatcacttgaggccaggatttcaaggttgcagccagtgattgtgtcataattccagcgcacaagaccaacctgggcgaacagcaagatgccgtttctacaaaaaaaaaaaaaaatgcacagcagccagggtgacagagcaagacctggtctctaaaaaatttaaaagaggccgggcgtggtggctcacgcctgtaatcccaacactttgagaggccgaggcaggtggatcacgaggtcaggagatcaagaccatcctggccaacatggtgaaaccccgtctctactaaaaaaaaataaaaaataaaaaaaaaattagccagacgtggtggcgggcacctgtggtcccatttactcgggaggctgaggcaggagaacggcatgaacctgggaggcggagcttgcagtgagctgagatcgcgccaacgcactccagcctgggcaacagagcaagactcagtctcaaaaaaaataaataaattaaataaaataaaaaaacagcaaatgctctccttggatactgaagtcactctctgagggattcatgggggttttataaggatgaaatgtatcctagtgttggtgtattgctagcgaatacttagtgcttaataaaataactaatattttgaaattcctttgcttgaggaattagagatgtgaagaacaacagatcagaaagcaaactgcaaaataagggatgtacagctgggcgcggtggctcacgcctgtaatcccatcacttaggaaggccgaggtgggcggatcacccgaagtcaggagttcgagaccagcctgggcaacataatgaaaccccgtccctactaaaaacacaacacttagccaggcttgatggcaggtgcctgcagtcccagctactcaggaggctgaggcaggagaatcacttgaacccaggaggcggaggttgcagtgagctgagatcgcgccagtgcactgcagcctggtgacagagcgagactctatctcaaaaaaaaaaagaaaaagaaaaagaaaaaaagaaattcctttgcttgaggaatgagagattcgaagaacaactgataagaaagcaaactgcaaaataagggaagtaattaatcccctcaaaaagtccacattgggggcgggcagctcatatcatgagagactttcagacgaaatcaagagcaatgccaggagtccaacagggagaaaagagaatttgtaaccaagctcattaattccaaagcttgatgaaacagacaattacctaaagggaaaagctgtctaaactgactcagaaagaggtgggaaacttcaacaagcagtagacgcccaaggaattttgaaagctgagttagaatcgctcttccgaaaattcctcaacccatgcggttttgaaggtgaatcgtggcggtgtttcaaaagcagacacttttaaaaatgctaattagacgattctgcaatgtaaagggagaaatagaaaagcttctcaaggttctttctttgttttgtaaacaaattattaaaactttagtatcccgacttgagatagataggaaagaaagtaaatctatagctcccagatacatatcacttcaaaagacctcaaggaggacaggcacggtggctcactactgtatcccagcacttcgggagaccgaggcgggcagattacttgaggtaggtcaggagttcgagaccagcttggccaacatggtgaaaccctgtctttactaaaaatacaaaaactagccgggcatggtggcgcacacctgcaatcccagctactcaggaggctgaggcaggagaatcacttgaacccgggaggcagaggctgcagcgagccgagatcacaccacggcactccagcctggtgatagagctagactccatctcaaacaaacaaacaaaaaaacccaagggaatggctggggcatgaaatcttgcagtgcttaagaagttaatgcatcacgacaacgaagatcattgcagaaatgtgggagctttcagctgctgggtcttaaaaaccaacaccccaaagtacggtgctttgtcctgctgaactgaagaagcctcaagatctctctaacttccccctcctgcttcctctgtgtctcccgatgcacaggatgaagttgttctctgaagtttcctgaagtctggacatgtcaaagaaggaaaaatgaccagtgtccccttccctgagtttctgaacccacatcgcggaggaaagactgatgtctgtcaacagccctgcagagactcctcataaaccactgtctgttctgagggttccacagcctctgtccctgcagagactcgtcataaaccattatctgaggccaggcgcagtggctcacacctatcatcccagcactttgggagcccgaggcgggtggatcacctgaggtccagagttcgtgaccagcctggtcagcgtgatgaaaccccgtctctactaaaaatacaaaattagccaggcgtggtgtcacatgcctgtaatcccagctactcgggaagctgaggcaggagaatcgcttgaacccaggaggcagaggttgcactgggcagaggtcccgccactgcactccactctgggcaacacagaacgaaactccgtctcaaaaaaaacaagcaaacaaacaacaataacaaaaaacattatctgttttcgggccactgtacattgttcaaacccattgacttctctttaaaatcatttactatttggaatcctatattcacccccaattccccactccccttccgctaagaagaagaggacacaagcgtctgtacccctttgtgtaatggggcaattcctctgacattctcctccatggatgagaatacatttgcctgtcatttcctttattcatgtttcaaaaagggcaattgtattttgtgcgttgatttttcagcaaaccttcaaatggcaaagggggatgtttttcccttggcccctaccacagcatccccaaacggtctccagctcctaagaagattcatttatgggcactacctagctacacagcgtcacccaccgagctcgcacacaaccaaggctttggggtgagaatgtacaaatacatcacggaatccaagcccccaacaccgcacacgcagcctggaagtggttgtgtcagagctgtgtgaaccagcgtgactccatcttgaataggggctgggtaacacgaggctgagacctgctgggctgcattcccaggcggttaaggtatgctaagtcgcaggatgagataagaggttgctacaaggtacaggtcataaaaaccttgctgatacaacagcttgcagtaaagaagcgggccaaaacccacaaaaagcaaaatggcgacaagagtgacctccggctgtcgtgacggctacattcccaccagcgccaggacagttacaaatgccacggcaatgtcaggaagttaccctctacggtctaaaaaggggaggcatgaataatccccccctcgtttagcatatcatcaagaaatcaccgtaaaaatggccaaccagcggccgccggggatgctttgtctgcggaggagccattcatttactcctctaccttctcaataacttgcttctctttccaccactgagccgtcctgaattctttcttgcacgagatccaagaaccctcccttggggtctggactggggaccccctttcctgtagcatcttcaggtgcagccgtgaatcagagaagcagaaggggcttaccttgaaaagcaaccagccgagaagcttcttcgccagacgggtggcccagaacacgtgcttgtagacgtccgtgttgaccaccccggggtccaccacgttggcggtcacgtggcttccctcagccgccagcagccgctggaggtggtaggtgaacaggacaagggccagcttgctctgggcgtaggctgcgtggggtgagtagcaggcactgtggggcaagcaggagaaggtgtaagaggctgacggcgttcacgcctaagtgcttcatcccagcagcatctgtacctgcggccacggccacgtctatacgcagccacctcccctagacccatgtgtgatcatgccatctgttggccagttttccaacgcgtgtggatttttctagttcacctttttattataaactcatcccttaattgtattggggtcagatatgttaaattatgttactaattttttatttatttatttatttattttggagacagagtcccccctctgtcgcccaggctggagtgcagtggtgcaatcttggctcactgcaacctccacctgcccggttcaagtgattctcctacctcagcctccccagtagctgggactacaggtgcccgccaccacaccctgctaattttttgtattttcagcaaagatggaagttttaccatgttggccaggctgctctcgaactcctgacctcaaattatccacccgcttcagcctcccaaagtgctgggattacaggcaggagccactatgctccctgttttttttttttttttttttttttttttttttttgagacagattctcactctgtcacccaggctgcagcctcccgggttcaagcgaatctcgtgcctcagcctccagagtagctgggattacaggctcctgtcaccacgcccggctaattttttgtatttttagtgggaacagggtttcaccatgttggccaggctggtcttgaactcctgacctcgggtgatccaccctccttggcctcccaaagtgctgggatgacaggcatgagccaccgcgcctggccacatgtggtcttcttgatgagtctcaaatcataaaagacaaccacacaagcaatttggcaaacttcccaagctatcataaattttcctcacatctactgcaagctctgtagtgtgctaagcacatgttaaactctttgcaccttggttcaagcagtttagagaaatgttttagtatcacaggacatagtgataaaaatcgatccgataaccgcggtaaagtgagtaacgtgcctctctctctctctctggtaacctcaatcaccagaaacacagaaaactggatgtttccagctttgctcctgtaaatatgttctactttttctatgtatgccttagaaacactttttaaagagatgttatttgcggtgttacataacgtcccttgaaggcacacaaccaccatagactccttttagaatttaatgctaggcacagatcattagccttagaattggcctcatagttcttttcaataagacaaggagaagtatttgagcaataatgtttttctttcctctggggctccaaagatgcccagaggcgatcaatttgctacacaattatcgtaacaacatttcaaggtggctgaaggttcatatcgcttgcttcttttatatatatatatatttttaaattttatttttatttatttatttttgagacagagtcttgctctgtcaacccagctggagtacagtggcgtgatctcggctcactgcaagctcctcctctcgggttcaagtcattctcctgcctcagcctcccaagtagctgggactataggcgcctgccacctgcctggctaattttttgtatttttagtagagacgaggtttcaccatgttagctaggatggtctcgatctcctgaccacgtgatctgcccacctcggcctcccaaagtgctgggattacaggcatgagccactgtgcccggcctaattttctgaattaaccacatggtatatgtatcctgatggaagctgtgaacagaaaatatctgggcaccccaaaagcgggaagctcaaaggaaaagtccagctggaacctgctgaaggcaaacctgcctcccactctgttcaaagtcacccctgtgctcactgagatagatgcatatctgatcacctcctttgggaaggctcatcacaaacccaaaagaatgtaaccatctgtgtctcacctacctgtgagctggaagccccctccctgcttccagttgtccctgcttttcaaggactatacttcttatttttttgagacagagttttgctcatattgcccaggctggagtgcagtggcacaatcttggctcactgcaacctctacctcctgggttcaagccattctcctgcctcagcctcccgagtagctgggattaccagcgcccgccaccacgcccggctaattttttgtatttttagtagacatggggtttcaccatgttggccaggctggtctcgaactcctgacctcaggtgatccgcctgcctcggcctcccaaagtgctgggattacaggcgtgagccaccgcacccaccccaacgtagctcttacatatattgattgatgtctcctgtctccctaaaatgtataaaaccaagctatggccagacgcagtggctcatgcctgtaatctcagcactttgggaggccaaggcgggcggatcacaaggtcaggagtttgagaccaggctggccaacatggtgaaaccctgtctctactaaaaaaaaaaattaaaaaattagccaggcatggtggcatgtgcctgtagtcccagctactccggaggctgaggcaggataattgcttgaacctgggaggcaaagggtgcagtgagctgagattgtaccactgcactccagcctgggcaagagagtgagactccatctcaaaaaaaacaaaaaaacaaaaaaacacacaaacaaaaaaaaaacaagctgtgacctgaccacgttgcacacgtcatcaggactttctgaggctatgtcacaggctcacgtccttaaatttggcaaaacaaactctaaattaactgagacctgtctcaaattttcagggttcacaaagccatctcagatatagtttgaatatcagcatgatatttatgctaaaaaactaaagataagatcaaaaagcctaaaagaatgtttaacacattcaaaagatcaaaagaaagacatccgtcatcatatgcgtttcagaaaaagcttctgaaaatccaatgcctcttaccaacaaaagctgttcctaaataagaatacaatattgagggctgggtgcgttggctcatgcctgtaatcccagcgctttgggaggctgaggtgggcagatcaccaggtcatgagtttgagaccatcctggttaacatggtgaaaccccatctctactaaaaatacaaaaaattagctggacgtgctggcgggtgcctgtagacccaactacttgggaggctgaggcaggagaatcacttgaacccgggaggtggaggttgcagtgacacgagatcacgccattgtactccagcctgggcaacagagtgaaagtctgtcaaaaaaagaaagaaagaaagacagaaagagagaaagaaagaaaagaaagaaaagaaagaaagaaaaagaaaagaaaagaaagaaagagaaagaaagaaagaaagaaagaaagaaagaaagaaagaaagaaaaagaaagaaaataaaagaatagaaaattgaaataaatgaagtaaactttgacctaaggatctggagaagaaaaatgaaaatgctttcctaaggaaaacacataaaagaaaaccaaaaagatcaaagcaaatgagaaatacagaaagaaaacagtataaacataaatgataccactggggaacagagactgatgttggtttttgttgttgttgtttgagaaggagtcttgctctgtcacccaggctggagtgcagtggcgccatctcagctcactgcaacctctgcctcctaggttcaagcaattctcctgcctcagcctcctgagtagctgggattacaggcatacaccaccatgcccagataatttttgcatttttagtagagacggggtttcatcaggttagccaggctggtctggaacttctgaccccaagtgatccacccaccttggccttccaaagtgctgggattacaggtgtgagccactgtacatggccctggtattggtttctaaacctcctctccctgttataaaatgtccaatatacactatattttgcagatgaaaagtagaatattacaattacagagcagaccctgaaactataaaaaaaaaattagggctgggtgcagtggctcacacctctaatcccagcactttgggaggccgagatgggcagatcccgaggtcaggagatcgagaccatcctggctaacatggtgaaacctcgtctctactaaaaaaacaaaaaattacccgggcatggtggcgggcgcctgtagtcccagctactcgggaagctgaggcaggagaatggcgtgaacccgggaggcggagcttgcagtgagccgagattgcgccactgcactccagccttggtgatagagtgaaactccgtctcacaaaaaaaaaaaaaaaaaaaaaattagataccctctatattcatgtattcattttttcataaaataaatgaacaaaaccaataatgcatgcctatgctggggctcagagaacagtaacctaaaatgaagacctcagaagcagcatcagaagcaaacctttcttgctgaccttctcctaccctcctgtctctcagacccatttcgccccaagggcaccacggaaactggaatccttcttccccaaggtgggtcccgaaaaccaaagcacctttcccccaaggccagccagaaaccctataaataggactctaagtttccctacaccctgagtatataaaaactcgccataaagaaatttcctatcatcgtgcagtggctcacggctataatcccggcactttgggaggccaaggcaggtggatcacttgagatcaggagttcgagaccagcctgcccaacacagggaaacatcacctctactgaaaatacaaacattaggccgggcacggtggctcacgtctgtaatcccagcactctgggaggccaaggtgggcagaccacaaggtcaggagatcgagactatcttggctaatacggtgaaacccggtctctactaaaaatacaaaaaattaactgggtgtggtggtgggcgcccgtagtcctagctacttgggaggctgaggcaggagaatggtgtgaacccaggaggcggagcttgcagtgagtggagattgcgccactgcattccagcctgggcgacagagcgagactctgtctcaaaaaaaaaaagaaaaaagaaaatacaaacattagccaagtgtggtggcgggcacctgtagtcccagctactcgggaggctgaggcaggaaaattgcttgaacccagaaggtggaggctgcaatgagccaagattgcgccattgcactccagccagggcgacaagagcaagactctgtctcaaaaaaaaaaaaagaaaaagaaaagaaaagaaaaagaaagaaaagaaaaggaaaaggaaattccttgacctgccttgtttgaatgtaggttctacgacccccttcccagagagggtcccaccccacccccagaaggaaggcgcactgctcagaggccaaaaaaatctagacaggcctgtctgtttccccactcagaccgtcagccttagatcacaccctcttcctccaatcctattcctacacggatttcgttcagacgtcgttgaacctaagcataaaaatagacggtttcccctgcatctttgggtcttccctctgaaggctgctgtatgtatccatcgagtaaactttgtatgccttttctcctattcatctgcttttgcaagttgatttttcagcttgcaaaatcagagggaatgaccctccatctgttctcctatcacactgtcatcatttccactgtgaagaacatggggaaaactggccagacaaccaaaggaagggcgtgcacatacatttgcacatcttttgggagagcaacttcacaacatgcaactcaatctttaaaatcataaatctttttttttttttttttttgagacagagtcttgttctgtcgcccaggctagagtacagtggcacaatcctggctcactgcaaccaccccctcctgggttcacaccattctcctgccttaacctcctgagtagctgggactacaggcacctgccaccatgcccggctttttttttttttttgtatttttagtagagacggggtttcaccgtgttagccaggatggtctcgatctcctgacctcgtgatctgcccacctcggcctcccaaagtgctggaatgacagacgtgatgtgagccaccacgctcagccctttttgtgccttttttttttttttttttttttttttttgagacagagtctcgctctgtagcccaggctggagtgcggtggcgcaatctcagctcactgcgacctccacctcccgggttcaagtgattctcctgcctcagcctcccaagtagctgggactacaggcgcctaccatcacgcccagctaatttttgtatttgcagtagagatggggtgtcactgtgttggccaggccagtctcgaactcctgacttcaagtgaaccgcccgccttggcctcccaaagtgctgggattacaagcgtgagccaacgcacctggcctatgaatatcttttagtaacatcactacttgaaattgatcttaaaaaaataaaccttgggccaggcatggtggctcacgtctgtaatcccaggactttgggaggccaaggctggcagatcacgaggtcaggagatcgagaccatcctggctaacacggtgaaaccccgtctctattaaaaatacaaaaagttagccaggagtggtggcgcatgcctgtaatcccagctacttgggtgctgaggcaggagaatcgcttgaacccgggaggtgaagattgcagtgagccgagatcacgccactgcactccagcctgggcaacagagtgagactccatctcaaaaaaaaaaaaaaaaaaaattaagcattgattcaaaaagtcttttctggctgggtgcagtggctcacatctgtaatcccagcagaactttgggaggcagaggtgggcggatcacctgatcctttcaggggtttgaaagggttcttggatctcgtgagaaagaactccgagtgggtccatagagtaaagtgaaagcaagtttattatgaaagtagaagaataaagaatgtgtactccatagatggagcatcccgagagctgctggtggcctatttttatggttatttctctatcatatgctaaacaacgggtggattactcatgagttttctgggacaggggtgaccaattcccggagctgaaggttcatcccccttttagaccatgtcatggcatctgtaaaccgtctcttatcagctaatgcattagaattagcgtatcatgaccagagaggatgaccagaggtcagtcgtcaccatcttggtttcggtgggatttggctggctttaccacaacctggtttatcagcagggcctttgtgacctgtgtcttgtgctgacctcctctgtcatcctgtgacttagaatgcctcatccacctccagagaaggcagcccaagcaggtctcagcctcatgttacgcagcccctattcaagatggcagagttgctctggttctaatgcctctgaaaaatttaggggattgttttctgagccccaacactgtgatcttagcaactgagcaattttcccaccttcatgtaaccaaagacagagtggatcacagagcttggaaagctcgtacccgggaaatcgcagcctgcagctgacatgttctgagatgtgccttgccgttgtgcaaaaggcatgtttgaatgcttgcatgaggacaagtgactcccccattaacacctccaggggctcagttctgcctccagccactgtctcatcacgcagccatgggtagcagaaagccacatgccaaaatctgacatcgggcctgtaaaaaataaaggttcctgttcaaagactttcctccccatctaattaggaataaatagtaacttctctgagaagcaaacttcattcaaagacttgtgctaacattcctaaatatctgctagccgtgataaagaaatcaatgtactttatgctcttagctcccacaatttaacctaagtatcagccctggcatgcttatactggtccaagcaagcattacgtcacagcctgttcctcttctttatctaaaagtgctttttcctttctcagcattccacaagttacttcctccttcctttgttctcctctgcctttgcctcttttaaatagttccaaggtgctggccaatcgggacaaatacagaatgtgaggtcccattccagccctggaaactggacacagcagtagggcggacgcatcaagtgataaatgaccctgtcccctttgttcgctgtactctcctggcaaaactgctggagagtgtaccctttctgcagaaagtaaaaaaaatggccttgctgaggaaattaatgttcaagtgctatttctttatggcactggggaacaagcatttcaaacagacctgaggtttacccgatttctgctggaaaagaaacctcaggtctgctgccttagaaataaataagggcaggacagaaagggtgacaagggggtccttagccatggagactttgcaaaataatgaacaatcaaaacataactttttgggggttggggtggggtaggaggggactggaaaggctgactgcataataaagagattggaagaattggctgggtatggtggcttatgtctgtaatcccagcactttgggaggctgaggtgggtggatcacctgaggccaggagttcgagactagcctggccaacatggtgaaaccccgtctctactaaaaatacaaaaattagcagggcgtggtggcaggtgcctgtaatcccagctactcgggaggctgaggcaggagaatccttgaacccgggaggtagaggttgcagtgagctgataccacgccattgcactccagcctgggtgacaagagcaaaactctgtctcaaaaataaataaataaaaagaaatctaagagactggaagaattaagacagggaaattgagtagttcagagctgaagtcccatctctgatccaagataaactgtaaacctccaattactgtcaagatatctttttaaggcaaacttctccaatctcctcaccccaggggaagagaagagtccaggaaacagatagttactaagtgcagagaggcaaagactggctttcctgctggcatgatcgttttttaaatatcagctacaagcattcggttctgaatctccagcatttgattgatgggtaagaggaatggttacttgaaaaagcagaaaatgcatcatccaaaggcagatttttccagagtaaatggaggggttggttctgtaattatggttttacacagtagcgtggagaagagagaactaagattgtttaaaaatacggtgtgggggcaggcgaaaagccaatacatttctctacaggaggtgaagaaatgaatccaagaggggcacgtagtttcaggagagattccctggggtgggggttagggatgaagaaatatccaccccagaaatgggaaagaatgaaagcaaatacgtaggaggaaatgcccattaaggtctgtaaatgaaaccctaaggactctgacaaaagtcgttggtattaggccgggagtggtggctcgcgcatgtaatctgagcacttaggggacactaaggcaggcaggtcgcttgagcccaggagttcaagaccagactggggagtatagtaagaccttatctctacaaaaaatacaaaaagtacctgggtgtggtaaagcacacctgtagtcccagctaattgtgaggctgaggtgggagcagatcatttgagcctgggaggcgcacatggcagcaagccaagatagcgtcactgcacggcctgggaggcagatatggcagtgagccaagatggcgccactgcacggcctgggaggcggacatggccttgagccaagatggcgccacggcactccagcctaggaggcggacgtggtcgtgagccaagatggcgccacggcactgcagcctgggaggtggacatggccttgagccaagatggcgtggccgcactgcagcctgggaggcggacatggccgtgagccaagatggcgccacggcactccagcctaggaggcggacatggccgtgagccaagatgtcgcggccgcactgcagcctgggaggtggacatggcagtgagccaagatggcgccaccacactccagcctgggaggcggacatggccgtgagccaatcagcaaagatggcgccactgcactccagtctgggtgagacagggagactgccaaaaaacaaaatgaaacaaaaaatcattcaatgagctttcctgttgaataagaaactgaacaaaagccacctgctactaaatctggaccttataaaagggtatttgagttctccattttttgctgattaaagcattactctcttcttgttattaaaaatcgtgaagactgaacatacttttgagtgtttataagaccgggcgcggtggctcacgcctgtaatcccagcactttgggaggccgaggcgggcggatcacgaggtcagaatatcgagaccatcctggctaacagggtgaaaccccgtctctaataaaaatacaaaaaaattagccgggtgtggtggcagacgcctgtagtcccagctactcgggaggttgaggcaggagaatggcgtgaacccggaaggcggagcttgcagtgagctgagatcacaccctgcactccagcctgggcaacaaagcaagactctgtctcaaaaaaaaacaaaaagaaaggagccctttataagttattgtgatggatactgtaggatgtaaacgtgtcatatctcggtctcccaacagccagtctccgtaggcggtgtccttttatatggatcaacaggcagtttttgcattgattatttatccactttgagaggtacttgtgtagaagcaaggacaactgagtttttatgttaacttcctacgaatccgttgcattgcaacgtatttccattgcaggacattgttgcataatcaaattgccaatgcaattagggaaactcaatcgactgctcataacctagttgactggagctatttttccagtgctcattaaacctgatgacaatcactgttttaatgagtaagtatgggtggcattcaatatatttataagtattataacaatccttcatgtctaaattgaattttccctttggcagtacaaacaactccattacattctttctaggatatctacgcttaatattcttgataactatcatctacatttaatattcttgataacgatccgcctaccaggaactcagaaaatactgcgaataaagagaggttttttttgtttgtttgtttttttgaaacagggtctcgctctgttgctagggtggagtgcagtggtgcgatctcggctcactgcaatctccgcctcccggattcaagtgattctcctgtcttagccttccgagtagctgggactacaggtgcccgccaccacactcagctaattttggtatttttagcacagtggggtttcaccacattggccaggatggtcttgatctcctgaccttgtgatccaccccctaggcctcccatagtggtgggattacaggtgtgagccactgtgcctgccccacgcccccccccttttttttctttttttttttttgagagggagtcttgctctgttgcccaggccgggctggagtgcagtgctatgatcttggcttgctgcaacttccacctcccgggttcaagtgattctcctgcctcagcctcctgagtagctgggactacagtcacccgtcaccacacccagctaatttttgtatttttagtagagacgggtttttaccacattggcctggatggtgtcgatctcaaagagaggtctttgactttttccgctaagagaaaacaaccaaaacaacacaggacattgcaggtatcttgtgaattccagctgcatccaaacaccctgatactttcgctcatagacacatagtgagtgtgtcagctgtccgacatatctcagaacacagggggaacatgtgaaaccttgagtgaaatccgaatcgagatgggataccacactcaaaacacgttacacaacttagtctatactggatgatttcacgggatgtgaattcatggttaggaataaaataatgaagaagtcacccaaagttacataagttgagaaactcaaaccaagacagccatgttcacagtgaggcacgcccatgcctataacaactccatgactgagggacgtcagagtgaaataaagaatttcttaaataggtagagaatctatcatggccaggcacggtgggtcacacctgtaatcccagcacattgggaagtcgaagtgggcagatcattcgaggtcaggagttcgagaccagcctgaccaacatggtgaaaacccagctctacaaaaaaaaaacacaaaaattaggtgggcatggtggcggtgcctgtagtcccagctacccgggaggctgagacaggagaatcacttgaacccacgaggcagaggttgtagtgagctgagattgcgccactgcactccagcctcgatgcctgggtgacaaaagcgaaactctgtctcaaataaaataaaataaaacaaaacaaatttaagggtctcacaggaaagaaatcttaaagaatagaaaatgattttggaaggtatgtgtccctcttttttttttttttttctctccaggctggagtgcagtggtgcgatcttggctcattgcaacctccacctccccggttcaagcaattctcctgcctcagcctccccagtagctgggactacagggacatgccaccatgcctggctaattttttatattttagtagagacggggtttcaccatgttggccaggatggtcttgatctcctgaccttgcgatccacccctctcagcctcccaaagtgctgggatgacagacttaagccactgtgcctgcccttttttttctttttttgagagggagtcttgctctggagtgcaagctgggctggagtgcagtagcatgatcttggcccactgcaacctccacctcccgggttcaaacaattctcctgcttcagcctccaaagcagctgagattacaggcacatgccaccatgcctggctaacttttgcatttttagtagagacggggtttccccatgttgaccaggctggtctcgaactcctgacctcaggtgatacgcccgcctcggcctcccaaagtgctttctattgaaatttatttcaccatggggatgattcggtacagccaagttgaggagacatgttctctcatgtgtaaaaactcttggatttttggaatatgttacaacactgtgatttattcctttacaagaacgctaattttccaagccagtaaatcaatcttggcaattaacactaattactggcaatgattatatcaggcaaaagccaagaaccacatctttcatccaaaaaaaaaaagcagtatattttaaattcaagtggttctcatattttagcatgcatcagaattcccccaaagaccttctccttgccaacccctgttctccaaacttcgggtttaggagatctggaggatggtctgagaatgggagcatcttcatttcttttttctttttcttttttaagacagaatcttgctttgcagcccaggctggagtgcagtggtgcgatcttggctcactgcaacctctgcctttcgagtcccagttgaagcaattatcctgcctcagccttccgagtagcagggattacaggtgtgcacccccacgcccagctaatttttgtatttttagtagagatggggtttctccatgttggccaggctggtcttgaactcctgaccttgtgatccacctgcctcggcctcccgaagtgctgggatgacaggcgtgagccaccatgcccggcccactcaccatatatttactgaacttcagtcatatgtgacgcagggatgacacaagaacagaaaaatcagggagatggagacggagctaaccacggaagctgaagttcgtcggccagatggcccaatgcacaataattcggggaacacacatccaggcaactgcacctgactgggaatacctggctgtcctaccaccatctggtcatctaggggctcctacagtaatacagaagacgccggctgaggcgtgttctattctaccaaggggacctgggcgtatctcatggactgaattacgtctccccagattcctatgaagttctaactctgaggaactcagaaagatgaccttatttggagatagggtccttttattttatttattttttgagacagagtttcggtcttgtcaccaaggctggagtgcaatggtgcaatcttggctcactgcaacctccgcctcccgggttcaagcgattctcctgcctcagcctccccagtagctggggttataggcacctgccatggcgcttggctaattttgtattttttaagtagagacggggtttcaccgtgttgtccaggctggtcttgaactcctgacctcaggtgatccacctgcctcagcctcccaaagtgctgggattacaggcatgagccaccatgcccggccggagatggggtctttaaagatgcgattcaggtaaaatgaggtcactagggtaggtactgatccaataggactgaggtccttataagaagaggagatgaggacacagacacacacagagggacaaccaagtgaggacacagggcgatgatgacatctccaagcccaggagagaggcctgaggaggaaccagccctgctcacaccttgatctcagacctccagcctccaggactgtgggagaatcaatgtctgctgttataagctacacagtctatggtattctgtgatagcagcctgagatggagtaaggcattgcataagaagaggagatgaggacacacacacacacaaagggacgaccctgtgaggacacagagagaagatggcgtctacaagtccagcagagaggcctcaggaggaaccagccctgcccatacctggatctcaaacttctagcgtccaggactgtgagagaataatgtctgttgtttataatctacccagtctatggtattctgtgatagcagcctgaaatgggctaagacacctcataagaggaggagatgaggacacagacacacacagagggatgatcctgtgaggacacagggagaagacggtgtctacaacccaaggagagaggcctcaggaggagtcagccacacccacaccttgatctgggacctccagcctccaggactgtgggaggctcaatgtctgctgtttaagccactaggtccgtggtattttattatggcagccccagcaaagcaatgttctctcctttaagagatcactcctaagctatgaacgatgaaaaaggggcctatttggaaagagtcagtgccgtcaacgaagaacagtttccagaaagctcagaggaggcatctgttaacactctctcattatcccctgcagaggaatcatggagaaatgaaacatggctcaggtgaatgcctgtcatcaatattcattttacataatcaaactggtgaagcaaaagaggagaacaggaaaagaaaagcagtgtaagttgaattgtaagtctcgaaaaaatagggggaagtggccgggcgcagtggctcacgcctgtaatcccagcactttgggaggccgaggcgagaggatcacgaggtcaggagatggagatcatcctggccaacatggtgaacccccgtctctactaaaaatataaaaattatctgggcgtgatggcgcatgcctgtaatcccagctactcaggaggctgaggcaggagaatcgcttgaacccaggaggtagaggttgcagtgagccgagatcgcaccactgcattgcagcctgggcgacagagcaagactctgtctcaaaaaaaaaatatatagatagatatatagatatagatatagatatatagatagatatagatatatatagatatagatatatagatagatatagatatatatagatatatatatagatatatagatatatatatagatatagatatatacaataaattaaaataaaaacaatacaatacaaataaataaacaaaaaatgttagagccggctctgagctggctctggctctcaagccctttgactttgaagttccttgatctgctttgcaatctgtattactttcctgggattgtccaaacaaatgagcacagactggatgcttcaaagtcacagaaattcatccagtgaagtgataccttctggagaccagaagtctgaaattcaggagtggacagggtcgtgctctctctggacggtcttctagggcaggaacccttcctgcctttcccagcttctgggggctcggggagtccctgaccccgtggtcagatcactccagtctctgcctccgtctccacgtggacttctcctctgtgtctgtgtctcctcttctgtcttttagaaggataccggtcagtggatttaggacctaccctactccaggatgatctcatctctagatctctaactaattacaccggcaaagttctttattttcaaataaagtctcattctaggttctgggcttcgggatgtggacagatctttctgtgaaccaccattcaatccactacaattgtatccagttccctccagaggctctaggggagggcccttcctgcctctcccagctcctgggggctccgggcatccctgaccctgtggctgcatcactccagtctctgcctccatctccacgtggccttctcctctgtgtctgtgtctcctcttctgtctctttccaagaacacctgtcattccatttagggcccttcttatatgtagagtggggtcggaatagttaatattatgtgttaacctgactggatcatggggcacctagatgtttgattgaatgttactctggggtatctgtgagggtggaggggagggtccttcctgcctctcccagctcctgggggctccaggcatccctgggtgtgtggccgcatcactccagtctccacctccatctccatctccatgtggccttctctgtgtctctctgtctccaaattttctacttcattttttttttttttttgagacagagtttcgctcttgttgcccaggctggagtgcaatggcacgatctcagctcactgcaacctccacctcccaggttcaaggaattctcctgcctcagcctcccgagtacctgggattacagacgcgcagcaccacgcccggctaattttttgtatttttagtagagacagggtttcatcatattggtcaggctggtcttgaactcctgacctcaggtgatctgctcaccttggcctcccaaagtgctgggatgacaggcatgagccagtgtgcccaggtattttctacttcttgtaaggccacccatcatattggatcaagggtctaccctaatcatctcatcttcacttaattccatctgcaaagacctatttctaaattaggtctcaattatacatatttggagttaggatgtggacataactcttcagataagagttaatggtggtcgggtgtggtggctcatgcctgtaatcccagcactttgtgaggtcaaggcaggcagatcacttgaggtcaggagtttgattacagcctggccaacatggtgaagccctgtttctactaaaaatacaaaaattagctgggtgtggtggtgcatgcctgtaatcccagctactcgggaggctgaggtgggagaatcattggaacccgggaggcggaggttgccgtgagccaagatagcaccactgcactccagcctgggcaacagagtgacatttgtctctttcaaaaaataaaataaaataatagttaatggcatataagcaataccgtcaaagcctttctttaatatgtgtttttataggaataaaaactctcttgttaattgcacttggtaatatatgcttcctcagctttcttaggtgataatgaggctcaattcttattaagcgcatgaatctgctctgtagcacctaaagtctctaggaagtagctgtcatttctgttgggtggggttgttctggatgtgatctgcttatcttcattattcaaaacagagatcgtggctgggcacggtggctcatgcctgtaatccacgcactttgggaggccgacatgggaggattacctgaggtcaggagttcgagaccagcctggccaacgtggcaaaatcctgtctctactaaaaatacaaaaatcaactggacgtggtggcgggtgcctgtagtcccagctgcttgggagtcgaggcaagagaattgcttgaacccgggaggcggaggttgcagtgagccgagatcacaccactgcactccagcctgggagacagagtgagactccatctgaaaaaaaaaatgagtaaatacaacagagattgctttgatcaacagtatcaaccccaaagtgagctctcagaataacagacaggcggccctccaccagtgctgtacgaggaaggggtgttcctgtgtgtctttggcgagcggtaatgcctgccaagcagctcacattccccaggttccccaacccatgccttgccttgctcagtgagtcgtgtctgcagcaagtgctgctggctgtgccaagactcctcgttccctcctcccttctcccaggccctctcatacagcaggctccgtgtgtggagccccgagtgggcatcagggaaggctggcccccacacacccagcccagcctcaggcctggagttagggaagccagtcatggcagggctgttcttgccagtgggtccaggcaaacccttcagcatggagcccgaggcaggaggcctacacaatcctgcagtgagccctgagctgagaagaagcctgagaaacacgcatgtcttcctctgggtgctgtcatgcatgggtgtgaaaacaggaaatgccccagccagcatacacacgtcacctgcgcacactggcacgcacatgactcacctgtgcacacgagcactcacgcaccttatctgtgcacactggcacgcacctcacctgtgtacacaggcatgcacatctcatgtgtgcccacgggcacaaagacctcatctgtgcccacaggtacacacaactcacctgtgcatatgggcacgcatgcacctcacctgtgcatactggtacacacctcacctgtgcacattggcacacacatctcagctgtacacacaggcacgcacacatgcccttgcttcctcagggcaccatgaaggagaagcagcccctcccggccacaggccctgctctccctgcattcctctcacccgcccttccctgcacagcccggtgcttcttcagctgcccggagaagatgaagtcctggccagcctcgctccttccctcccacaaccggcagggttcacacttcatgcaggatcccatcgaggccgactccctcatcccacacccttcagagcagagaggctcacagacacaggagctcaattcgacaaaacagatgggccaaggtatcctaggaggcccccacggccctcccttcgttacatcctgcccctcgctgtgcagggaaatgcaaactgttaggagctggcagggcctgtgcccctgggctcaccctcctcgtagtcctgagggtactccagggcctgggggtggggagggcgcccaccctgctgtacattacagaggctggccccaaagtctgatgctggcacagccaagcagccagttctttccgagtgtggcattaacgctttgtgatcttagggctgcagagaaattcaaaggcgagtccgactgtgtgctctgactgtgtctgtctccaaattcctacatggaaatcctcatcccccgtgagatggtgttaggaggtgaggcccttgggaggtgatgaggtcacgatgggggagactcaagtatggaatcagtgcctttataaaggggaccccagagagctcccttgccccttccactgcttgatgacacagtgagaaggtgccatgtgtgaaccaggaagcgggttctcgccagacgctggcacactttgatcttggacttccagcctccagaaccgtgagacataaatgtgtgttatttataagccacccaaactatggaatttttctttcttttttttttttttttttgagacggaattttgctgttgttactccggctggagtgcagtggcgtgatcttggctcaccacaacctccgcctcccgggttcaagcgattctcctgcctcagcctcccgagtagctgggattacaggcgtccaccaccacgcctggctaattttgtatttttaatagagatggggtttcaccatgttggtcaggatggtctcgatctcctgacctcgtgatctacctgcctcagcctcccaaagtgctgggatgacaggcgtgagccaccacacccggactgctggattttttcttatatcagcttaaacaaactaagatgattattcccacagaggaatcgtttttatccttaaggcggggttaggaggaattcacaagagagacctgctgatggacagacagtacattgcgtgtcgacaggagtccacaccaatgccacctgcagatgcagtgcctgacattcccatgggggcacaagagaaggtttaaatagatccgttttccttttctatgtctcacctctgtgtttcttgttccttctaaaaaataaagtaacaataccatcgcacattgctaagttgcccaaggacagcaaatggctggggatgtacatatcccacaacacagcgccaggagcacctgtgcccggcagatgcaggcagcaccatttccagagcacatgtgcccagcagatacaggtagcagtgtgcccagagcaccgctacccagcagaagcagggagcaccgtgcccagagcacctctacccagcagactcagggagcaccgtgcccagagcacctgtgtccagcagactcagggagcactgtgcccagagcacctctacccagcagatgcagggagcaccatgcccagagcacctgtgtccagcagactcagggagcactgtgcccagagcacctgtgctcagcagacgcagagagcaccgtgcccagagcacctgtgtccagcagactcagggagcactgtgcccagagcacctgtgctcagcagacgcagagagcacaatgcccagagcaccagtgcccaccagatgcagggagcactgttcccagaggaccatgcccagcagatgcagggagcatcgtgcccagaacatctgtgcccagcagatccagggagcaccatttccagggcacgtgcgcccagtagacacagagagcagtgtgcccagaacacctgtgcccagcagacacagggagtaccgtgcccagagcacctgtgctcagcagacacagggagcaccgtgcccagagcacaatgctcaggagatgcaaggagcaccgttctcagagcacccatgcccagcagatgcagggagcactatgccgggcaccaatgtgcagcaaatgcgggggcactgtgcccagagcacccatgcccagcagactccagggagcaccgtagccagagcacctgtgcccagcagatgcaggaagcaccagtgctcagcagacgcagggagcactgtccccagagcaccagtgtccagcagacacagggagcactgtccccagagcaccagtatccagcagacgcagggagcactgtccccagagcaccagtgctcagcagacgcagggagcactgtccccagagcaccagtgtccagcagacgcagggagcactgtccccagagcaccagtgctcagcagacgcagggagcactgtccccagagcaccagtgctcagcagacgcagggagcactgtccccagagcaccagtgctcagcagacgcagggagcactgtccccagagcaccagtgctcagcagacgcagggagcactgtccccagagcaccagtgctcagcagacgcagggagcactgtccccagagcaccagtgtacagcagacgcagggagcactgtccccagagcaccagtgtccagcagacgcagggagcactgtccccagagcaccagtgtccagcagaagcagggagcactgtccccagagcaccagtgtccagcagatgcagggagcactgtccccagagcaccagtgctcagcagatgcagggagcactgtccccagagcaccagtgtacagcagacgcagggagcactgtacccagagcaccagtgtacagcagacgcagggagcactgtacccagagcaccagtgctcggcagacgcagggagcactgtccccagagcaccagtgtatagcagatgcagggagcattgtccccagagcaccagtgcttggcagacgcagggagcactgtccccagagcaccggtgtccagcagacgcagggagcactgtcctcagagcaccagtgtacagcagacacagggagcaccgtccccagagcaccaatgctcggcggacacagggagcactgtccccagagcaccagtgctcggcagatgcagggagcactgtccccagagcaccagtgtacagcagatgcagggagcactgttcccagagcaccagtgctcggcagacgcaggaagcactgttcccagagcaccagtgtacagcagacgcagggagcactgtccccagagcaccagtgctcggcagacgcagggagcactgtacccagagcaccagtgtacggcagacacagggagcactgtacccagagcaccagtgtacagcagatgcagggagcactgtccccagagcaccagtgcttggcagacgcagggagcactgtccccagagcaccggtgtccagcagacgcagggagcactgtcctcagagcaccggtgtacagcagacacagggagcaccgtccccagagcaccaatgctcggcagacacagggagcactgtccccagagcaccagtgctcggcagatgcagggagcactgtccccagagcaccagtgtacagcagatgcagggagcactgttcccagagcaccagtgctcggcagacgcaggaagcactgttcccagagcaccagtgctcggcagacgcagggagcactgtccccagagcaccagtgctcggcagatgcagggagcactgtccccagagcaccagtgtccggcagatgcagggagcactgtccccaaagcaccagtgctcggcagacgcagggagcactgttcccagagcaccagcgtccagcagatgcagggagcgccacaccgcacagacagagggagatgaataacctttaacccacctgagatgctgttatgattattcacagggtgcacctacctgctctgaaggtcatccatgttcagctcagcgacgtaatgggtggcagaggagacggtgaccaccctcgcactgtggccaggggacccagactctttcagcgtatccaagagaaggttggtcagcaggaagtgccctaggtagttcaggccgaaatgttcttcgaatccatctctggttttcctctgagggaccatcatcaccccagctggacaaaagagaatatcagaaggagttagactggggaagacagtggagaaatctcacagatggattccccagatgcgcaaatggcccaggacatcggagggtggggtgtagagctggcggccatgtcttcctcctgggcctctgtttcctgctttaggtgtgatggagaagattctagaagatcactgaagtcccttcctgccttctgtctctgcacctctgtgccttgagtttaaaaataataaccacaggccgggcgcggtggctcacgcctgtcatcccagcactttgggaggctgaggcgggtggatcacctgaggtcagaagttcatgcctgtcatcccagcactttgggaggccaaggcgggtggatcatctgaggtcaggacttcaagaccagcctgcccaacatggtgaaacccttgtctctagtaaaaatacaaaaattagccaggtttggtggcagggtcctgtagttccagctactcaggaggctgaggcaggagaattgcttgaacctgggaggcggaggttgcagtgagctgagatcatgccactgcactccagcctggtgacagagcgagactccatctcaaaaaaaaaaaaaaggaaaagaaaaataataaccacaatgataacacagcaacacacacaagagagtgagaatcatccaagtcaccaaacagagtcccctggacaattaattattctgggcggctaggtgtgatggctcatacatgtaatcccagcctttgggtaggtgagtagggcagactgcttgacgtcaggagttcgagaccaggctgtgcaccacagtgaaactccatctttaccaaaaatacaaaaaattagtgggtgtggtggtgcgtgcctgtagtcccagctactcggggaggttgaggcgggaggattgtttgagcccaagaggtggaggttgcagtgagccgagattgtgctactgcaccccagcctgggcaacagagatcctgtctccccccagaattctggacaagtatagctgctatggcaccccctcttcactgagtatcccacaaacaaactgctcagatgtcctttgagaaatgccgacctcagtataaacatggcctgtcctcacccctagaccacagggcagccctgtcggtcatcattctatagacatcatcatcaccgcaggttctgtgcttgacatgttctatctaccagacacagaacagcccacccctgtcaggccaagcccggctgagcgcctgccctgaagtccttgctgtggaggcctgatctcaaaggtgacttgtcctagaaacacgcacgaaccatactgccttgtacttagagcagaccagtttgcttggatattaatgccaatgtagatatgtatttgtatgtacatggataatgtagatgtgtatacataggcatgttatatatgtacctggaattctgtatctatctacacgtaacgcaaatacaggcacgtctattcatatacatatatgcatacgcatttgtaaatgtgtttatatagctatacacttgggtatataactgcatgtatgcataattcaaagatatatgcctatagagatatatgttagcatgtacatatgtgttcacgtctttacatgcagattcattttcaaatgcctataaatttgtgcatattttcttttacatatgtgttgtatgcacatgtgcatgagtttgcatgtgtacacatttattcacatgtatatacatgtccatacacatttacatctttgcatgtgtatctgcatacagtgtatgtatatattatatgtttctatttggaattgtacaatcgcaagtatttgcatgtgttcatacacctacaaacacacagcatttgtcattatttgtacattggaacatctacgtgtattgcacgcatgaatatgcattttgattcatctgtggaatcccatagcttttgcatttgtgcacgtttgcatttgcaaatgcatttgaggtgtatgattaatacacacacacacctatccatttgcatatggacacgtttgtgttcaaagatgtatttcaatatggagctatattgatatttgtagatctatttctgtatttgtatatatatgtgtttgcatctgcatgtgtacatatctttctatgcatatgcatttgtatatgtgtttgtgtgtattttatatggagctatctatacatatatgtaggtctagcatttgtctacatatttgtatatgtatatctgcatgtgtacatattttcctatgcatatgcatttgtatatatgcttgtattagtgtgtatgtattttatatctacacacaaatatatagaggtctagcatttctctgtgtatttgtacatgtatacatgcatctgcaagtgcacacattttttatatgtacatgtatttgtatatgtgcttgtatttgtgtgtattttatatggagatatctacacatatataggcctagcatttctctacttatttgtatatgtatacgtgtatctgtacatgaatacattttcctaggtacatgcatttgtttatgtgcttgtatgtgtgtgtgtattttatatgtatgtatttatttattttttgaggaggagtttcgctcttgtcgtccaggctggagtgcaatgaggcagtctcgcctcactgcaacctccgcctcccaggttcaagcaattttcctgccttagcctcccgagtagctgggattacaggcacccaccaccacacgtggctaaatttttctgtattttcagtagagacggggttttgccatgttggccaggctgctctcaaactcctgacctcaggggatccgcccacctcggcctccctaagtgctgggattacaggcgtgagacactgcacccggccgtgtgtgtattttatatggagatatgtatatatctataggtctagcgtttctgtatgtatttgtgtatgtatatgtacatctgcatagcgtacatctttttctatgcatatgcatttgtacacgtgcttgtgtttgtgtgtatcttatatggagctatctatacatatatgtaggtctagcatttctctatgtgtttgtatatgtagaggtgtatccgtaggtgtatacattttttgaggtacatgcatttgtatatgtgcttgcttctgtgtgtactgtaatatctgtatgttatttgtgcctcggtacatggacccatttccctataaatttttgatgcgtgtgcatttgtgtacctgcctgtgtttgtgtacacagtctttccagttgtactttatgaacactcaaaaccaaagctggctcctcgccggctcagcattcccaaagaaccaagcaggagccacgtggccttatcgacccaactttggaactcctacagagttgtcaccactgccccattctaggaattacgagacagttaatgaggacagccgagattcaagagacggagcagggactccagctcccgaagagacaagtgtgaaaagaatttgcaggcctgttttacagcctctccaacccgcctttcaaaactgtggatgcacaggccgcactggatgccccattgcgcggagggcccacagaagactcagcagtgggtcccgcggctctacacgtccctggccccagtggaggcttgacaattgtgaggtccttgaggaaaaaccaacgtcttattctggctgtagcctccacagtgcggttgtagtgctttgggtacagcaagggggaaataaaaaataaacgtggatggagatctgctgcttttgagacgtgaagccacctggacttcctgggtcgagtggagacccggagaccttttgtctagctaaagaattgtaaaggcaccaatcagcactctaaaatggaccattcagcagtctgtaaaatggaccaatcagtgctctgtaaaatggaccaatcaatgctctataaaatggaccaatcagcactctgtaaaatggaccaatcagcactctgtaaaatggaccaatcagcactctgtaaaatggaccagtcagcaggatgtgggcggggccaaataagggaataaaagctggccacctgagccagcttgtgtccccttccacgttgtggaaactttgttgtttcactcttcaccataaatcttgctgctgctcactctttgggtctacactacctgtatgagctgtaagactcactgccaaggtccgcagcttcactcctgaagtcagcgagtctgcgaacccaccagaaggaaaaaactccaggcacatctgaacatctgaaggaacaaactcgggacgcaccatctttaaaagccctaacactcaccgtgagggtctgcggcttcattcttgaagtcagcgagaccaagaacccacaagaaggaataaattctggacacactctcacagagaatggtggcaggggagaggcaccaccatgccattccaggcctgtggcctgctgaaatcctcagggagaaatgagcagactgttcaggtgcagtccttgcttctcacctgcacacactttccagccagactcagtgcttccccctcctacgtgaatatctagctttcaaaaaaacttccaggatacagagaatttattccctgagcttatgcctgtaaaacatcaggagtataaaccaactgggagggatccaatatcaatcagggtccagtatcaatcagtcacaagacacatgtgtattaaacattcaacactcctacagtcctcaaagcccatctaacaaaacacttctgagaagtatgtcagaattcacctcaggagttatccagaaaaaaagcccggcccggtgggtcatgcctgtaatcctcccagcactttcagagggcgaagcgggcagatcagttcaggtcaggagttcgagaccagcttggccaacatggagaaaccttgtctctactaaaaatacaaaattagccgggcgtggtggtgcatgcctgtaatcccagctactcgggaagctgaggcaggagaatcgcttgaacctgggaggcagaggttgcagtgagccgagatcacaccactgcactccagcctgggcgaaagagtgagacaaaacgaaacaaaaaaacatacctgcacctgtctgtttcttgcagcacaactcacaactgcaaacatacggaatcaacctaagttgatttttgtctcaaaaacaaaaaaaaaccaacaacaaaaaaacaaaaacaccagaataggttgctgtgggtggacgggaagctttgcattttgatgaactataaacatctttttcacgatgccattttcctcatattttatttgatgtgaagaatctggagacacacagctcaatccgtgcctgaagtgtcataaattcccagcttaggagagacgagcttatcatgaacacctggcttatgcatgcatggttttgaaaggcagcttcagggggctctaaagcaggcctgcaaattcttttgacactcgtctccttgggagctagagtctacgccccttcccttgaatctcggccatgctcattaactttctcgttaattcttttgtagaatgccacagtggtgtaaacactgtgtgacttccaaagttgggtcaataaggtcacgtggcccctgcttggttcttgggaatgctgagtctgggaggagccagctttggtttaaaaagactgagcaccttcagcctgacatgctggagaggccccaggtacctgttcttgttggccctcccagctaagcccaggtgacaggctgtaccagcttcttgacaccagagaaagctatcctggacatccaacctggtcaagccttcagataaagtcagccccagctgcagccccacaggagaccccccaggcagaactgcctacattcctgtgccccgaaagaaagtgaattcatacaagctgtatagaaaacagcacggatgttcctctcaaagaactaaaagcagatcatttgttcgatccagcaatcccactcctgggtatctacccaaaggaaaagaagtccttatatcaaaaagacacctgcaggccaggcatggtggctcacgcctgtcatcccagcactttgggagaccaaggcgggcagatcacctgaggtcaggagttcgagagcagcctgggcaacatggagaaaccccagaattgcttgaacccaggaggtggaggttgcagtgagccgagatcgcaccactgcactccagcctgggtgacagagcaagactccatctcaaaaataaataaatcaataaaataaaataatcaaacaaaacaatacaaaacaaaatacctgcacctgtctgtttcttgcagcacaactcacaattgcaaacatacggaatcaacctaagtacccctccgtggagtactggataaagaaaatggaatggaatactactaagccattaaaaagagtggaatcgtgtcattggcagtaacttggatagaactggaggttattattctacgtggagtcactcaagaacagaaaagcaaatacacgttctcacttgtaagtgggcactaagctctgggtatgcttctggcattgaaggggcatacggaatagaggaatacacattagagactgagggtggggctgtgagtgaacctgtcacccaggaaatggccactgtacccaacaggtggtttttcatcccctgcctccctccccctaccttctagcagtcaagagtttctgctcttcccatctttgtgtccatgagtacccgctgtgtaccttccaggtgtaagtcagaacatgcagtatttggttttctgtttctgtgctggttctcttaggataatggcttgcagctctgagcaaattcttggtgacaacagcatcgttggggaaggtatcttttgcaagagcagaggggacagtgcttctgtgcaggcaggtggtgacctgtgctccagatgaatccgagccgtgctagggactcgcctggcggggaagctgcgtgagaattcctgcgccgtggtgaatgcagcagccacgcgcaggggccctggatgctgataattcatcgttagtgagctactgcgagtaattacgtttattcctattttattattattattattactttgaggtaaactcttgctgtgtcacccagactggagtgcagtgttgtgatgtcggctcactgcaacctctgcctcctgggttcaagcgattctcctgcctcagcctcccgagtacatgggattacaggcacctgccccgatggccagctattttttgtatttttagtagagacggggtttcaccatgttggccaggctgctcttgaactcctaatctcaactgatcctcccgccttggcctcccaaagtgctgggactacaggtgtgagccactgcacccagccctactaatattattatttttttggagacagagtctcgctctgtcaaccaagctggagtgcagtgtgtccgtattttattttttatttcattttttttgagatggagtctcactctgttgcccaggctggattgcagtgggttgaactcggctcactgcaacctccgcctcccgggttgaagtgattcttctgcctcagcctcccaagtagctgggattacaggtgtgcaccacaacacccggctaaactttttttttttttttttgtatttttagtagagatggggttttgtcatgttgaccagtctggtctcgaactcctgaccccaagtgatctgcccgcctcagcctcccaaagtgctgggatcccaggtgtgagccaccgcgcccggccacgcacccgtattttaaaccacagtgtcacggagacgtttctaggcagcaaacccacctgaaacgctgatatttacggaacgaaagcctgacatattctgaaggagaaattgttttgttgttgagttctttgccagtggctttaggtattaattttcctcttcctatgtaagcagagcattgaaagaccagattggtgccaggtagagagattggatgggtgcctgagatgcctgttaggaggccattatcatggcctaggaagagatgatggtaccccagaggagggattgacggaagtccgaaatgcagaattgagtactagttagacaatcgacggcaaattcaaatgcctgtaggcttttgtatgtgttttaaattttccataatcatgtttttttcggcatcagtaaaattctatttatttatttttgtcaagttattattttcttttaaatcaaaggaaagtataaaaaaggtgcacagggctgggcacggtgactcacacctgtaatcccagcactctgggaggccgaggcaggcggatgacctgaggtcaggagtttgagaccagcctggccaacttggtgaaaccccgtctctactaaaaatacaaaaaaaaaaaaaaaattagctgagtgtggtggcgggcacctgtaatttcagctgcttgggaggctgaggcaggagaatttctggaactcaggaggcagaggttgcagtgagctgatatcgtgcactgcactccagccccggccgacaacagcgagactatgtttcaaaacaaaaaaaaaaaaggtgcagagatcatgagggaaatctcaatggaatcatccaaagcgagcactctcccctctcaggtaaccgcctcccacatctgcacccctaagcccttttttgatccaaaattaattatcacattcttctaaggtaactacaattccaatttccattaccatagatttaatttgcctgtttttttctgggaggcggagattgcagtgagaagaggttgtgccactgcactccagcctgggcgacagagcaaggctctgtctcaaaaaaggaaataaataaataaaataaaataataatttgcctttttttaaaaattttaatttaattttatttttgagatggagtctcactctgtcgctaggctggagtgcagtggcacaatctcggcccactgcagcctctgcctcccgggttccagaaattctcctgcctcaggctcctgagtagctgggattacaggtgtatgctactatgcccagctaatttctgtatttttagtagagacgggatttcaccgtgttggccaggatggtctcgaactcctgacctcgtgatccatccacgtcggcctcccaaagtgctgggattacaggcgtgggccatcgcgcccggcctgtttcttaaaatttcaataatttttgggaaaccagtggttttgggctacatggatacattcttttgtggtgacttctgagattttgttgcacaagttttaatcatcagcaaatatactgatgtttcattgcgaattttgtaaggaataagaaaaccctgtggccacgtcagtgtatcgggtgccgtccacgttaggagcattcacggaatctgtctcttcgccaattcaaaggtggagaatacacaatagaactatcgttcattgatctgcgaatcgaaaggtggaaaatacagaataaaactatcgtccatcgatctgccaattcaaaggtggaaaataaacagtaaaattatcgtccattgatctgccaattcaaaggtggaaaatacgcaatacaattatcgttcattggtctgtgcacctaatggcattttactggggagtgaacgctcagggtcacaatcacatattgtgcctgaagcagtgaacacaggtgaggtgtatcctgaacgggaggagaagggagagttctccgctctccaagcggagaactccagagaaaggagagtgatggggatgaaagggcaatcagagagagagagaggagagagagagggagggcaaagaaggaagagagaaggagagggaggaaatagggagaaagagagacaaagagagatggagagggaacagggagagagagggagggcaaacgagagggagagagaaggaggggaggaaataggggaaagagagaaagagagatggagagggaacagggagagagagggagggcaaacgagagagggagagagaaggaagaggaggaaatgggggaagagagagaaagagagatggagagggaacagggagagagagggagggcaaacgagagggagagaggaggagagggaggaaatagggggaaagagagaaagagagatggagagggaacagggagagagagggagggcaaacgagagagggagagagaaggaagaggaggaaataggggaaagagagaaagagagatggagagggaacagggagagagagggagggcaaacgagagagggagagagaaggaagaggaggaaatgggggaaagagagaaagagagatggagagggaacagggagagagagggagggcaaacgagagagggagagagaaggaagaggaggaaatgggggaaagaaagagaaagagagatggagagggaacagggagagagagggagggcaaacgagagggagagagaaggaggggaggaaataggggaaagagagagaaagagagatggagagggaacagggagagagagggagggcaaacgagagagggagagagaaggaagaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagagggagagagaaggaagaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagagggagagagaaggaagaggaggaaatgggggaaagagagagaaagagagatggagagggaacagggagagagagggagggcaaacgagagggagagagaaggaagaggaggaaatgggggaaagagagagagagatggagagggaacggggagagagagggagggcaaacgagagggagagagaaggaagaggaggaaatgggggagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagagggagagagaaggaagaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacagggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagagggagagagaaggaagaggaggaaatgggggaaagagagagaaagagagatggagagggaacagggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagagggagagagaaggaagaggaggaaatgggggaaagagagagaaagagagatggagagggaacagggagagagagggagggcaaacgagagggagagagaaggaagaggaggaaatgggggaaagagagagagagatggagagggaacggggagagagagggagggcaaacgagagggagagagaaggaagaggaggaaatgggggaaagagagagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagagggagagagaaggaggagagggaggaaataggggaaagagagagaaagagagatggagagggaacggggagagagagggagggcaaacgagagggagagagaaggaagaggaggaaatgggggaaagagagagagagatggagagggaacggggagagagagggagggcaaacgagagagggagagagaaggaggaggaggaaatgggggaaagagagagaaagagagatggagagggaacggggagagagagggagggcaaacgagagggagagagaaggaggaggaggaaatgggggaaagagagagaaagagagatggagagggaacggggagagagagggagggcaaacgagagggagagagaaggaagaggaggaaatgggggaaagagagagaaagagagatggagagggaacggggagagagagggagggcaaacgagagggagagagaaggaagaggaggaaatgggggaaagagagagagagatggagagggaacagggagagagagggagggcaaacgagaaaggaagagagaaggagagggaggaaataaggggagagacagagaaagagacagagagaaagagagaaagggggagagaaggaaggcaaaggagagaggaggagagatgggggaaggaggaaagagagagaagtgggacacagaggaagacaaaggagatagagagacaaggggagagacaggaagagaaaggagatagggagaagagggagggtgtgcgagagggaaacagaaagggagagagagaagaaagaggggagagagaagaaagaggggagggagagaagaagggaaagggagggagagagggagagagagaatgggagaaaaggagagagagaagaggggagaaagagggagagagggaaggaaggagagagggagggagggagagggagaatgggagagagagaagaggggagaaagcgagggagggagggggagagagagaagaaagagagaagagagaaagagagagagggagagagagggagaaagggagagagagaagggagaaggggagagagagggggagagagggagggaggagggagaagggaggtcgagagcaaaatagtagaagcggggatggggtagactgaggagagagagagacagagagaaaaagcaaaagagaggaaaagtgagacagtgaagaggtggaaagagagaatgacagagagacggggagaaggaggagagagagacagagagttacagaaagagagagagagaggagaaaagcatttgagtaactgaaaaaccactgcttctcaacccacttcctagaatctcgggagggcggtgggaaggatggagccagtccagggaggctatgggacggacgccctgaacatctagccttctctggcagggaacagcctgccgcagagtcacaacagaccacatcccatgctgctgccaacaccaacactaaaagaacatccaaatgcctcctgttcagagaaggcgccatcgggagaggcagaggaaaccactacggaacagaaagctactctatccacaggagagcagctctggaagagaagcaaacagaaggcacgcagaataaatggtctacacctgtgcagactcaaggatccgctgacgaatgcatgcgccgcgatgcaacactttccgtcttcccgggagggagaccagatgactgtggagcccgagtcacatagaaaatgccaggcgcccacaaagacaggagatggctgctcaggtgtccgtccaccaaaaagtgggtcctcagtaaggaccggctccactgcacctcagtcttctgttgatgcagaactgcacacctgggcttccccgaatgaatcttccttaactctcatgggtcttgtaggtgccctgtgcccatttgctcatttgaatgaactcattagaattcattcattcatttgattccattcattcatttgcatcatttgaattcattccttcttttgaattcacttgttcctttgaattcattcattcacttgaatttattcatttaaattcactcatttgaattcattcattcattcctttgaattcgttcattcctttgaattcactcattcctttgaattcactcattcctttgaattcactcattcctttgaattcactcattcctttgaattcactcattcctttgaattcattcattcattcctctgaatttattcattcctttgaattcattcgttcctttgacttcatttgttcattcatttgaattcattccttcatttgaatttattcattcccttgaattcattcagattcactcatttgaattcattcattcattcctttgaattcattcctttgaattcatacattcctttcaattcatttagtcctttgaattcattcgttcctttgaattcatttgttcattcattagaattcattcattccttagaattaattcatttgaattcatttgttcattcctttgaattcatttgcattcattcattcctctgaattcattcattcatttgaattctttcattcattcattcactcatttgaattcattcaagtgaatgaatgaatttgaatgaatgaatgaatgaatgaatgaatgggtgaatgaagaactgtaccaaaaaacagagtctttaggtctctggccagggaagaatcattgttatttttcagggtcaccctgtatcgtggacgtatttctttggtggtaggaaaaataatgcttagtaattcattatctcagaaagaaattcatccattagagttatgggaagatggctgacaaggataaatctataaatcctctgcattattaaaaatctatcaattttcagacatggggatgggaagctagataaatacaattttgaagtgaataaaccataaataccggctctgcaggaggtctattattgatttattcttgtgcttgataaatcatcgcgttgcctctgagcttcccacagcagccagacagaggcagtcaggttctattttcaacccactagcaaatgaaaaagatattctatgtctgaagtatttaatgtttgcaaaaccttgattgctctaagaataaaaaaagaaaagcacgaagtgtagctccttcttgccttggaagtcaccctggctgagctcagctggggctgttttccatgagacttgaggcacgtggttgactagcaggagttttggagggaaggttctggggaaatagtttagggcagcagtctccaacctttttggcaccagggaccacttttgtgaaagacaattttctgaagacagaaggtggaggtggaatgtggggatggttttgggatgattccggggcatgacatttattgtacactttatttgtattattattacattgtactatataatgaaataattctacaagtcgccatcatatagaatcagtgggagccctgagcttgttttcctgtgactagacagtcccatctgggggtgatgggagacagtgacagatcatcaggaattagattccataaggagcacacaacctagatccttcccatgcacagatcatcaggctttagcttttcataaggagtgcacaacctaagtccctcacatgcacagttcacagtagggtttgtgctcctataagaatctaatgctgctgctgatctgacaggaggcagagctcaggcagtcatgtgaacaatggggagtggctgtaaatacagatgaagctttgcttgttcacttgccactcaccttctgctgtgcggccggtgtcctaacaggccatggactggtactatgacctgggggttggacagccctggtttaggggtctgcagaccccctactagcctcttagacactaaaagtaccaccactggagtccttccctgaggctgcctataaatagaaactctatttacataagttgacaccagcaatatcccaaacatacaatccagcaatctcatttgcacacaacgaagaagaattctgatgcacaaaccaacgagaaaaatccttgatttcttctctaagtcaaggtacatctggcccaagcttcagcacaccagctggtgatgaacccattctcagcgttgactgtatagaatccagccttctcatttgcacacaacgaagatgaattctgatgcataaaccaaggcatgcaacaaatgagaaaaatcctttacttcttctctaaatcaacgtacatctggctcaagcctccagcacaagagctggtgatgaatccattctcaacgctgactgtgtagaatccagccttctcatttgcacaccacgaagatgaattctgatgcacaaactaaggcatgcaataaatgagaaaaatactttgcttcttccctaaatccaggtacatcagacccaggcctccagcacacgggcttgtgctgaatccattctcagtgctgactgtatagaatccagcctcgtcatttgcacaccatgaagatgaattctgatgcacaaaccaaggcaaaaaatgctttacttcctctctaaatcaaggttcatctggcccaagcctccagcacacaggctggtgatgaatccattctcagcatagactgtgccatctgggctacttctggcttgaggagcacttatccctgcagctttccatccaccctgggtacctcgggaggcccctttccaagcccatgggcttcacgaagctccatggttctgttgcatttccaagagaaccaagaggatttgtcaacaagagactgcctctctgcatttctgtcttcttgtgaagagtgggcaatgggtattcaacacagcctccaaaagcgaagtctccagctcttttctagaagcttctgtctgtacccacagaggaaaaaaaaaaaaatccagatcctctgcaactgagctcttctcaacagtgaccccagggacaagatgaaccttagtcagccacaaaaacctatagggagtccaggaaagccacagcctgagcaacctcttgaaagatgtagaacaaaaagataaaaggaagaaagtgcaaagtgttatttcaagccatcatcttgtaacaaatggattctcattatcacctcctggaaatggtgttctgagcagcacaggctggggaattccagggaggcgtgtgacttggggtgcaatcttctctgtactttacaagactgtgttgtcacattgcaagaggtgtgttttctaaggcagaacatttcacagaatgattattggtccaatgtttgtttccgttgctaaagtatgatttctatgaggtcaagaatcttgcttattattttatttttcctgcaagcgaagtatgtgaagggcagagtaggtaggtatggcaggttaaataatgcacaactcaagatgtccaggtccacattattcatgtgggagacagaatcatgaccccaaaaatgcccacactgtaatccccatgtgggagacacaataatggccccaaagatgtccacatcctaatcctcaggtggaagacagaataatggccccaaaaatgtccacatcctaatcctcatgtggaagacagaataatgacccaaagatgtccacatcccaatcctcatgtggaagacaaaataatggccctgaagatgtccacatcctaatccccatgtggtagacagaataatggccccaaagatgtccacatcccaatccccatgtggtacacagaataatggccccgaagatgtccatatccgaatccccatgtgggagacagaataatggccccgaagatgtccatatccaaatccccatgtggaagacagaataatggccccaaagatgtccacatcctaatccccatgtggaagccgaacaatggccccaaagatgtccatatgttaattcccatgtggtagatagaataatagccccaaagatgttcacattctaatcctcatgtgggaaacagaataatggccccaaagatgtccacatcctaatcctcatgtggaagactgaataatggctctaaagatgtccacagactaattctcatgtggtcgacacaataatgaccccagagatgcccacaacctattcccaatttggaagagtaataactcaaaagatgaaaaaatgtccatgtcctcatctctggaacacatgaaaatgtgactttcacggcaaaagggcctttgtagatgtgaattagtggaagatcttgagatgaggtgattatctgagatgatcctggtgggccccaaataatcacaatggttcttctacaaggcaggcagaagaacaaaagtaagtgaaggagataaaaaaaaagagaaggcaagatgagagagagaaagagagagaagggaagagagggagagagagagaacaagaaagagagattcaaaggtgtctcattgctggctttgttgttgtttttgttgttttgagatggagttttgctcttgttgcccagactggagtgcagtggtgtgatctcagcttactgcaacctctgcctcccgggttcaagcaattctcctgcctcagcctcccgagtagctgggattacaggcatgcgccaccatgcccagctaattttgtatttttagtagagacagggtttcacaatgttgtccacgttggtctcgaactcctgacctcacgtaatccacctgcctcggcctcccaaagtgctgaggttacaggcgtgagccactatcattgctggctttaaggccgggttggaggccatgggtgaagaaacgctgacagtcttctaaaaactggggaaggaaatactctcctctagaaccagtgtcagccatagactcaggaatttcacactggacttactggcttgaggtgcctctgaggcattgagcgaaggtaaaaggtcttagcatggaagaaaggtctagataagtctaggaagaagtaaacccaatatgtgcatgagattttctacagaagagatagggtacagagacaatccaacaacaagacccttttgattcaaattcaaccctgtcccagtttccagaatatttttgtttgtttctgagagccctgtgtgccttgtttaaaatctgttgagaaaaggaacagaggagaatcctaggaatgcaatagccatttcaaaaggtaaacgtggtggttgagtgatggagtatacgctggttagcctgtgtcaactggtgttagcctgtatccactgtcacagatgtggttcatatacacattgctcagtaaaattctgctccccccagaacacagtaagattctgctggagaaacatatcatatctgacattcctaatttttttttttttttgaaacagtcttgctctgttgctcaggctggagtgcaatggtgtggtctcggctcactgcagcctccacctcccaggttcaagcgattctcctgcctcagcctcctgagtagctgggactacagatgcccgccaccacgcctggctaatatttgtatttttagtagagacagggtttcaccatattggtcaggctggtctggaacccctgacctcaggtgatccactcacctcagcctcccaaagtgttgggattacaggggtgagccaccgcgcccggcctgagattcctaattttttctgcttactggtggatgcaagcccataccaaatggatggaagtagtcgcacaaaagtcctaagaggatggacagttctgttttgtgtgtctctgtgcaagggcaccatgtcatgtatgtatttccatctccaactgctctgtgataaagtgctcccattactaatgagtaagggtgttacacagaacgaggaaatgagacgtcgggtcgtgtaggatctccacagtgcctctaagtggtctccacatttggtgacttataatgctataattctaatcacttctaatactgataggtcttcagcaaaggaagtccacacccagtgctgagacagaagattccaaatggctgctgactgggaaatcatttatgcctgcgtagaaacttcagatcccaccaggatggcaaatctgaaaagtgttattgatctccaaagaagacacacaaagttaaaatcattccggaccttccaacaggagccactagcactgataatacgatgtttcttaccaggctaagtacatggaaatggtgttgtctgtagctatttgagtggcactcacacatcatagctatgtctgcacgtatttttatgcataaatacatatacatcatacatcaaatacatatacaaatacatatgcactcacacatagctatgtctgtacaaatttttatgcataaattggcatcacactctatgtatagttttatatcccatgcttctcctttaaactctagcataataatttccaattaaacaagtgggttgagggggaaccgtgggtatctcatccactttcctatcctccaatcccattaatgttatacaaaaacacgaaacacatcaagacaaaaagaaaaaaaaattagatagaagctaccacatcttggcagctggaaacagacaggtattacaactttagtacaaagaataatgctttctccctccttacagacatgtccatatcctaatctccagaatttatgaaaatggtacgttaggtagcacaaggggttttgcagaattaagaatctttaatggtctaggtgggtaatggagtaattacattgggtaatcacaagatccttttgctgatttttttgtctgcaatctgaagtgtcaataacttgataaatatttcatgtatttgaaaggaatgtgctgtctttatgggctcactgtttgacgtacgtctgttctatccactgtattaatgtcactatttatttcctctctgaatttgcatttggtctccatctgtgaaagtgatgcgttaaattctactagcacacatgtttgttggtgtatttctgagacctttagttctatgtatttacttagtttggagatgtcaataactgtacctcctcagtgtggagggttcaggttaacttttataaaaaataaaatggactgcagcaggggatgagagtaatgggcatcagtgttacgaggagaaacattaagtgttgcaatgatcttaagcgctcagcgtggcccaaagaagggctcaaggtcaacagtaagcgttgcaatgaccttaagcactcagcgaggctcaaagaagggctcaaggtcaagggtagtttgtgttgaagattggcagatgggcagattgaaggtggggaaggggagatattgactccacctatctgggtgagaatgttgaacagggggtaaaatcaagagataaatggtaatgagcttctagtgcccaaataatgactctcaggggaatgtggtgatggttttgtaagataacatttgggaaaacaccaacccttagcatgtgcctcataccctttagtccaagtggacaagtcaacgtgtcaactccatacaacatgttatcgcgtttaccattatttcaaagtaacatgctaacaagaatgatgctcttccaaagctatccgtgaaatgaagcactgactagaaatagcaggtatgttcaataattcccatggatatcctgttttgctgagacacttctcccgcatgaaagctagagttcctgtttgcattcaaattaacccctggcttgctgcaatttcaccaggactcaccattgttgatcaggacatggagaggaatcttcttcatcttgaacttctgcacaaactgccggatggaagtcatggaagccaagtcacagtataaaaattccactggaaaaggacaacaacaaaaaatacctggttatctcccaacctatttcagagattaagaaaatttctaaacaggtcaaactcaatttcatctaggaagtaacactttttttttttctgctctttttgagatggagtctcgctctgttgaccgggctggagtgctgtggcaggatctcagctcactgcagcctctgcttcctgggttccagtgattctcctgcctcagcctcccaggtagctgggattacaggcacatgccaccaggcccagctaatttttgtatttttgtatttttttttttttttttttttttagtagagacaatgtttcaccatgttggccaggctggtctcaaactcttgacctcaggtgatccgcccgcctcagcctcccaaagtgctgggattacaggcgtgagccaccacgcctgtccaggaagtaacactgaattggacatgtcagtagggtacaatgaggagctcatactctagggagatcaatgagtcccatccttgtatagtcccctttccttgagtctgtgtgggacctgtcattctcctcctgaccttgatgtgagctgatgttttgtgagagcgccttggggccagaacctgggcatggcctctctaggagctgacagcagcccctggccaaaagccagcaagatactcagatccccagatctgcagcttccaggaattggattctgcgtataaccatgtgaatttcgaagatcctgagctccagagaggacctcaggccagatgacactttggttatagcccagtgagaccccgaagagagaatgcagttacacctgcccagattcctgacccgcagcagctgtgggatagtaagtatgagcccttccacgctgctgagtctgtgggttattttgttacacagcatatgtaactgatacacaaaatgactcagaagcaaggacttccttcttctgcagtagaggaatatagaatatagaattttatataataatcaaacaggaagcaatttatgcatcccctgctacagatagtaagaagtacgagcccttccacgttgctgaatctgtgttattttgttacagggcatatgtaactaatacacaaaatggctcagaagcaaggacttccttcttccacaggagaatatagaattttatataataataaaaaaggacgccatttatggatcccttgctacagatagtaagtatgagctcttccacgctgctcagtctgttattttgttacacagtatatgtaactaatacacaaaatgactcagaagcaaggacttccttcttctgcagaagaataataaaagaaagcattttattttttattacatttatgtttttggagacagggtctcactatgtccccatggctggtctcgaactcctaagctcaagtgagcctcccacatcagcctcccaaagtgttggattacaggcgtgagcagctgtgtccagccaaagatgacatttttagagagtgaatgactcagggacagctttataacatcacataggtagagaggtagacttatgtctattgtattcagtatatcaacttcactctttctctctaaattcccagtgggtctccatcgctaaaagtgatgtgtttgattgtgttaaagctgttttttttttttttttcccagaaggactgaggttttggagggagaggaactagaaagaaaagcaaattcacaggtatataattctgcctccaggtccatgggttcaaggaggttgggagaacaatgcaacaacctaaagtcagacagaacaaaatgcatgaaaactagctattacttgcagcagagacagcagatctctgagggaagaagcaagttcccttacattgagatgggaaggtaatttctggagagaggtggaaggtattgggggacactgccagtgagttctgaaaggtgaggatggggaatggtgtgaggtggaagagcaaatcacagcatgtgtgcagaggtcagagacaggagtcctcagggagggagcgagcagaggctggttctgggctggccgagaagagaacagccttgatctgcagggctgctggtggtcagtgtcatttacagcctcctcactggggagcctcataggggaaaatcattactgtaaaagaactgttaatatttttatgaaggccacatagctttcagaggataagcagtgtgtgtgtgtggtggggggaggggtctgcctgtgccccccatgtctgcactgatgtgtaaaatgccagcaatcaattttatgacagacacaccttgcttaataagctctatgagccttactctccaaaactattactggaatgctcatcatcattccaaaacgaaatgactctccactcaccatcagagagagagaagagacagagatggagtgtaagaatgagaaagagagagatagaaagatagaagcagagagagagagaaagagagaaagaaagaaaggctaagagagaaagagaaaaaaggagggggaggaaaaggggaagagagaaaaaacacacagagataaagacaaagagacacagtgagagagagaaacagaaagagagagagggacgggagacagtaaaagggacaaagagagaaaggcagacagagagatacaaagaaagaggccgggcacgatggctcatgcctgtaatcccagcactttaggaggcgaaggcaggcagatcacgtgaggtcaggactttgagaccagcttggctaacatgttgaaacctcgtctctactaaaaatacaaaaattagccagctgtggtggtgcacacctgtaatctcagcactttggaaggtgggcagaggtcaggagttcgagaccagcctggccattgtggtcaaactccatctctactaaaaatacaaaaattaggcgactgtggtggtgcacgcctgtaatcccagctacttgggaggctaaggcaggagaatcgcatgaacctgggaggtggaggttgcagtaagccgaggtcgcgccactgcactccagcctgggtgacagagcaagactctgtctcaaaaaaaaaaaaagagacagaaagaggcaaagagagagagcgtgacaaacactgagagacagagagaaatagagaaaagaagacaaagagagagacagagaaagagagagagagagaggaaaaagagagggagagagagagaggaaaaagagagggagagagagagggagaaagacaaagagagcagacagaaaaagaaagagaatgaaatgagagaaagtgtgtgttagtttcatattccttactgtataaggagaagaaaaggaaatggagaggatttggagaaataggaacatttttacaccgttggtaggagtgtaaattagttcaaccattgtggaagacagtgtggcgattcctcaaggatctagaaccagaaataccatttgacccatcaatcccgttactgggtatataccaaaggtttataaatcattctactataaagacacatgcacacatacgtttattgcggaactattaacaatagcaaaaacttgaaaccaacccaaatgcccatcaatgatagactggataaagaaaatgtggcacatagacaccatggaatactatgcagccataaaaaaaggatgagttcatgtcctttgcagggacatggatgaagctggaaaccatcattctcagcaaactatcacaggaacagaaaaccaaacactgcatgttctcactcatcagtggaagttgaacaatgagaacacatggacacagggaggggaacatcacacaccagggcttgctggggggtggagggttagggaagggatagctttaggacaaatacctaatgtagatgacgggtcgatgggtgcagcaaaccaccatggcacgtgtatacctatgtaacaaacttgcacgttctgtacatgtatccagaacttaaagtataataataccaaaaaaacaagaagaaaaggaaatggtatctggattactttgacaggacataactttctaaaacacgtcattctggataaaatattaccaggctgttaggacacgctgctgagtctgtgttattttgttacacggcatgtgtaactaatacacaaaatgactcagaagcaaggacttccttcttctgcagtagaataataaaagagggctagcacttgcttgtattgacggcttgtattttcacgcggttccggcatgtggcaataccgaagcacaaagctggggcgcatacgcacatttattttctcatcgaagaccataaatagttcccttcctcccatacgtagcccattctcttgactttccttttctgggatggactgtggggttctcgccgagagatgcttgtgtgcctcacttggggatcgtaaacgcaaatgtgtcacctccttcaggaagttttcctgaaccccaagccacgccgggcatctctagatctggcttccgcaatcgcaacgacagtacccatcattgcacctcctcacttgcatgaccagtatgtttttaagcatgtctcatatgccttggatgctacgtaactttggaacatacattgaaatgatgcatctttgagtgtccagagctaggctctctgggcacacccagaaaaaagtcagcggaagaggtaaagggaagatgtatgggagcttgggccacgtcctctgctggcgctctgccgcatgccagcttctgccccagagggaggggagggaaggagagggaaaaagagaaaagaagaaaaggggagaaaggtgaagtgaaaaatatcagcatgaagcaaaaatgtgtcctcagacaaaaaggaaatgcatagacccgaggcagacaggaataggacccaggcagataggaataggacccaggcagatagacccaggcagacaggaataggacccaggcagatagaccccaggcagataggaataggacccaggcagataggaataggacccaggcagatagaccccaggcagataggaataggacccaggcagataggaataggacccaggcagatagaccccaggcagataggaataggacccaggcagataggaataggacccaggcagatagaccccaggcagacaggaataggacccaggcagataggaataggacccaggcagatagaccccaggcagataggaataggacccaggcagataggaataggacccaggcagataggaataggacccaggcagatagaccccaggcagacaggaataggacccaggcagataggaataggacccaggcagatagaccccaggcagataggaataggacccaggcagataggaataggacccaggcagatagaccccaggcagacaggaataggacccaggcagataggaataggacccaggcagatagacccaggcagataggaataggacccaggcaggcactgcaagctgtgagcatcatcttgggaatatgcaaatgtttgtgctgaattactttcctttttaaaattatttatgcatttattgagacagggtctcgttctgtcacccaggctggagtgcaaaggtgtgatctgggctcactgcagcctccacctcccgaattcaagcgattctccctccttagcctcctgagtagctgggaccacaggtgcgcagcaccacgcctggctactttttgtagttgttgtagagatcggattttgcaatattgcccaagctggactcgaactcctgggctcaagcgatccgcccgccttggcctctcaaagtgctgggattaccgtcgtgagccaccttgcctggccatcctttcctaaggtagtaagaatgtggtaggctaaatgacggtatcctccactccgtccctaaaaatctcctggtcctaatctctagaacctgtgaaaagattaccttgtatgaaaatagggtgtttagacattaaaggttttcaaatgaggaaattatcctgtattagcctaaatataatgacaaagatttttgttttttgtttgttagcttttatagagacaggggtctctctatgttgccaaggtaggtctcaaactcctggccttgttatcatactgctgcccaaaatgctaggatgacaggagtgcggagttttttttgttttgtctttttgagttttttttttttgacaaagtcttgctctgtcacccaggctggaatacagcggacagatcttggctgactgcaacctccacttcccgagttcaagtgatcctcccttcctcagtctcccaagtagctgggattacaggcacccgccaccacgcccggcttatttttgtatttttagtaaagatggggtttcaccatgttggccgggctggtctcaaactcctgacctcaggtgatctgcccgcctcggcctcccaaagtgctgggatgacaggcatgagctaccacgcctagcctggggtttttataaggaggaggaacaggcatgcttgagacagatgagagaaaatgatgatgtgaagacagaggcagagactggagtgatacagccacaagccgtgggatgcctggagcccccaggagctgggggaggccaaaaggatcctcccctagagcgtctggatggagctcagccctgagacaccttggatttaaagtcttgtcctccagacctgggagaggatatatttctattgtgcaagttccccagttttggtgttttttttttttttgttagttcaatatgattttattcaaaaatgtatacagctgaaggagggatctggtcttttgttaaaaaaaaaaaaaacaattttcacagtatatatttggccattttagctctgtagtgaacaacaccagaaaaggaagtttctgttcaagatcctgactccagcacactcagccaggttgcttggcaagatgacacatttcctggtctgaagcacacagcccatcctctcacctaagtggaacagcagttctcctgcaggcgcgtgtgtacacacacacacacacacacacacacacacacacacgaggtcttattttcactgctctacacagggtcctgagaacccttacttttaaagttgggaaaaacgggccgggcgcggcagctcacgcctgtattcccagcactttgggaggccgaggcgggcggatcacctgaggtcgggagttcaagaccagcctggccaacatggagaaaccccgtctctactaaaaatacaaaattagccgggtgtggtggcacatgcctgtaatcccagctaccagggaggctaaggcaggagaatcacttgaacctgggaggcagaggttgcggtgagccgagctcgtgccattgcactccagcctgggcaacaagagtgaaactctgtctcaaaaaaaaaaaaaaaaaaaaaaaaaaaaatgggaaaaatgtggaaggattccttaactcattgtctgcgacaaatccagctgccttttaactcttagcaactgccagtatcaaatacttgaaagtgacgagatgctccatttaatgcaacaactcaaatgctaagcaattcggtcaagtcacatgcttgaatatttttaaatgtcacttaaaaattatcgagagaagataagatgtgcttttcacagtaaccctaaggaactcacacagaataaaaatcttaaccctaacggagtgtgaatccacagtaacaaatgccttctgtcactgtgattctgacagtgagacagtatcatatgaagacaggagattcacgcacctgctgtgtctgatgcccctctcggcacctagcatggtgaatgatgtccacgcttcccgtagcccacacaccacaccctccaatgcagaaagtgagtctacaattctcactgttgctcttgaggctgccaataactcatccaacttttcttttatttgcaactcagtgacagacagtaaaccctgagactcaagaagataacctcatctggccgggtgtggtggctcatgcctataaccccagcactttgggaggctgagatgggtggatcacctgaggtcaggagttcgagaccagcctggccaacatggtgaaatccggtctctactaaaaatacaaaaattagccaggtgtggtggtgcacgcctgtaatcccagatactcgggaggctgaggcaggacaatcgtttgaacctgggaggtggaggttgcagtaagccgagatcacaccactgcactccagcctgggcgacagagcaagactatgtctcaaaaaaaaaaaaagataacttcatccacagaagaatttctaacatctaaaggggtttcctgagggcaagtcagaaatacagatttctgaaattaatgctgcccaagagatgaagtcaactggaaagacacagaggcatgtgttgataaatagggatcaagaagaaaaaaaaattccttttgtttggagttctggcaaatcgcctggtttggaggaactgaattaccccttcttctttgcgatagagaacatcattatggaatgaactgtacctccctaaaaaatccttttgtctgaggctctggcaaacctcctaatttggaggaattgaatagtgccttcattttttctttgcaatagatataggacatcgttatagactgagccgtgccctccctcactcatcatcagaacccttaaactccaatgtgactttatttgcagacagggcctgtaggagctcaaaagggtgaggccctcgtccagtaggactggtgtccttataatcagagaaacacacaccaggtgtgatggttaatgccgagtgtcaacctgattggattgaaggatgcaaagtattgatcctgggtgtgtctgtgagggtgtggccaaacaagtttaacatttgagttagtggggtgggaaaggcagacccacccttaatcggggtgggcaccatctaatcagctgccagcacagcacattcaaaaagcaggcaaaagaatgtgaaaaggttagactggcctagcctcccatgctacagctttctcccgtgctggatgcttcctgccctcaaaaattggactccaagttcttcagctttagcactcgggctggcttccttgctcctcagctcgcagacagcttattgtaggaccttgtgatcctgtgagttaatactgaataaacccccctttatatatagctatttatcctgttagttatatccctctagagaaccctggccaacacagggtgcatccctcaccccctatatctatcaccctgctgcctgagttgataggaaagcagaaagagcccctttttaatgtttaattttattaagtatgcaatttcccagtgcccaaactcatgttgatttcaaaaactgcccttttaaagcatgtggacagggtaacaattcatagcaggtgacaaaaatgttttataaataatatccacggaaacagaaggtgtcaccgtctgcagaatgcagccaaaatattcagaagatttgtatcactctaagttctcgtgctagtaagaaataaaaaagcaggccgggcgcagtggcttacgcctgtaatcccaggactttgggaggctgaggcgggcgatcacctgagttcaggaattcgagaccagcctggccaacatggcaaaaccctgtctctactaaaaatataaaacttagctgggcatggtggtgcattgcctgtaatcccagctacttgggagactgaggcaggggaatcgcttgaacctgggaggcggaggttgcagtgagccgagaccatgccactgcactccagcctggtgacagtgccagactccatctcaaaaaaaaagctgtgtaaatacatgaatcattagatattagcctttctttgctgagccttgcacatttccacgaggtgtctctggaagcaggttagctttggtcttattgctgcgtggagcagagatgagagggatgggccatgacatgccatcctgcagcattctggtctttgtatgatcacggctggttgcgctgcaggagcacgccaggtcttttcacctagttctttgttgttgttgtttgagatggagtttcaccctgtagctcaggctgaagtgcggtggtgcgatctcggctcactgcaacctccacctcctggattcaaccaattctcctgcctcagcctcctgagtagctgggactacaggcacccgccaccacgcctggctaatttttgtgttttagtagagacagggtttcaccatgttgcccaggctgttcttgaactccggaccttgtgatctgcccgcctcggcctcccaaagtgctgggattacaggtgtgaagcacctcacccggcctcatctagctcttgatgacatactcagaccaacccgtggggtcccgggtccccagaacagaggtggacatggctccgatatcacaagaactggcgcttcctgcagcacacacctgaggttgagacacagtgattaggttttgttttattgtggctgatctaggacactttaaataacacaacatccaagagtcagccaaacgtggcagccaaaagtgctcctgaccttgtgatctgaaatatatactttaaccttctcttggaaggcatgttttaagataatataacagcttcctcatcatggagaatgaagcccatctgtaccaagtcaccaggccatcaaggaaaaggaaataagtactttcaatattttccttagagaaatacagttgggtgggcaggtgcagtggctcacacctgttatcccagcactttgggaggccaaagcgggcggatcgcttgaggtcaggagctcaagaccagcctggccaacacggtgaaactgcatctctactaaaaatacaaaaactagccgggcatggggtcaggcacctgaaatcccagctacttggatggctgaggcaggagaattgcttaaacccgggaggtggaggttgcagtgagctgagatcgcaccactgcactccagcctgggtgacagagccagactgtctcaaaaaataaataaataaataaataaagtaatatattggatggtatgatggtacacacactcctgaatcagacggctgccactctgtgaactgttactgcaagctgtctgtggtgagacatgttcagaaattgaaagtaaatgtttagaaacttaaaaaataatgacagtcatttaagctttgttcaatccaatgacttaaaaaaaacacactgagagcttctagtttccatgtttcttaaatgcattttttttagtaattcatttttattgtatctacggcagttatcaatctgctgcagattaggggagaggcagttttgccatggagagtttaaaagcgctgattctgagcacagtgtcatctggatagaaactcctgaggtactgctgtaattttccacaaaaacacttgtggggatgtaagaaagaggaaaacccatactactgctaataattggaaccagtgatcaaaggatgggtaaaagcacaagctgagcttccaaaaacagcagtgtgaatggattttttttaaaaaaactagaagatgcatttttcttgctccttgagaaaaaaggcttatagccactagcaacatgaacatcagcattctattgagatcactggcttgcgaggtggtgatatagtttagatctgtgtccccacccaaatctcatgttgaattgtaatccgcagtgttggaggagtggcctggggagaggtgatgggatcatggaggtggatttctcacgaatgggttagcgccatccccttggtgatgttcttgtgaccatgaatgagttcccacaagatctggttgtttaaaagtgcacagcacctcccctccactcttgctcctgctctagccattaagacgtgctggcttccacttcaccttccatcatgattgtaagttgcctgaggcctccccagaagcagaagctgctctgcttcctgtacagcttgcagaaccatgagccaattaaacctcttttctttataaatcatccaatctcaggtacttctttatagcaatgcaagaacagactaatacagatggatgcatgcatggacggatggacggatgaattgatggatgggtggaaggatgggtagatggatggataggtggatggatggatggattggatagatggatggataaatggatggatggatggatgggtgggtgggtgggtggatgggtgggtggatgggtgggtggatggatggatggatggatgggtggatgggtggatgggtggatgggtggatggatggatggatggataaatggatggatggatggatggatggatgggtgggtgggtggatcgatggattgatggatggatacatgagaggatgggtgagtggatggatggatgaattgatggatggacggatggatgaactgatggatggatggatggatggatggatggatggatggatgggtggatggatggatgggtgggtgggtggattgatggatggatagatggatggatggataaatggatggatggatgaatggatggatggatggatggatggatgaactgatggatggatggatggatggatggatggataaatggatggatggatggatggatggatggatggatggataaatggatggatggatgggtgggtgggtggatggatgggtgggtgggtgggtggatggatggatggatgaatggatggatggatggatggatgaactgatggatggatggatggatggatagatggatggatgaattgatagatgggtagtgatatggtttggatctgtgtcctcattcaaatctcaagttgaattggaatccccagtgctggaggtggacccttgtagggggagattgggtcacgggggtggatgtctcaggaatagtttagtgccatcccctgggtgctgtgcttgcaatagtgaatgagttctcgtggcatctggttgttgaaaagtgtgtagcatctccccagcccaccccaactgcacctctgtctctccttctcttgctagggccatgtaagacacctgctttccttcactttccactatgattatgcatttcctcatgcctccctagaagcagaagctgctctgcttcccgtacagcctgcagatccatgagccaattaaacttcttttctttataaattacccagtctcagtgtagcaattcctcaaagacctagaaccagaaacaccatttgacccagcaatcccattactaggtatatatccaaataaatagaaatcattctattataaagatacaggcacacatatgttcattgcagcactattcacaatagcaaggatgtggaatcaactcaaatgcccaagaatgatagactggattaaaaaaaatggtacatatacaccgtggaatactatgcagccataaaaaggaacgagatcatgtcctttgcagggacatggatggagctagaagccattattcttggcaaactaatgcaggaacagaaaaccaaacactgtacactctcactcataagtgggtgcttaacaatgagaacacatggatacagggaggggaacaacacacactggggcgtgttgtgggtgggggtcagggagggggagagcatcaggaaaaatagctaatgcctgctcagtagtgaagtacaaatcaaaaccacaatgagataccacctcacatcagttagaagggcgatcattaaaaaatcaggaaacaacagatgctggagaggatgtggagaaacaggaatgcttttacactgttggtgagagtggaagttagttcaaccattgtggaagacactgtggcgattcctcaaggatctagaaccagaaataccatttgacccagcaatcccatgactgggtatatacccaaaggattataaatcatcctactataaagacacatgcacatgtgtgtttactgcagcactgttcacaatattaaagacttggaaccaacgcaaatgcccgtcattgatagactgaataaagaaaatgtggcacatagacaccatggactactatgcagacattaaaaaggatgagttcatgtgctttgcagggacacggatgaatctggaaaccatcattctcagcaaactaacacaagaacagaaaactaaacaccacatgttctcactcttaagtgggagttgagcaatgagaacacagggacacagggaggggaacatcacacactggggcctgttggggggtggggggcaaggggagagatagctttaaaagaaatacctaatgtagataacgagttgatgggtgcagcaaaccaccatggcacgtctatacctatataacaaacctgcatgttctgcacatgtaccccagaacttaaagtacaataataaaaagaatagctaactcatgctgggctttaatacttaagtgatgggttgataggtgcagcaaaccaccacggcacatgtttatctatgtacaatcctgcatatgtacccggaacttaaaatttttaaaaattacccagtctcaggtatttcttcagagcagtgtgagaacggagtaatacaggcaaccaacgggctttgctcattcttgcaatcagcatctttttttttttgcatccattcaggagctacctcgcaccaagagaaacactggtaggaagggtaaggggaacagggtatggctggcatcactaggggaagatgagccgatacatcaagccctgcagcaggggaaggcagaatgctcactgggtgctagaacttgaacttcacccctgacattcagaaaaatctctttggacaaagagcagagcaggaatgaagcccacaattaagattgcgatcaattatcttttttttttttttttgaggcagagtcttgctctgttgcccaggctggagcgcagtggtgcgatcttggctcactgcaacctccacccgccaggttcaagcgattcagcctcccaagtagctgggattacagacgcgcaccaccacgcctggctaatttttgtatttgtagtagagacaaggtttcgatgatcagtcatctttttgacgcactgctggattctgtttgctagtatgtggttgagcatttgtgcgtctatcttcatctgggatattggcctgtagttttctatttttgtcgtgtccttgtcagattttggtatcaagatgatacaggttttgtagaataagttagggaggaatccctccgcctcaattttttagaatcgtttcagtcagattggaaccagctcttctttgtacatctggtcgaattcagctgtgaatttgtctggtcttggggcttttttttttttttttgattgataggtttttgtaaattactgattcaatttcataacttgtcatgaaatgagtctgttctggatctgatttcttcctgattcaatcttgggaggcatgagggaatcagcccaggtgtccatcaattatgtgttggatgaagaaaatgtagttgctgcatatataccgtagaatagtatagagccataaaaaagaatgaaatcatgtttttagcagcaacacagatgcagctggaggccattatcctaagtgaattaacacagaaacggaaaattaaataccacttgttctcaattatacataggagctaaacattgaataatcaggcataaaaatgggaagctggcacacctgcgcattccaagagcaggggagggagaggggtgtaaaggctaaaactctacctatgaggtattttgttcaccgtttgagtgacaggttcaactgaagcgtgaaccgcagcactacacaatgtatcttacaacaaagctgcacgtgtacctcatgaaattttttttaaaagaaaacaaacaaggccggggggtgggtggctcacgcctgtaatcccagcactttgggaggccgaggcgggtggatcacgaggggtcaggagatcgagaccatcctggctaacatggtgaaaccctgtctctactaaaactacaaaaaattagccaggcgtggtggcgggcgcctgtagtcccagctactcaggaggctgaggcaggagaatggcatgaacctgggaggcggagcttgcagtgagccgagattgtgccactgcactccagcctgggcgacagagcaagactccctctcaaaaaaaaaaaaaagtaataaaaataaaaaaaataaaataaaaaacaaggaaaaacaaaagagtatgaggcttcaagcccactggaccaagacaccagggtgatctgcgcataggacacaggaaatcgtacttgctaggagctcagtggctgcgttcacctggaacctaacccatgtaggagctgcgtccctttcccagggcaccatgagagggaccagggaaccgaacacaggaggatctccggaagacttgagataggttttttcattccacctggagtaccttcaacgataccttcattctatttagataatttagagaaatgaaagttagagtgtttgggagtatttaacgcactcctaggagctacaaaatgagtgtctgccacgtagctcatggaataagatggagtataccagttatccatgtggcaagaacagaaaagaagcaggaagtacagcttcagccaacgagggcgctcccagttactggtcatgatataaagccaaaatggtggcctcctacactcagagcctgtgaaaaaggtgatgtctgtatcttgatggtaaagatacagagtattaaaaaggaggaattacaattgttaaaacaactgttcgacaattgttcgacaattgttttaacaattgttcaacaattgttaaaacgttcacatttatcagccaaacaagcaaaaaccaagtagaaatggccctagtcacacaagacagcaatgattgaagtctaaaacgttaatggaacaaggaggatcatcgcctatgaaggcatggtttggatctgtgtaaccaaccttgtaacccaacagggctaacttgaaaatcataaaccaaatgctgaattgagatgaagctataatgtgccattttcacagcattttcttcagaataacacaatatccaagtatatttttcaagaattcctaggtaggcagggagaaatgaacaaaatcaacattgtgggggaaggaggaaaggatgggtggaaagagggaaggggaggggaggggagggaagcaagaatgaatggaaggagggaagaaagaaagggagggagggagaaaggagggaagaaagggaaggaggaaaggatgggtggaaacggggaaggaaggaagaaggagaaacaaggtcccagaaaatactgtcaataatatatttaatgaggcaggaaatgcaaacttacaaataggaaacactgtactgtatgaaaaaagctttaaaatgataggtttctgtttcttagtatcctgataatatgttacatttgtaagtaaaatgtgaaaatctcgaggaaataattttctcagagatactaattatcccaattcaatcaaggaaattaggtctaatcagaccaatagctataagaaaaatagagaagaataatgaaagaatggcatgaagaaagggtagatgagtgcagagggtattttagaaaattcttctagactttcaaagaacagataagtgccctgatactgactggttggacaaaaagagtctgaggtggtttgttttgtgaaatttatgctgttctgatagaaattctgaaaaaagcatagcagaagaaatttgctaggagggcaggaattgcttgatgagtaacatttatatatacagaagaaaaaaatcataaaaatgtaaacttaaagaagtcttccactgagacatacaaaagcaaatgtatttaatactaagaaaaaaatttccagaaatgctgtccattctgaaatattattaaagagctcctagaataaatgtgataagtgtgtccataaccactacctgaaaatcagatcttagtcaaccttgtaacccaactgggctaatttgaaaatcatcatggccaggtgtggtggctcaccctgtcactgtagcattttgagaggccgaggtgggaggattgcttgaggccagttcaagagcagcctgggcaacatagcaagaccctacctctacaaaaggaagtcataaaaaattatctgagtgtggtggtgcatgtctgcaatcccagctacgtgggaggctgaggtggcaggactgcttgagcataggaggttgaggctgcagtgagctatgattatgcctctgcacctctgcactccagcttagaaaacagagcaagaccctgtctcaaaataatataaaataaaaacccatcatttagaccaggaggcagcgcttgtggagaaggcgttcagctcagagcagcaacagctttcaagcatctaccaacagccaacacagcccctgaatccgtctgcacctgccccgtccctacgcatcctaataaattcacgagtgtcttggtaagccagaacctccgggatccaggcagccagaggacagttcttcccgcacttgtgggtagcaacagccgtcctgctacccaaaaagcccagttcttggagccaagagctgatgcgaccacagcctgcaaagtcttgagcagggacgaagctcatgatggcttctggcctctcttcattcaggagggaaggaacccaggtgcccgaactgccggaatttgccaagaaggagggcagattggttgtcaccccctgcgtctctcatttctatatatttatcaatttaaaaataaaggtgaaataccagtatctcttagtcgttatgcaggtatggagcgcctctctggagacctgaaatcctattttctttgtatgaggcagctatccatctgcccctaagacctactgtgaaagacgctgcagcgagattattctgtgtgtgtgtgtatatgtgtgtgtgtgtgtgtgagagagagagagagagggagagagagagaaaataagcaagagagaggaagaaaaaagaacaaaacacagagaaagttatggagaaagagagggtgagaatgggagagaaagagagagacagagggaggaaagagacagagagaaagattgtgacacagaaatagaagcacagaaagagagcttgaaagagacagagagtgtgccagagagacacagagagacagatacaggctcacacctgtaatcccaatagtttgggaggccgaggcgggtggatcgcctgatgtcaggagttcgagaccagcctggccaacatggtgaaaccccgtctctactaaaaatataaaaactagctgagcgtggtggcgggcacctgtaatcccagctactcgggaggctgaggcaggagaatcgcttgaatccgggaggcggaggttgtagtgagccgagatcactccattgcaccccagactgaatgagaagaacaacactctgtgtcaaaaaaaaaaaaaaagagagacagaaggagagagacacagaaactgagagacagagagaataagcgagagacagagagagagaaagaggagagacacagagaaagtgacagagagggacagagaggaatagaatgagagagacagaggttgtgacacagagagggagagaaagagagagagacatacagagagagaaagagagagatggggagagagctgcctggcatggtgggataaataagtgggtgacgcctttgttttcattgtgtttactacgatggccctcctctccctcttgagcacttgagatacatcactacgagagaactcaagttaaaacaatgctcctcggatacacagctgtcctcagaaaccaccttcaggataaactctgtaaatattgttgtcagaatggtaaagtgttcagataattaaagttgtcctctgactcccaggtctagtctagaaaagaagattaaaatgaaagcaccattgacccacccgcgaggcaaagagcagatgccccaaagagcttgtgtaagtaaagaggaaagaaaggctttcgaagacaaggcactacccaagggcgagaagtcaatcttgatgttgccgtggaaacgcggacttgtgaagagctttcaagaacaattctgtctccaaggaggtaaatcgtcctcctgggaatgcgttgaaaccattatccacccacaggactgggctaaaagtaaacttcagggtagcttggatgagcagcataggttgctaatgagcgtcgatttaatggtctgagttgtttatacatcaaaaagaagttaccaagggtctacctgtctgctgtttagatacactggaaaccagttaaaacttaattcctaagaagctgtttcccactgtgttcaaatttaaatgcttcaagagtaatgcttctgggcacaaaatggaaaaagtggggaaaatccaacggcatcaaaatccccacgccaccacccatgctgcaagcactgtaagctgtgatagtatctgtctgctaaaggtgctaaagagaaagcttgaggaactgagacctggcagggacccctcttaggggcaaaccaggaaactctctccacccccgaccaagcatggaaatcaagagaaatcttgagttccttccaggaaggaaactccaggcacttcgctggctgggagaagttaatgagcaacttgatgaagaagaaagtcacagtagcttaaaataacaaccaaggaaattagagtcagggatgttcgcttccctagagcaactaataaagaaaatgtggcacgtagacaccatggaatactatgcagccataaaaaaggatgagttcatgtcctttgcagggacatggatgaagctggaaaccatcattctcaggaaactatcacaggaacagaaaaccaaacactgcatgttttcactcataagggggagttgaacaatgagaacacatggacacagggaggggaacatcacacacaggggtctttcggggactgggggactaggggagggagagcattaggacaaatacctaatgtagatgatggatggcagcaaactaccatggcacgtgtatacctagtaacaaacctgcatattctgcacatgtaccccagaagttaaagtataattaaaaaaaataaaagaaactcacacctctaccctatggaatcctctggcatgaagacctcagacgtgggagagctagggactgaactctgatccctgttccttgttttaaatttcttcctgagggtcctggaggaggtcctgcccatgggccagatccaatgtgcttttactgctgaccgcaagtcttagacaaagctccacttccttaaccaattgcaagtccaaaagtctttgaatccaccttgttcctgtaagcaaccccaccctcgggcccagcttcaagatatatatttttttttttttgagatggagtttcgctcttgttgcccaggctggagtgcagtggcatgatcttggctcgctgcaacctctgcctcccaggttcaagcgattctcttgcctcagcctcccaagtagctggaattacaggcacttgccaccacacctgggtaattttttgtatttttagtcaagacggggtttcaccatgttggccaggctggtcttgaactactagtagacctcaggtgatctgcctgcctcagcctacaaatgtgctgggattacaggcatgagccaccgtacctggcccaagatatccctttttaggccaaaccaacgtatagcttccatgtattgatttatgattttttttttacttattatttttgagatgtagtctcgctctgtcgcccaggctggagtgcagtggtgccatctcggctcactgcaacctccgcctcccaggttcaagcgattctcctgcctcagcctcccaaatagctgggactacaggcaagcgccaccatgcccagctaatttttgtatttttagtagagacagggtttcaccatgttggccaggatggtctcgatctcatgacctcgtgatctgcccacctcggcctcccaaagtgctagaattacaggcatgagccacgacgcccagccgtgatttataattgttgatgaaaagagtcaaactctgtaaaatatttgaagagatttattctgagcgaaatatgagtgaccacggcccgtgacacagccctcaggagatcccgagaacatgtaccccaggtggtcggggtgcagcttgattttatatattttaggaaggcatgagacatcaatcaaatacatttcagaaatacattggtttggttcagaaaggtgggacaactcaacctgggggctgccaggctataggtaagtttaaatattttctggttgacaactggttgagtttatctgaagacctggaatcaacagaaaggaaatgtccaggtggagataaaggattgtgggaaccaagttttattttgcacaggaagctctcagatagcagacttcagagagaacaggttgtaaaatgtttcttatcagacctaaaagggggcctggctctcagttgattatgtcccagatctgggaaggaacaaaggaacaaagggagggacggaaggaaggagggaaggagggaaggaagagagggagggaaggagggaaggaagggagggagggaaggaagggagggaaggagggaatgaaggagggaatgagggagggaaggagggaatgagggagggaaggagggaggcagggagggaaggagggagggagggaaaggagggagggagggaaagaagggagagagggaaaggaatggagggaaggaaggaagggaaagaagggagggaaggaaggaaggggagaagggaggaaggaaggggagaagggaggaaggaaggggagaaggaaggaaggaaggaagggaggtaaaggaggtaagggagggagggaggaaaggctattctctatagaatgtggatttttcccacaagagacttctcagggcaatttcaaggtatggcaaggaaatatattttggggttaaatacattgtttttccttgtctcattatgttatgccagagtcacattggaaagtaagttacgatatatagggttaaataaaacccatctaatgagaactcatggtttgtaaagaatgactccctagaccctttagataggaatttgggcaagataaaaaaatcagaacttcgtcctcatgattttgcctggagcagcttctgtcctgaaatttacccgacttgaaacactatggctcggaagtcattgaaaagattgggtcttaggccaggtgcggtggctcacgcctgcaatctcagcaccttgggatgccaaagcgagggaatcacctgaggtcgggagttaagagaccagcctgaccaacatggagaaatgctgtctctactaaaagtacaaaactagccaggcgtggtggcgcatgcctgtaatcccagccactcagcaggctgaggcaggagaattgcctgaacccgggaggtggaggttgcggtgagctgagatcacgccatagcactccagcctgggcagcaagagtgaaactccgtttcaataaaaaaaaaaaaaacgttaggtcttaagcgtgagctgcctgagtctcctggcttggtgctgtccaaataaacactatcctttctcttgctgcaaagcctcattgtggaggtttgacctaagtgcaccaggcaagtggacaccagtccagtttggcaacaaaacaggcatcagtaacgtggggtacagggtgagaaaggcctacatcagcagctttttatgagatgaaaagatttcctatcaggagaacataaacagacttagactaaggtgttggacttctgttcgtctgaggatcctgtttcttgctgcctggtgagaaggtagtgaggtcatttgggtatacatagcagcattaacagcttgaacctagcgaatatagatgcccatctgtctgcagaagttgcctccctctgccctcaaatgagctgcttaaggagccatccatcttagctagctctgctgcgtaacaaaacgccccaaacgtagtagtttaaaaaacaacacccctttatgatctcacagttctgtaagtcagaagattgggtttagattaacaggatgtctccatttagagtctcacaaggctggaattaaggtgtcagacaaagctgagatgacatctgtagcttaggatgctcttccaggcatgctgaattgggaggcaaaattcagcttcttgtggttgtgagattgagtcacattttctctcttttctttgagacagagtctcactctgttgcctaggctggagtgcagtttcgcgatctcagctcactgcaacctccgcctcccaagatcaagtgattctcttgcctcagcctccccagtagctgggattacaggtgcctgccaccacacccagctaatttttgtctttttagtagagacgggttttctccttgttggaaagagtggtctcaaactcctgatctcaggtgatccaccggccttggcctccaaaagtgctgggataacaggcgtgagccaccgcgcccggccaagtctcattttcattttggctgtcagacaatggtggctctctgcttgctgtgacaccctcagcaacttgtcatatgggagtctgcttcttcaaaaccagcaaaaagggccggctgcggtggctcacgcctgtaattccagcactgtgataggctgaggtggggaagatcacctgagctcaggagttcgagaccagcctggccaaaagggtgaaaccctgtctctacgaaaaatacaaaaattagccaggcatggtagtgggcgcctgtaatcccagctacttgggaggctggggcaggagaatcgcttgaacctgggaggtggaggttgcagtgagccgagattgcaccactgcactccagcctgggtgatagagcaagactctgcctcaaaaacaacaacaataataacaacaaaaaccaggaaaaggatctctgagaccatctcaagtttatttgaagaagaagaattactcattcatctcaccctctttgaggcaggtccagcacagatgatctctcctttgattaaacccacgtatgcctagtgttccattattggaatgctaagcatgtggagttatttatatcctactgctcaaggtcatcgccaagatctgatggcaaaaattcaaaaacttgcaacttcaggcataaatggattaactcaaagttttgaatcaaagaagatgagtgaggcaagcctccattagtttagaggttaattttgccacggttgagaatgtgccccagtccaggaaaaacagacgccagtcaccataggacctgtgctccgtgctttttcttttctttttgagacggagtctccctctgtcgcccaggctggagtgcaatggcgccatctcggctcactgcacccttcgcctcccgggttcaagtgattctcctgcctcagcttcctgagtagctgggattacaagtgcacgtcaccacgcccggctaatttttgtatttttactagagatgggctttcaccacgtttgtcaggctggtctcaaactcctgacctcaggtgatccacccgcctcggcttcccaaagtgctgggattacaggcgtgagccaccgcgcctggctttttttttttttgagacagagtcttgctgtgtggcccaggctagagtgcagtggcgcagtctcagctcactgcagcctccacctcccgggctcagatgattcttctgcctcactgtcccaagtagctgggattacaggcatgcaacgccacgccctgctattttttttatttttcagtacagacggggttttgccatgttggcaggctggtcttgaactcctgacctcaggtgatccacctgcctcggcctcccaaagtgctgggattacaggcgtgagccactgcgtgcggccctgtgctttttccaaggatggttttgagggctttggtatagaaagggaaaaaagcaggcaggagggaaagaggaaagaaaaaaaaaagaaggagagtagataaaagaggcaaatgattacattcttgtgagtctttgattggcactctctgaatacacattttacatggcaaagtgcgggtagaggaacagtcaatcacgcgttcatttcatgcacagtaaatccacttttgcataagacaaagtcaacatacagaagaggaagatgtcaaacatgcatttgtctcagggtgggcggagagatcatttctagtcttatctttgtcccacacttgtgaagacaagttgttaatttacattgtcagggagaaattcaacagaactctgttttaggggaaagattttggagcccacaagaaatttccttatgagcaatttgtgagagcatctccgctggggagggatgtgcagaaatgaagaggctacaacaagtgtctgaagatagtcctgaaggccaggtgcagtggctcatgcctgtaataccagagctttgggaggctgaggcaggaggattgcttgagcctagcagttcgagaccagcctgggcaacatggtgaaacctcgtgtctaccaaaaatacagaaaaaaaaaaaaaaaaaagcagctgggtgtggtgatggtggtgcatgcctgtagtcccagctacttgggaggctgaggtgggaggatcacttgagctgagaaggtcaaggctgtgccactgcactccagcctgggcaacacagtgacaacccaatctcaaaaaaaaaaaaagatacccttccagccagatgaatgcacatgaccactggcatgagaggaggtcggcattaagatacaggtcctaaggaccttgttgataaaacaggttgtggtaaagaagctggccaaaccccatgcaaaccaagatggcgacgagactgacctctggtcttcctcactgttcattatacgctaactctaatgcattcgctgctaaaagacacttccatcagcctcatggcagtttacagatgtcatggcaatgtcaggaagttaccctatagggtctaaaaaggggaggaaccctcagttcccagaaccgcccaccggcttcccagaaaactcacgaataatctttcccttgtttcgcacagaatcaagaaataaccataaaaatcaccaactggcagccctcggtgctgctctgccaatggagtggccactctttattcctttactttcttaatcaacttgctttcactttactctatggactcaccccaaattctttcttgcacaagatccaagaaccctctcttggggtcaggatcaagacccctttccagtaaacaacgcctcatgttttctataataatttcattactttgtgtgcccactgacaatggtaatggtctaacccggggttggtcaactgcagccctctagcaaaatccagccccttgcctatttttgtgcaccttgtaaaccaaaaaactatttccacatcttttaaacagtgggttaaaaaaaatcaaaagaaggataacacagttgactgttggacaacatacatctgaactgagcagattcacccatttggactttcacccgagatgactcctcctccctcttcgtcccccctcctccccccctcccttctcctcctcccctccccctcctctccctactcctgcagagtgcagtgactcacgcctataatcccagcagtttgggaggccgaggcgggtagatcacgaggtcaggagttgaagaccagcctggccaatatggtgaaaccccgtctctactaaaaatacaaaaattagccaggtgtggtggcgtgtgcctgtaatcccagttacttgggaggctgaggcagaagaagtgcttgaacccaggagacggaggttgcagtgagccgagatcgtgccactgcactccagcctcggtgacagagtgagactccatctcaaaaaaaaaaaaaaaaaagagaacgaagacctttatgatgatctacttccatttagtaagtagtaaaatattttctcttctcttccttagcattttttttctagctgactttataatatacataacatacaaactatgtactaatcgactctatgttatgaataaagcttccggtcaagagtacactaccagtatttaacttttgggggagtcagaacctatacatagattttcaactgcatagaggtcagtacccctaacccccgtgttgttcaagggtcagctgtatatacatattttttcgaggtggagtttccctcttgttgcccaggctggagtgcgatggcgtgatctcagctcactgcaatctccacctcccgaattcaagcgattctcctgcctcagcgtcatgagtagctgggattacaggcacgcaccaccattcccagctaattttttgtatttttagtagagacgggtttcaccatgttggtcaggctggtcttgaactcccgacctcaggtgatccacccgcctcggcctcccaaagtgctgggatgacagttgtgagccactgtgcccggccgggtcaactgtattttgtgccacgtgataaatatatacatttacatctcagtgtccctcaagattcttagaacacagaacttgcccattcatttacatattgcgctgttgtggtagcgatcatatgacccaaagagcttcacatatttccctatgtggacttttcttttcttttttttttttttgagatgggatcttgctctgtcacccaggctggactgcagtggggtgatctcagctcactgcaacctccacctcccaggttcaagagattctcctccctaatcctcctgagtagctgggattacagacacgcaccactacacctggctaactttttgtatttttagtggaggcggggtttcgccatgttggccaggttggtctccaactcctgacctcaagtgatctgcccaccttggcttcccaaagtgctgggattgcaggcatgagccaccgtgcctggccctgcaagtctgttttgattggatttgtttgactttaaacccattcggaagagttttcctagaattgctacactcggagacatgaggcaatgcttactctgacttttgacgttttcaagtgtacagttgaaagtcaacaacatgggtgaatgtggcaacccctccttacacaatcagagacagtcactgccaagccgcttcgtggattgtcattagcttccaatgagaaacaggtgcacaatcaaggtctaaagataaagagggttaagtgcaagacagcagccatgacgtgtcggtccacgtacagcctgtctgcctgagggctcagtgatccaaaaagacactgcaggtcagcacttcagagtgttcgcaacatccggggttacttaaccctgtggcttgacaagcagcagagatttgcaaacaatgatagcttctgtgccacttcagccgaacactggctctgaaaacagcctcagtatctgacaagctctcattcctgggcttgtggcgtggctgtccattgagagagcctaagtatatcttcatgccgaggggatgggagcatttatataaataaatgtttgcactgattacagcactgctgccaaagagcttgatgggcgatgatgatccgatttcgccatggcagcttatgtttacagaacccggctccattgcagacaggacatcgaatgtgtaacgcagtatttaaatgtccactgacatttacagctcgtgtcagcccaagagggaagaggcgttggtgtcccagtctgccaaggagggctcctgctatggaatgaatggtgtcaccccgaatctcatgtgtggaaaccctaatgccaaaggggatggtatttggagacggagcctttgggagatgatgatgtttacatcaggtcgtgaaggtgggatccttatgttgggattcgtgcccttgtaagaagagacaccagggcacacatgctccctcgtgctccacccccctctctctctgccctgcgagaccatctgtaaaccaagaagaggaacctctcaagtacccaaccatggtgccacctggatgtaaacatttctgcctccagtactatagagaaataaatttctgttatttatgccaccccatctatggtccagttaacccttaaacaacacaggtttgaattgcacgggtccacttctacgggcattttcttctacctctgccaccccggagccagcaagaccaatccctcctgtccgctctcatcttaggctactcaaggtgaagacgataaggatgaagaccttcatgacgatccactcccacttcagaaatagtaaatatattttctcttctctatgatttttaaaaatttagtttggtgtccttttttgtttttaattatctttccataagtgattggggtactggtggtatttggttacctaagttctttagtggtgatctgtgagattttggtacacccatcacccgaacagtatatactgcaccctatttgtagtgtttatccctcacccccctcccactcttcccccccaagaccccaaattccattttatcattcttatgcctttgtgtcctcatagcttagctcccacgtaacactgagaacatacgatgttggtttttcatccctgagttacttcacttagaataaaagttccttatcaggcgtggtggctcaagcctgtaatctccacactttgggacgccaaggcgggtaggtcacctaaggtcaggagttcaagaccagcctgaccaacgtggtgaaaccctgtctctactaaaaatacaaaaattagctgggcgtggtggcgtgcacctttagtgccagctactcgggaggctgaggcaggagaatcacttgaacgtgggaggcgtaggctgtactgagcagagatcacaccactgaactccagcctgactccagggcaacagagtgaaactccatctcaaaaaaaaaaaaaaaagaatgaaagttccttatgatttttgattctcaaagttccttataaggcgattctcctgcctcagcctcctgagtagctgggattacaggcgtgcgccaccacgcccggctaaaaaaaaacaaacagcattttcttttctctagcatactttaataatacagtatacaatacataaaacatacaaaatatatgttaatcgactttatggtattgataaggcttctgctcaacaataggatattcataagttttgggtgagtcaaaagttatctttggattttcaactgtgccagggacgtgtgtgacgcccctaactcccacattgttcaagggtcaactctagttttttgttgttgttgttgttgtttttgagatggaatcttgctctgtcgcccaggctggagtgcaatggtgtgatcttggctccctgcaatctccgcctcccaggttcaagcgattctcctgcctcagcctcctgagtatctgggattacaggcgccacacccagctaatttttgtatcaaggtcaactgtattttcttgcaacagccagagctgactaagacagtcttgaagctcaaagaggtacaagaacctacccaaagttatccaaccaacaagcacctggaaggcagaataaagactcaggtagccaagcgccatagccacaccatggtagagctattctgccttgtagagatgcattgaatctgtcacagggtgaatacatctccaaatgcatttgaaaactcctacgggatgctacagaaacacgtgagggaagagtgggtgtggacatactctccatctgttacactcagagtactccaactacaggagtgagatgcctcaagacaggccaaggcagaaacaagcatcactatgaaccccagaatagatatgttttttggccagacacggtggtacacgcctgtaatcccagcactttaagaggcccaggtgagaagactgctggaggccaggagtttaagaccagcctgagcaacagaggaagatcccatctctacaaaatatttaaaatatatacatagctgggaatgatgatgcgtacctacagccccagctactttagacactgtggtgggaagatcactcgagcccgggaggctgaagctgtcgtgagccacagtcacaccactgcactccagcctgggtgacagagtgagatccggtctcgaaaaaatcatcattatcgtcacagtaatgagaggaattttaggtgataggtggttactaatttcaaaaataggggcttccggtttctcctctaatgatacaggggttaagaagaaatgacttaagcagatagtaaaaattagctgggtgtggtggtgcacacctgtcatcccagctacttgggaggctgagatgtgaggatcacctgagcctcggaagttgaagttgcagtgagccatgatcacaccactgcactccagcctgggtaacagatggagaccctgtctggaaaaaaaaaaaaaaaaagattttgcacaaagttttacgatgactctgctttgtaattaaaagtaatttctgctttgttggtgatttctcacacatttatctggtagaccagatacctgcatgtgatagggtaagaaggacccatttccctccaaggagaacagcattgcaagggggttgaggacgcatgcatgtggaatccaaacattgaatgcactgagacggcgctgcatgaagcctgtctgtgagtttatgatgaagctgcacagagctccgtaggcggctctcactcctctctctcagcctttggcttcagtttaattgcatacacacccttcagagctgctcggggcccccacttcttcagccttctggcatttttctaagaaacactaaacctctttccaacgttgcccttggattttgtgtgcacgtcttccagcccttgagctgcttgacctgtgcttgcaagggttccataacactggataggacagaagctccgcccagccccaggtgaaagctctgtgctcttcagggaccatgtcctattcacactgtctccctcacatctaatacagtcatgatactcggcaatatagtactccacccaacaggcaactcagagtctgccagtgatacaggagttaagaagaaatcacttaggcagacagtaagggtatgggagtcctcggcaaggcttttttcttttctttttttttttttttttgagatggagtcccgctctgtcgcccaggctggagtgtagtggcgtgatgttcgctcattgcaacctccgcctcccgggttcaagcaattcgcctgcctcagcctcctaagtagctggcattataggtacgcaccaccaagcccggctaatttttgttttgttttttttttttttagtagagacgcggtttcactggtcaggctcgtctcgaacccctgacctaatgatccacccgcctcagcctccaaaagtgctgggatgacaggtgtgagccactgcgcccggcagcttttctctttaacgaaaagcagccccaagtcattttctaacaatgaacagcctgtcaagtcgagctgcagacatacacaagccagctgggagcttgtacgggtgaatgtcgggaggacctagggactagacacgttcaagatggcggctccatcttcccgggaggaactaacgactagacacgttcaagatggcggctccatcttccgggcaggaactagggactagacacgttcaagatggcggctccatcttcccggcaggaactagggactagacacgttcaagatggcggttccatcttcccggcaggaactagggactagacacattcaaaacggcggctccatcttcccagcaggaactagagactagacacgttcaagacagtggctccatcttccctcctctttgtcagccacatgtaaagtaagaaaaacaggaccgagagccccgaccaactacaaagcccatttgcataaccgattagggtgggcaaccagcctttcctgtgggctatgtaaatgtcatgcttgatggaaccaatctctcggagagccccgaccaactacaaagcccatttgcataaacgattagggtgggcaaccagcctttcctgtgggctatgtaaatgccatgcttgatggaaccaatctctgagctctatgtaaatgagacaccgcctcctcaaactggactataaaatccatcacatttggtgccagctggtcctttccgctcggagacccctttctctatagagaaaaccatttctctttctcttctcctgattaaacttccactcctaaactcctcgtgtgtgtctttgtcctaaattttcctgatgcccaatgacgaaccccagggtatataccccagacaacgtagccacttcactaacatgtagagagcttgcgcattttaattcctatcctcacaataggcaaagagcagaacatactgaaaatcagcaactctgcgatccatcagaaaatagagatcacaagacgaaatgctgcctgaagactggacagacaggtggcaagtggaattgtgcttgtctaggagttcctgctggagccagcacctgatggacacatttgcagggtaattattaaacagctgcaggctgacagtggacaagcctaagtaagttaaaaactcctggccaggcatggtggctcgcacctgtaatcccagcactttgggaggccaaggcgggcagatcacctgaggtcaggagttcgagaccagcctggccaacatagtgaaaccccgtctctactaaaaatacaaaaattagccgggcgtggtggcaggcacctgtaatcccagctactcgggaggctgaggcaggagaattgcttgaccctgggaggtggaggttgtagtgagcccagatcgcaccactgcactccagcctgagtgacagagcgagactctgtctcaaaaaacaacaacaacagaaaaacttctgggggcccatcttagaggggaccttgtactttcacaaattttacctccgggagctccaccaggttcccagggtgaagatcaaagaaatatccagttgtgtgttattgggggaaagtaaccactttgcaatattcctagggagacagtagcattttgaagtatgcccaaagcaatccgtgtcctctctgccctcaaaggaaattactttagcgcagtcaaagtgaactgggggaagggaaatcttctatttcagtttttcttttttttttttttctttccaggcagattttcactcttgttgcccaagctggagtataatggcgcaatctcggctcactgaaacctccacctccagggttcaagcgattctcctgcctcagcctcctgagtagctgggatgacaggtgcctgccaccatgcccggctaatttttcgtatttttagtagagatggggtttcgccatgttggccaggctggtctcgcactcctgacctcaggtgatccacccgcctcagcctcccaaggtgctgggattacaggcgtgagccaccgtgcccgaccagatttcagtttctattagctttcaacaacacttttcgtgcatgagtgacgctggcggccatgtactcagccattccatcaaggttccaagcagcaaagctgcaaaatggatctgactccttcagtgaagaagagtctccctgaatgcattggaaacactcatgagatgctactgaagcaagtaagggaagcctgactgtggacatgctctctgtctcttaggctcacagtactccaaccacagaaacgagatgcctcaagggaggcagaggcagaaagaagccatcactataaacccaagaataaagccagcagagctacagtgatggcctgtgtgctgcaggtgagcatcaccttgttgtaaggccacaggctttcctggccaccctgctcagttggcctcgtggtgggagtcactagactcaagatagacccagccagaccatctggttagagctacccaaggaaaagccattgtcagcacaaagtcactggagtcttagaatgcacagctgtgatgggctgattccttctcccaaatccctatgttaaagccctaacgcccaggacctcagaatgtcaccatatttggagatagtctttaaagaggtgattaaggtaaaacaaagtcaccagggaggcccctaatccgagaagactgggatgcttataagaagaggagatgaggccgggtgtggtggctcacgcctgtaatcccagtactttgggaggctgaggtgggtggatcacgaggtcaggtgatcgagaccatcctggctaacacggtgaaactccatctctactaaaaatagaaaaaattagctaggcatggtggcacgcacctgtagttccagctacttgggaggctgaggcaggaaaatcgcttgaacctgggaggtggagcttgcagtgagccgagatcccgccactgcactccagcctgggcgacagagcgagactccgtctcaaaaaaaaaaagaggaggagatgaggacacagacacacagagtgacgaccctgcgaggacacagtgagaagatggcatctacaagcctacaagagaggcctcaggaggaaccagccctgcctacaccttgatcttggacttacagcctccaggattgtgggagaataaacgtctgttgtttacaagccacccagtctatggtattctgtgatagcagcctgaaatggactaagacacctcataagaaaaggagatgaggacacagacacacacattgggacaaccctgtgaggacacagggagaagatggcgtctccaagcccaggagagaggcctcaggaggaaccagccctgcccatacctggatctcagacttccagcctccaggactgtgagagaatcaatgtctgttgtttataagtcacccagtctatggtattctgtgatagcagcctgagatggactaagacacctcataagaggagatgaggacacagacacacacagaggggcgaccctatgaggacacagggagaagacggtgtctacaagcccagcagagaggcctcaggaagaaccagccctgcccacactttgatctcacagacttccagccttcagaactgtgggaaaataaaagtctgctgtttaagcggcccagcctgtagtattttgtcatggcagccctaggtgactaatacaacaggtgtttcatcctgttcctttcctcaggtggtgttgcagagtaccccagcatctttaggtggtggtagaagagactccagcatctgccataacccccggaagagtgttctgtatgttacactgtggggaggttttcctcaaagcattagagtgatctgaacaatgggaatctttgcacagaggaggatgagttctactcggggatggtacctactaagagagacatgttgtcttctcttcaattgccctttaatgaagaaataaaaattatttaattattcggtgaagaaataaaaagagtattgcattctttcaacagagattctgcacttgtactcccaggtatttatgaaacctcatgttgatgcctggtgcataggccaggcagtggggctctacctaagtaatgcctggtggttggccatgggtagctggagcaccaatagcatactctaatagtccatgacatcggtctactcaagggccatggctcaaatagaaggctttgtttggaggaattcaaaagaggttctactgagaaggaacctatgaatcagtgctgctacaatacttttggattgtgcggttcaaacgccatattggttttcttccagctctccagctccagcagcactgaggcagatctgagtttctcgaagctgggcccatcaccaacaagacagtgatggtgaaagcaatgatagaagaggtcgaatttagagtaaggatcaggatggacaggtgggtacatctatgcaaccctaacctttctgaaactactaggcatagatattttcctgaagactagtctcagcctgcatggatggtccctcatggctactgtctcatttgaaaagtgaacctatgaaaagaggaaaacactatgacatccaccactgtttggtcacaccaattcttgacattaactctctcgaaggacattagtatgaccttcaaatcctagcccgcaggaaagcttcactttagttgtttgtttcctgggtgtcccttcctacaacccacgaagcaaatgccacacaccctccttacatgcataaaacagtgctgataatggatgaaacacacaagtatcagctcatgcctgcactttcagagaaaacactcttgcttagaccatgggtatgtcaagctgccaaggatacaaaaggtaaaacaatccaagggcaacagatggttcatgacaaagaactaagagggcagcactgcgattccaaaaatttggatatggacgtcaatgagagtgaatgagagagaagcagagagacggcgggggggggggggggggggggagggagggagagagagagagagagagagacagagagaaaggaaggaggaggaggagaaaggaaggaggaggaggtgaaagaggaggaggagaagcaggaggagggggaagaggaggtgaaggagaagggaaaaaaaaagtagaaggggccaggtgcggtgtctcatgcctgtaatcctagcactttgggaggctgaggcaggtggatcacgaggtcaggagactgagatcatcctggccaacatggtgaaaccccatctctactaaaaatacaaaaattagctgggcagggtggtgcatgcctgtaatcccagctactcaggaggctgaggcagaagaatcgcttgaaccggggaggcagaggttgcagtgagctgagatcgcgccacggcactccagcctggcaacagagtgagactccgtgaaagaaaaaaaaaaagaaaagaaaagggaagggaagggaggggaggggagggaaggggaggggaagagaggggaagggaaggaaagggagaaggagaaggaggaggagagaaagggaaggagaagaaacgaaagaagatgaaggagaagaaggagaaggaggaggagaagtaggaggagatgaggggcaggagaaggaggggaaggaagaagtaggaggggaagaggagggaagagaagaggaaagaagacagggagagagaataagagaatgagaaagagagaatgaaggagagaataaatgaaagaagagagagatgagaaaacctacttgtgaaagaggcctcagtagaagaaaagagaatgagcaaagagcctggtccaggccactctaaatgtctctcaaatgttaaagactgatgaaggaggagcaggaagacttatcacacgtccaaggagacaatgttgagcgacccgcaaacttagcagaagggagaacaggctctggagatgtccagtaatggggtagagcccagactcccacacttggtagttgtacccttcaacctggagaggcctcagttttctcatcagtgaaatgggcccaagaatagtatctatctcaagaaaccattttctctgctccttcatgagaagaaactcctcttccattccagttttatcatgagattacaggagttcagccccatcttcaacctgcacctttacttctgctattttcaccatagcagaagtgacttcctccactgaagtcttgaaccccctcaatgtcattcatgaatattggaattcactttttcccgatttctgttaatgtggatatcttaacttcctgccatgaatcaccaaggttctaaatggcattcagaatgaggaatcctttcaggaaggttttttggttttttttttttttttttttttttttttgagacggagttttgctcttgttgcccaggctggagtgccatagcgcgatcttggctcactgcaacctccacctcccaggttcaagcgattctcctgcctcagcctgccgagtagctgggattacaggtgcccgccaccatgcccagctaatttttttgtagttttagtagagatggggtttcaccatgttggtcagactggtctcaaactcctgacctcaggtgatccacctgccttggcctctcaaagtgctgggattacaggcgtgagccaccacgcccggccctgactcgaattttgaaaaaagttctactctgggtaaaaccctatcaaacagcatcgcttgatacagaaaaatctttcatgacagaaagggtcaactgatgtgacaaacatcactgttgtctattttaagaaattgccaaagcaccctctaccctcagcaaccaccaccctgatcagtccacagccagcaacattgaggcaagactctccaccagcaataaggttttgactcgcgaaatgttcagataattgttagtattgtttaccaataaagtatgcttaaattaaaaaatatatatcgttggaatggtgtatggatacaccacaaaacagtcttagcataatgctcaccattcactaagtgctcaataacgacattattaactttgccaattcctctgtttattgctcagaaggatgatgcatttgtcaggagaagcaaagaaaaagattcttgaaaagatcatggtgacattgctgaaaggtcggggagaaaacacaaacagactgaatgggtcctgtgaagctcaagggtgtgggtagctcgtaagaaaggctatgagcagagattacgctggagaaatatgccaggaagggaagggaagggatggtcagaagctagttagtgtgtgcagtgatattttcacaatgcttttgaaatcagcgtgttaattggctaaatgagccactggctggatgacagtatgtgagcattagctgctctatgtcagctgggattctaggaaaacagattgtgccaaacatttggatatccagaggaggcacaacaactgtgcattagaaataggacttatgtttcccacccaactacctctctctggggcctgacctgccgtctaaaaacagtccaccccaatgcagcctccagtcactctgccaggtattgacccagagtcttgattctatgcaacaaataagatctttgcattttaacccattgagttttagtaagaatcttcgacaagaagatttcttccagagaaccaaagcaggagttgcaagattgcaaagggcacactgaggtcttaaatatccatctgatttggccaggaatgtgatcgatcaaaaactcaggaattttcctggtcatcgttgtctaacgtgtattcagaatgtactctgcggtgagtaccattttacgaaaagactcactggccaagactatgggcgtgaggtaactaacaatcagggggcttggtttcattttgttgaaaaaaagttcaacaaagacatccacaaagaaataggtgatgggcctttgcctactcatttctttgctcgttttgctatttacccattcccctgttttcttgccctgtaaaatggacacaatactcaagcttcccattggtgtcaatgtttacattcacgatgggtaaaaaaaggtatttcatgatttgaaaagtgtgatgcattttattcttttttataactttaacaccttttaattttttgaacgtttttgagtcatcataacacatagcttaaaacacatacacacgtggtgcagctgtacaaacatgtatttttttaaacttgtatgttagattcgggaggagtccatgtgcaggtttgttgcacaggcaaattacgtgacatgggagtttggtgtacagattattttgtcacccacataatcagcacaatatctgatatgcagtagagacagagtgccactctgccgcccaggcttgagtgcaatggtgcgatcccggctcactgcaacctccgcctcatgggttcaagtgattcttgtgcctcagcctcccgagtagctgggattacagatgcctgctactctgcctggctaatttttgtatttttagtagagacagggtttcaccatcttggccaggctggtctcgaactcctgacctcgtgatctgcccacctcggcctcccaaagtgctgggattacaggtgtgagccactgcgcccggccaataggcagctttttaatcctccctctcctcccacccttcaccctcaagcagaccccaatgtctgttgttcctttctttgaggccacctttactcaatgttgaacttccaattataagtgagaacatgcgatatttgcttttatgttcttgtattagtttgctaaggacaatgatctccagctccatccatgttcctgcaaaaaataataagatcttgttcttttttacagctgcacagtattccacgacgtacatgtaccacattttctttacccagtctaccactgatgggtatctagcttaattcccatgtctttgctattgcaaataatgctgcaatgaacattcatgtgcaaaagtgtctttacggtagaataattggtatttctttaggtatgtacccaggaatggttgctgggttgaatggtaattctgttgttttaactcaaaagtatgctttttttttttgagacacagtcttactctgtcacccaggctggagtgcaatggcatgatcttggctcactgcaacctccacctcctaggttcaagtgattctccctgccttagcctcccaagtagctggaattctaggcacctgccaccatgcctggctaatattggtatttttagtagagacggagtttcaccatgttcgctagactggtctcgaactcctgacctcaggtgattcgcgtgccctggctgggattacaggcgtgagtcaccggacccagccgcctattttctttctttaagagataaggtcttggtctctcagccaggctggagtgcagtgatttgagcacatctcactgcagcctcaaactcctgggctcaagtgatcctcccgcctcaacctccccagtagctgggaccacatgtacacaccaccatgcccagctatttttgaaaaatttttgtagaaatggcatcttgctgtgttgcccaagctgctctcaaagtcctgagctcaaaataatcctccatcttctgaaagcattgcgattatgggtgtgaagtttctttgactttaatattttaacttaatttataacagtatttttgaataagggactctatccatcactatttaattctataattgtatatatttgcaggcccctccaagcctttgtgaaccctgaatatctgagatggtgtcagttaatttagaaagttaagtccgggcgtggtggctcacgcctgtaatcccagcactttgggaggtcgaggcgggcggattgtctgaggtcaggagctcaagacaagtctggccaacatggtgaaactccgtctctactaaaaatgcaaaaaaaactttagctggacatggtggcgggcacctgtaatcccagctattgaggaggctgaggcaggggaatcgctggaaccagggaggtggaggttgcagtgagccgagatcgtaccactgcactccagcctggacaacagagtaggactccatctcaaaaaaaaaaaaaaagaaaaatttattttgccacagttgaggacgcacccatgacacagcctcaggtggtcctgacgacatgttcccaaggtggtcagggcacacgctggttttatacattttaggcagacatgagacatcaatcaatatatgttgagaggtacactggttccatccagaaacacggggacgactcgaagtggggagggggcttccaggtcataggtggataagagacaaatggttgcattcattatttttttggggtgtgtgtgtgtgtgtgtttagacagagtattgctctggcaccaggctggagtgcagtggcgcgacctcggctcactgcaacctcagcctcccaggttcaagccattctcctgcctcagcctcccgagtagccgggactacaggtgcccgccaccatgcccagctagtttttaaaatatttttagtagagatggggcttcatcatataggccaggatggtcttgatctctttacctcgtgttctgcctgccctggcctcccaaagtgctgggattacaggcgtgagccaccgcacctggccaggagtaactttgaataaaacgggaggcaagtttgctctgagaagttcccagcttgacttttcccttgagcttagtgatttggggaccccaagattttcctttcaaaccttcttaaattattgttactgtcactatgcttccatctttcatgaacttaggcgacatccatggaggtatcatttgcagattcaaagtagctctttcaacttctgagtcatggagcacagtgtctttaatatcatgcttttgtttttgtttttgtttttttgttgtcgttgagacagagtcttgctctggtaccagggagtgcagtggcgtgatctcggctcactgcaacctccgcctctcaatttcaagccattctcctgcctcagcctcccaagtagctgggactacaggcgcccgccaccatgcccagctagtttttttgtacttttagtagagacggggtttcaccctgttgcccaggatggtctcgatctactgacctcatgatccgcctgcctcaccctcccagaatgctgggattacaggcgtgagccaccacgccagactgcagtagtgagtcttagtcactcactgtgaagttccctgcagtttctttttcaaaagcattttgctgtggataacgcattctcattacgtcagacatctgcagtaacatttatctagcaacaaggttaactgccttcacatcaacaaaaacaggttgtgttgccagcaaagaagaatgccagttctcttttccatcccataatacttgtcatcagtactggggtatcctgttcaccttctcccatgctgtgagattaatttagagaacatattcacggtattttgttttttgttttgttttttttttttgagacggagttttgctgttgttgcccaggctggagtgcaaaggcatgatcttggctcactgcaacctctgcctcccaggttcaagtgagcctccagaggaagcacagtactgcccacatcgttatttcagacttctggtctccaggactggaaaagaataaacttgttgtggctttaagacttccaagtgtgtggtcgtttattacagcagccctaagatagatagatagatatagatagatagatttattttactttaagttgcaagatacatatgcagaacatgcaggtttgttacataggtatacatgtgccatgctggtttcctgcacccatcaacccgtcatctaggttttaagccctgcttgcattagaaatggggtttcgccatgttggccaggctggtcttgaactcctgacatcatgatccacccacctcggcctcccaaagtgctgggattacaggcgtgagccaccgcggctgacctttattgctctttctatgtaaaaccagaaaagccaacaaagctatttcccgtaatgacatgcccaagtcctaacccccaaacaccgtgaatgtgaactgatttgcgaatagggtcttggtagatgcattctcgttaaggatatcaggacaggatcatcccaggttcaggactgatggacacttcaaactttcattctatattctttcacacgagtagtgttgtttggctctgagaagcactttcatttttatttccaggcaatttcatatcgttctcttcaattcagtgagtgcaaaagaagcaagacagggagtgatataaaattactgctaatagaaaattcacttttaatcttgcttaaaacaagtttttttgttttttgtttttttgtaaaatgaaggagagagctgaacttcaaggatgcgaatttatttccacacaggggagaaacactgattggagaaaatttacagttgctgtttagacacttgagcctcaggatcgagaaaaggtgcacctcttagatgggccttaaattggagatgatgatatctaaccacctggagacgggaaagtaggtgtcactcaatgctgaacggtgctactcatctgtgagattgtataatgaagttttggagactgagcctgtaccttcatctgttctttaaccaatgcacacttaacaagcacgtcatgtttagctgctcagcagagcttccttcttcagaaacagagacggggtgcggaggcattttacaacccagggggctccagcttcatagactgtcttgtgaggatctatgctgttactctgaggatcagcgttggttttccaagtccttcatgaacataacaagtcaatgataagacgacaagttccaccgctgtgcctcagctgagacaaaaaaaaaaaaaaagctggaatcatttagaaataacaatcccaggccaggcatggtggctcatgcctgtaatcccaacattttgggaggccgaggccagcagatcacccgaggtcaggagttcaagaccagcctggtcaacatggtgaaaccccgtctctactaaaaatgcaaaaattagccaggcatggtggtgcgcgcctgtaatcccagctacttgggaggctgaggcaggagaatcgcttgaacctgggagatgaaggttgcggcgagccgagacagtgccattgcactccagcctgtgcaacagagcgagactctgtttcaaaaaaataaaataaaaatagaaaaaggaagtcacactcacaaccattctacaagcaggagacccagaatattttgctttagaatctacaggctctgctttaaaattcctcctctcccaaactcaggttaaaatgtaagcctcagtgctggatgggaggtcgaatgggaggggtttgagcaacggacgatggattcttcctgaagagatcaatgtcctttcttgaagcatgagtgagtttttactctatgagttctccacaggctggttgttaaatagagcctggcgtctcccgtctgtcttccctcctgtctcttcgtgtggtctctgtacacataccagctccccttcccgttccaccatgagtggaagcctcctgaggtcctcagcagagacagatgctggccctgtgcttcttgtacagcctgcagaatcataacccaaataaacctctttcctctataaattatccagcctccagtgttcctttctagtgacacaaaaccgacgaagacaccccagctctctctaccatggggtatttatgtcactagtgatgaccgtcctgacaaggggccagccctgcagttcccacgagaccacctacttcccactccccatatgagctcagaaacttccggaagctggtacactcatggaatgataatccatataatttccgcaacgagatgtgatgtagtatcatgcttacttaagtgatcctgaatatactctttttgtgtgtttttctttaattttccataacttattgggttacaggcagtatctggttatataagtaagttctttttatttttttctgagacagagtctcgctctgtcagccaggctggagcgcagtggcatgatctcggctcactgcaacctccacctcccacgctcaagcaattctcctacctcagcctcccaagcagctgggattacaggtgtgtgccaccaggcctggctaattccttttgtatttttagtatagacagggtttcaccatgttggccaggctggtcttgaactcctgacttaaggtaatccgctcgcctcagcctcccaaactgttgggattacaggtgtgagccaccacatccgatcacgagtaagttctttagtggtgatttgtgagattttggtgcacccattacccaagcagtacacattccacactatttgtagtcttttatccctcgctgccccctcccaagctctccccaagtccccaaagtccattgtatcattctcatgcctttgtgtcctcatagcttagcttccacgtatcagtgacaacagacgatgtttggttttccattcctgagttacttcacttagagtaatagtctccaaaggacatgaacttgtccttttttatggctgcatagtattccatggtgtctatgtgccacattttctttatacattctatcattgatgggcatttgggttggttccaagtctttgctatgtgaatagtgccacaataaacatacgtgtgcatgtgtctttatagtagaatgatttataatcctttgggtatatactcagtcatgtgattactgggtcaaatggtatttctggttctagatccttgaggaatccccacactgtcttccacaatggttgaactaatttacactcccaccaacagtgtaaaaccattcctatttctccacatcctctctagcatctgttgtttcctgacttttaataaagctggaaaccattcttctcagcaaactaacacaagaacagaaaaccaaacaccacatgttctcactcataagtgggagctgaacaataagaacacatggacacggggaggggaacatcacacactggggcctgtcgaggggtggggggctaggggagtgatagtattaggacaagtatctaatgtagatgacgggttgaggggtgcagcaaaccaccatggcacatgtatacctatgtaacaaaaactgcacgtcctgcacatgtaccccagaacttaaagtataataataaaaaaagtaatagtctccagtctcatccaggtcactgcaaatgctgttaattcattcttttttgtggctgtgtagtattccatggtgtgtgtgtgcgtctgtctgtgtgtgtgtgtgtatatatatatatgatgtccatcaatatatacaatgtccaatgttctggagtccacagtcagtaatgtccatcaaggtacatacacacgttcacggacattattgcctgtggacatcagaatcttgacccacacctaggaaatgactgcattcaacgtcaggcgactggactccccgccagacacccgccattgagaacaaataataaaagccacagtcttcaccttgcaaattgatatttggacttttgtcattcaaggatgctttcaatggttcgtgtctactaggcttgggagaaagataggctcgtgagaggagacatcagacaactggcaaatcagaggtagatgaagcaacaaaaggaaggaaaaagagtgtggaaataccagccaacgagctggtgttcccaatgggacctatgaaaagatgttttgcaggtggagagaagaaagaggagacgcaagcatttgagctgagcaacgaatattgcctgcattgcggaggaccaagaatggacaatatcaccaggttagcctcctgggaaatgctgcacgggtggcaggttcagcaaatcaaggcagggggagaaaatggctgccgctctctctccagtttgcgatcctgggaagttagggtgcacgggtttactgggctttgatttcctcagaggactggttttacttacacacagcaggaagccataatacaaggggctcttttcccaccacaggcatcaagctgaatcaccgcacacgcttgcattccagactcatgttctccagagcttacaggttgggatgggaccactgtaacccatgaccccaaactagggagcttacaaaagcagccatttaacctctcccagtcctggagactacatctgtgaaatcgaggtgcctacagggacatgctccctgctctagggaagaattcttcctgcctctcccagctcctgggggctccaggcatccctgggcttatggccgcatcactccagtctctgcctccgtctccacgtggccttctcctctgtgtctgtgtctcctcttccgtctcttacaaggacacctgtcattagatttaggatccactgcaatccaggatgatctcatctccagatccttttttacatctgcaaagaccttatttccaaataaaaaatcacatgtacagattcaaggtgaacttgtcttttttttttttttggtgggggtgggggtaaaatagaggcaccattcaatccactacaggggttgagaagaaataaaatattacaaaatgctccctgataagaaataaaatattacaaaatgcttcctgaatgtgatttagaagtttttttgtttgttttgttttgtttttaaatggagtttcactcttactgcccaggctggagcgcaatggcgtgatgtcagctcaccgcaacctctacctcctgggttcaagtaactctcctgccttagcctcccaagtatctgggactacagatgcccgctaccactcccggctaattttttgtatttttagtagacatggggtttcaccatgttggccaggctggtttcaaacccctgacctcaggtgatctgtccgcctcggcctcccaatgtgctgggattacaggcgtgagccacctcgcccggccgatttagaagcttttgtttgtgggcgtgaaggttcagtaagagcttcctctagtccttgtcaagatcaaaattaaaggcattataaacagagatgcctatctgtcggccacatatccagaaaataaatgctgagatgagaattctggtttctgaataggagtctgatatctgcatttggtgttgccaaagcaagccctgacttctctcttctctcattgagacagagcacacaccctcactccttgtgtctctgagtcacatgtatcgggccatactcacctgatacctcacggattgtcccggggctagttctatttctagctcctgggcaggacggtgaccatgagttcgacggtgcccagcaagcccatctggccagcacttatctgcctttgggtacagcctgccctttctcccaagtgtctgagcataaaaatagcccaccatgtcaaccccgcagatgacaagcatgtgagtggctagtttctgcctgagaactctcccgaggtctccctgaacactcacggatgcctgggctggcccaagatgcagcagtaggtcactgacagactctcttccatttattcacagtttccatgattcccacgctcatagcatcgacataacaaaagcaaagttaagctacagactctgctcccgccccaacctctctaatagctgctaacagagccaatggattgtttttttcaacttgcaacttaaacacaactttgccttctccctgagtcttttaattcaaacattcagtcattctccatcaggtacgcacaggagatacaaaatcaatatgataacggtcttcaggttgtgggtgacagagcgggagcatggccatcttgaacaaacaccaccattctaggctccccttgattaaaaaccgcctaaatccagcccgaaaacatcagcctcatgactcatgtcagcataaccagaaacattccaaccctaagataaacccgtctccgaccaaaaacataccaaccctgagacagcctcccctctgaccagagatattcaaccctgcaataaactctccctcacatacaaacattctgaacctatgataagcacccccttccaaaacccttaaatgtgcttagtctataagagagaagagctctgacctaactcagccagaagcccctctcaggtttctctaaaataaacctgtgtttaactgtcaagtgacatttcatgcttctttcctctttaattcttacagtgagtgtgtagagcacgcttgacataagtgactccaccttagaaaaagattccatgttacatttcattcaaaaggcatcatgcctacaggagccagatgttcacctgatcaataaagaccacatccaaacagttaaggacacaaccaaacaccctcttccattgtcaatcctcaccagaggactctgtggtcatgaaagaacagggcttcagcagctccaaatggctaccttaacagatgccatcttgctgtcacttgtaatcattacgcagcatccaccgcaaaaggctctgccccactgatatcaaaggctcttccttgcaagatggcgaccactgatggccctccagggccaggccaggagacttttttttgtccacatcaatatccctgtgctcctttgttaagctttttcctaccccttttctcttgatgataaatgttacgttgtttgatgtagaatgtttaatctataacatgcatatattggtgaagtgtattagtatgtataggttgcaatactgactgacttgggtcacagcaggagcctgtgcgcctgtagctctgactaaatgctgccggcacacaggctccagtactccaagggctcaagccatttcagtactaaatgggaagtcctaaggagaattgcctccttgaaaactccgtgcatcttggggcttctgtaaactgaaatagcatcaataaaaggctgaacttgtgaaaagacacaaccatacatgggcctggttttctatctctgaccttgcaccactcatgagagcgggctccagcaagccagccagcaggaaagacagaaaaggtgaaaactgattcaacaaaggaaggatacttgagctagattaaacattttattacattttctctgaatttttagcccatcatcacgggtcattagagaaatgcaaatcaaaaccacaatgaaataccaacttatgccagttagaatggcgatcactaaaaaagtcaggaaacgagagatgctggagaggatgtggagaaataggaacgcttttacactgttattgagagtgtaaattagttcaaccattgtggaagacagtgtggcgattcctcaagaatccagaaccagaaatactatacgaccacagactggataaagaaaatgtggtacacagacacaccatggaatactatgcagccataaaaaggatgggttcatgtcctttgcagggacatggatgaagctggaaaccatcattctcagcaaactaacacaagaacagaaaagcaaacaccacatgttctcactcataagtgagagttgaacaatgagaacacatggacacagggtggggaacatcacacaccagggtctgtcagggggtcaggggctagtggaggtatagcattaggagaaatacctaatgtagatgatgggttgatgggtgcagcaacccaccatggcacatgtatacctatgtaacaaacctgcacgttctgcacatgtaccccagaacttaaagtatataaaaagaagcatatatatatatatatatatatatatatatatatatatatatactgtatttatttaataaaatttcaaattaatgatgtaaaaattttgaattttataaatttgaatatgacttggcctgtgacagagacagaggccacaagacccctgcagtctaccctataccctgctgccacagtgacctccctaacatacacacctgatcacaagtcccctcagagcagcttccatggcttcccctgcctcttgaaatactgcccaacttgtgttctgtctgggtactcttgttctgaggcacccttgatccttgattttataagtccacttggctgagccatggtgcccacatatgtgattaaatgttcttctgggtgtttctttgaggttgctttaaatgagataaatatcgaaatcaggagactttgagtaaaggaattggtgggtaggcctggtctaatcagttgaaggtcataatagaacaaaagactgggctgggtgcagtggctcacacctataatcccagcactttgggcagctgaggcaggtggatcatctgaggtcaggagtttgagatcagcctggccaacatggtgaaaccttgtctctaccaaaaaaataaaaataaattagctgggcgtggtggtgtgtgcctataatcacaactactcgggaggatgaggcagaagaattgctcaaacctgggagatagaagttgcattgagccaagatcgcaccgagatcgcatcgtaccccagcctgggcaacaagagtgaaactctgtctcaaaaaaaaaaaaaaaaaaatctaaatcagtacactttgagtaaagcaatttgtccttcctatggtgggtgggcctggtccaatcagttgaaggtctgactagaacagaagactaatgttacctgagccagaagggattctgccaacagatggactttggactccaactacatcatcagctcctccctgggtctccagctggctggtctaccccatacatcttgagacttgccagcctccatcaccatatgagcaaaattccttaaaataaatgtgctttctatcagtacacacatcatattggttctatttctctgcagtatcttgactcagacacacagttccctggttctgcggcacccacctcccgtggtatccttgttctgtaagaaattagtaagttttaggtgaacgccaaggaggaatttcatccaggaaagctctttgcctccttgtagacccgatgaatttctactcactctctaaaatttaactcaaatacatgtattttctgataatgtttctaactctatgagcaaaaccaggcatctcactccatggcatctggacacgcagctacagaggtgcatctgacatgcccgagttgttatgtaccatcttcccctgactgtgaatctcttaggaatgacatccataaaaatgcaatgtgccatccaggatttaatacgtgctcaaatattgccgagtgtggtttttctcgtctctgttttcacagtccaggctggcaccatttctctgcaaatcagtgtatttttcacccacctgattttcctgcccccagcctcccctcccacaaggcgccttgaagctgctgtcaagctcaatctcctgaagatagcccaaatccttcccgcagcctttggaaagcctcccatagcttcttctcacagcaaatctaagtaaactacaaggtgactcccatgttcccctccccatttttcctgtttgtagggatgttgtatgagtctggttttttttttgttgttgttgtttaatactttaagtcctggggtacatgtgcagaacatgcaggttacataggtatccatgtgccatggtggtttgctgcacctatcaacccgtcatctacattaggtatttctcctaatgctatccctcccccagtcccctactccccgacaggccccagtgtgtgatgttcccctccctgtgtccatgtgttctcattgttcaactcccacttatgagtgagaacatgaggtgtttggttttctgtccttgtgatagtttgctgagaatgatggtttccagcttcatccatgtccctgcaaaggacatgaactcattcttttttatggctgcatagtattccatggtgtctctgtgccatattgtctttacacaatctatggtcaaatagtatttgatatagataaggatggataaataaagtataagtatgttttcatgctgtagataaagacatatctgagaatgggcaatttagaaaagaaaggtttaactggacttacagttccacgtggctggggaagcctcacaatcatggtggaaagcaaaaggtgaaaggcacgtctcacattgtgacagacaagagaagagagcatgtgcaggaaactcccctttataataaccatcagatctcataaaacttactcactatcatgagaacagcagggcaaagacctgcccccatgattcggttacctcccactgggtccctcccacaacaggtgggaatacaagatgagatttggggccgggcgcggtggctcacgcctgtaatcccagcactttgggaggccaacacaggtggatcacctgagctcaggagttcaagaccagcttggccaatttggcaaaagcccgtctctagtaaaaacacaaaaattagccgtgcatggtggcgggcacctgtaatcccagctaattaaaaggctgaggcaggagaatcgctggaacccaggaggtggaggctgtagtgagccgagatcatgccacggcactccagcctgagtgagcgagactctgtctctaaataaataaataagatttgagtggggacagagccaaaccatatgagatgtaatgagctgtacattttcccaggcatttaatgcctttttgtttttcagttgccataatgcggtgtccagcaacatacggtacatggatgtcatacatgggacatgtaaaatggtagcatccatctgcagttagactgtaggctccctgttggaaccaccctgctcgtggacaatcactgctgtcttggtaatgaacaccccctacatatctgcttcactatagagctgctgcctccagaaaccccatacacccatgcgttctggcagtgccaacggctggaaattgctgcccactcctcagccaaacccacagtcaggcagggaacccaagccaggccaattgggtccctgccttgggatagtccaacgtaacataagaaaaagacagtgtgttagtattataggcaaagcaaggcaaaagagaatagagaagcagctcgggtaagagactaaagcttctctgcaggaagaggagaccccagagataggaagctggcatcctggaaaggttggactctgtgttctggcctctgagaagaaagtgatcactaagcttggtgcagattaaacatagaagcaaaggctcttctggcttaagtggatcaagctggggtcagtcgcttgcagccagggttttgatgcatttgttcgttctctctggatggggtcagtccctcgcagccagaattctgaggcgtgcgctcctattgtctggatgtgtggggttttatttactttctttcaaaagaaaagtagatagaaaggctcaaaaggatgggggcaggggaaagacctcccagcaataagaaagaggtccaggcagcaaccatacaggaagaagcaaaaatgaaactggaaagtcagaatgaaaaactgcccaatgtctgctatattattttcttgttttgcaaagaaaggaggtccaaagcccttgtgggtctcttatttttattttttttttttttattttgttttgttgagagagcctgttgcccaggctggagtgcagtggcacgatctcggctcacggcaacctccgcctcccaggttcaaggtattctccctcctcagcctcccacgtaactgggatttcaggcacccacgaccacactcagctaatttttgtatttttagtagagacgacatttcaccacgttggccaagctggtctcaaactcctgacctcaggtgctccgcttgcctcagcctcccaaagtgctgggattacaagcatgagccaccgcgcccggctgtgggtctctttttgcacagctgggacagggaagaagaaaacttgtgttcctctgccactgtttcctgcagaaatgggtgaatacagtaaatggtacggacgttcctcaaaaaaattaaaaatagaactactcgatgatccagcaagcatgcttctaggtatttatccaaaagataaatcggtctatgagagacatttgcacccccatgtttatggcagcagtattcacaatcaccaagatatggaatgaacccaagcgttcaatagatgaatggatgaagaaaatgcggtacagctgggtgcggtggctcaggcctggcgacagactgacactccgtctcaaacaaaaaaaaaagaaaatgcggtacacgcacacaatgggatactatgcagccttcaaaagaaggtagttgggccaggcgcggtgcctggaatcccagcaccttgggagactgaggcgggtggatcacttgcagttagttaggagtttgagaccagcccagccaacatggtgaaaccccgtgtccactaagaagtacaaaaattagccgggcatggtggcaggcacctgtaatctcagctacttgggaggctgaggcaagagaatcacttgaacttgggaggcggaggttgcagtgagctgagatcacgccactgcactccagactgggcgacagagtgacactcagtctcaaagaaagaaataaagaaaatgctgtaaatacacacaatgggatactttacagccttaaacggaaggtaattgggctgagcaaggtggctcacgcctgtaattccagcactttgggaggccgaggcgggcggatcacgaggtcagatcgagaccatcctggctaacagggtgaaaccccgtttccactaaaaatacaaaaaaattagccaggcgtggtggcaggcgcctgcagtcccagctactcaggaggctgaagcaggagaatggcgtgaacctgggaggtggagcttgcagtaagccgagatcgcgccactgcactccagcctgggcgacagagactctgtctcaagaaaaaaaataaaaaaagaacgtaattggccaggtgcagtggcccacgcctggtatcccagcactttgggaggctgaggcaggcagatcacttgcagttagttaggagtttgagaccagcctggccaacatggggaaacaccgtctctactaagaagtacaaaaattagccgggcatggtggcgggtgcctgtagtctcagctactccagaggctgaggcaggagaatcatttgaacttgggaggcggaggttgcagtgagccgagatcacgccactgcactgcagcctgggtgacagagcaagactccatctcaaaaaaagaaagaaaatgcagtacatacagacaatggaataccacgcagccttaaaaagaagggaattctgtcatttgccacaacatggatgaacctgggggatgttaacgtgaaatacaccagacacagagagacaaataccgcatgatgtcactgacatgtagaatctaaaatagtcaaattcacagaagcagacagtagaatgatggttttcagaagatgaggagagagggacgtagggagatgctgttccacaagtataaggttttggtatataacatgaatcagttctgcagtctgggtacaactgtgcacaccacagcagttgtgcctagagttaacaagaccgtattatacatgtaacactttgtcaagagggtggctctcatggtaagcgtttgaccgtgataaaataaaaatttcaacacgtatgtttattgcaatactatttataacagcaaagacttggaaccaacccaaatgtccatcaatgataagactggataaagaaaatgtggtatgtagacactatggaatactatgcagccataaaaaaggatgagttcatctcctctgcagggacatggatgaagctggaaactgttattctcagcaaactaacagaggaacagaaaaccaaacactgcctgttttcactcataagtgggagttgaacaatgagaacacatggacacagggaagggaacatcacacaccggggcctgtcagggagctgggggcaaggggagggagggcatcagggcaaatacttaatgcatgcagggcttaaaacgtagaagattggttgataggcgcagcaaaccaccatggcacacgcacacctatgtaacgaacctgcacgttctgcacatgtatcccagaacttagagtaaaattaaaaagaaagaaagtcaaagacagttttgtaaatgttcggctacatcgtaacattcaaaatgagactggccaactttccctatctgctttgatgagtccatcagaatacttgtaatatgtggactaagtctttaaataaaaacacctgcttataaatatgcctgaataacatgagctctggcacttgtcagcctcagacaggtcatgactcagtaaaggatggaacacttccttgctgacacagacttggagattgagaaagcaacacaggccacccaatgggagaaagaggacatggtacagtgaaaggccagtgtgctggacatggggagggccatgctatgcactctggtgtctggattaaccactgggaccagccctgacttcctgcatggctgaagaggaggctgatgatgcattgggagttggcatcctggctctcagtgctggaaccctggaccacctgggtgagactaccagactgagagccctccctgcccttactctgtcgcccaggctggagtgcagtggcgcaatcccaactcactgcaacctccacctcctcgattcaagcgattctccagcctcagcctcctgagtagctggaattacagatgcccaacactacacccggctaatttttgtatttttagtagagacagggttccaccataacagccaggctggtctcaaactcctgacctcaggtgatccacccgcctcggcctcccaaagtgctggggttacaggcgtgagtcaccgtgcccagcctggaacatttgttgtttcaataaacagctgtgcatttttgccccctaaaagcaccattggacaaccacaatcccaggcctgatgctggcagtcataggggatcagatgtcctcccgtattctctatccacaaaacaggaagcttagctgatgactcctggaggcacactcaaccctaaactatgatataatcctgcaggaaaataaatggtatcccaagatgttcagtatgaaaatgcatgtggctttgtgggtattttgcaaagaagcgaatgggatagtatctgttttcttcactacaatctcagggaatgactcatggaaacatcagtgatccgcaagcagattatggttaaactaaaactcctacgaggctgtctccaaaaacttgagctatctgaggtgcttcatcaacagaggtgtgaaaataccgtcctacttgccgggctgagggcctgggagcttacgggtgactcagctttgcttagtatcactgctcaccatgcgacaattctgtgaagttcttcagacatgcaggatcaacgcacagtgttacagatcatctgacacttcttcctaccaacaagtgtctgcaggcgtagctgctgggctgccttgctggaacttatcagggtggaaactctttggggtgagaataccacgtttcggcgtcttcaggggatacagcagaggtgtgttgaatgctacggtgatagctacaagcacaggcaaaggctcctacagcaaataaaacagacctacaagaccagccacagtagatgaagggctatagggaccagcatgggcattcggaccagcacgggcattgagaacagcagttcagcttaagccacaaaacttcaattctccttaaaatctacaagagtccatctgaaccaccaaagttttggccaaacccaagaccaagagtccaaaaccaggctggacgcagtggctcctgcctgtagtcccagaactttgggaagccatggcaggcaagatggcttgagctcgggagtttgagaccagcctgggacaaatggcaaaacctcatctttacaaaaaaaaatacaaatattagcagggcatggtagcacgtgcctacagtcgtagctactcgagagactgaggtgggaagattgcttgagcccggaggcagaaattgcagtgagccaagactgcactattacacttcagcctgggcgacagagccagaccctgtctcaaaaaaagaaaaagcgtccaacaccatcttcctgaagccatgtgtatgtcagtagaagaaaccttcaaccccctagagaatccaaaggggagtggggaactcaggtgctgtcctcatttaccccgaaatgaagttgtgcaggaaaaaaagaaaaaagcgtccaggaattcagaacatgcttattatcctagtgagacccaaggttccatttgctacagaagcctatgaaataattcctaggacaaagggtcactaagaagtcattcatcttttgggtaatagttgaaggagtcagaagacagtcacaccagtagtttagggaaggattatagctgattgcattttttttttttttttgagatggagtttcactcttgttgcccaggctggagtgcaatggcgcgatctcggctcacctcaatctccgcctcccgggttcaagcgattctcctgcctcagccccctgagtaggtgggactacaggcatgcaccaccacacccagctaattttgtttttttttagtagagatggggtctctccacgttggtcaggctggtctcgaactcctgacctcaggtgatcctcctgccttggcctcccaaattgctgggattacaggagccaggcctacacgtggtttttaagggccagcaaattatatgtatgcacacacctcagtttggaaggagaatgactgagtaccagtgggataccaggagagcccaggaagaaggcagcgtatcccttcacaagcccctttccatgacttttctacatgactccagcaagactatgctggggaggaggaggagacacagggcctcgcctgagtatgggtgctgacttggtgcaagaagagaagggtaggcatcgtctcctggtggccattcccaccctggaatggctccaacccaatggagcggagctctagtggttccagccactggaaacaccagacgtagcacaacaataatgaactgttgttggacggccatctactccagatgtcccatcactgggcagctgtccactggggccaagtcatcactggatggccgtccacttcggctgcaccatgttcctggcctacagcagcatggaacacgccactgctgggatgacaccagggattccctcagcttagagagcaggtgctcacagacaggggtcatggacagcaatcactacccacagcctccactccctgcccatccatcttttttgtttttgtttttgagatggaatctcgctctgtcagccaggctggagtgcagtggcgcaatctcggctcactggaacctctgtctcccgggttcacaccattctcctgcctcagcctcccgaatagctgggaccacaggcacccaccaccacgcctggctaacttttgtatttttagtagagatggggtttccccatattggccaggctggtctcgaactcctgaccttgtggtctgcccgcctcagcctcccaaagtgctgggactacaggtgtaagccactgcgctcggcctctgtccgtccatcttaagcagctgaagaactgaacggataaaacaaagccctcaaaaccacagacacgtgtgtccatgtctgaggtccacggggcaaggaggaaaaaagaaccaactcacgcatcctccaggggtgaagactgggcattaaaataaatgcccgtatggagggaaaatatccatcttgggactcatgggaaaaacaggcaaacacaaaaaacaggaaagtaatattccataaaaaagaaatgaagagcatcagttgaaatgaagatttatgtggggcgaggcagaaggacctgagaccactaatccttcactatctcaattatagcaagaaataggttggaaggaaaacacaaatatacagcctataaaagatacccacagaggagtaattcaggtggaacataaaagagatttaaaggtaaatagaaacgaaaagaaagtcagagtcaaaatattatcaggccgggcacaatggctcgcacctggaatccctgcattttgcgaagccgaggacgacggattgcttgagctcaggagtttgagactagcctgagcaacatagtgagagcctgtttctacaaaaaatacaaaaattagctatgcgttgtggcgcatgcctgtagtcccagctactcgggaggctgaggtgggacgatgtcttcagcctgggacgcaaaggttgcagtgaaccaagatggtgccactgcactcctgcctgggtgacaagagcgagaccccatctaaaaaaaaaaaaaaaaaaaaaaaaaaaaaaaaaagactatcattacttttaatggcaaaaacagcaattacttttgcaccaacctaatatattcatatcagataaaaaataataaattcagagcacaaaaatattaaacgtttaacaaaagggttaatgcggtaacataataagaagggtgccggaaacgagtaggagatataacatcacatcctagagaagcccggacaatagtagacagagggaagatcaaaatcaagaatgaggagactcagctgggtatggtggctcaccctgtaatcccagtactttgggaggttgaggtgggcagatcatctaaagtcgggagtttgagaccacccaggccaacatggtaaaaccccatctctactaaaaatacaaaatgtagccaggtgtggtggcaggtatatgtagttccagctactcgggaggctaaggcaggagaatcacttgaacccaggaggtggagtttgcagtgagccgagattgcgccattgcactccaccctgggcaacaagtgcgagactccgtctcaaaaaaaaaaaaaaaaatacaataattagccgggtctggtggtgtgcacctgtaatcccagcactttgggaggccgaggcaggcagatcaactgaagtcgggagttcgagaccaggcaggccaacatggtgaaacactgtcatactaaaaatacaaaatacagctgggtgtggtggtgggcacctgtaatcccagctactcacgaggctgaggcaggagaattgcttcaacccaggaggcagaggttgcagtgagccgtgatcgtgccactgcactccagcctgggtgacaaagcaagactctgtctcaaaaaaagaaaaaaaatgaatgtggagaatcatgtcaggggtgcagagggcaggcttgtggaagcgtgtagaatgtagaagaaaaagatgatgacatgaagtgattggagaaaagaacatgaaagagaaggaaaccagttgagaggcaacatccaatgttggtatctctgaagacaagaactgggagaaagagacacagaaacatagttgatccttcacaggtttggactgtacaggtcagttatatgtggattttcttctgcctctgccacccctgagaaagccagaccaacctccctcttcctccttctcctcctcagcctcctccatgtgaagatgatgaggatgaagacctcggggatgatccctttccatttgatgaatagtaaatgtagtttctctttctcatgattctcttggtaacgttttcttttctctagcttactttagtctaagcataaagtatgcaatacatagaacatagaaaatatgaatgagtgaatcacctgtttatgttattggcaagggttcctgtaaacagtaggctattaataattaagtttttggagaatcaaaaggtgcacatgggccaggcgtaggggctcacatctgtaatcccagcactttgggaggccaaagtgggtggatcacctgaggtcacaagttcaagaccagcctgaccaagatggtaaaaccccgtctctactgaaaatacaaaaattagccaggcatggtggcgtgcgcctgtaatgccagctactcaggaggctgaggcaggagaatcgcttgaacccaggaggcggagattgcagtgagctaagatcacaccattgcactctggcctgggcagtaacagtgaaactctgtctcgaaaaagaaaaaaaaagttacacatggatttttgactgtgtgaggggttggtgtccctaacccccatgtttttcaagggtcaattgtaaatggaaaggtttcgtgcaaagaaaaaaaaaatccctgagataaaaacccagatctgccattataagatgtatagtaagccatacgatttatttttaaatgcccatatgtccatcaacctcatcctgatgaaaccgtggagctttaaagatcaagagaaaatcctaaaagcatcaagggaggaacaaaaaggacatctgccaatggaaaagcaaatcaggtggaaagagctcttcgtcaatgtgagatttcagtaaggaataaagaaagagctacagagtcctgaatgacaaaggatctgaacaaataaccctagacccgatatgggaaaacgagatttgtctcaaacactttgggactcaggaaattaaaaaaaaaaaaaaaaaaaagaatcattgcttgtttctctaaaactgtgcccagacacacacacacactacagcaagctaagatttccaggcaaatcactaagccattcatagggaaagacaggcactgtgtgtcagatcaaggattcacctacataacggtggttatgaaatggaaaatagagaaacacatgtacatcactggggtgtggctaccatagtcaaaacagggtaactcttgagaaaaacatcctctctacaaaacgcttattttaaaaaactaattagagattgggacaaaaagaatcctcaaaacagcaatcagaatcaagtgatagcatgtggtggatggctagggttatgctactttgtcttcaaaaggcagaacctgttgttctaatttaatttctgaagttactcagttgagaaacggagttagctaacacttggtttaaagttacgaaagtttcaaagagcttctgcacagcccaggaaactatcaacagcgtgaacagacaacctacagaatgagagaaagtatctgccaactatgcatctgataaaggtttaatatccagaatttataaggaacttaaacaaatttacaaaacaaaacaaaaataaaaacaaaaaaaatcccattgaaagcacaccctttgccacgtcaggcaaaggacatgaacagacacttttcaaaagaagatacacatgcagctggccgggcgcggtggctcacacctgtcatcccagcactttgggaggccgaggcgggtggatcacaaggtcaggagatcaagaccatcctggctaacacggtgaaaccctgcctctactaagaatacaaaaaaaattagccaggcatggtggcggggttgagggcttgatatgtgggaggcatattactaaacaatttgattaccttgtttaacctttacaacattcttttgaggtagatcttactattcttcccatttcatagacgaggaaaatgaggcttagagaagttaactaaattgcacaatattccttagttagtaaatggcgaatttaaatccagtttggaaagacagatgtgctttgcttatgcataccttgatttctgaaaaagtgcatgtaactaaagtcaaaaaccaaagctacttgcgaggctgaggcaggagaatggcgtgaacccggggagcagaggttgcagtgagccgagatcgcgccaccgcactccagcctgggcgacagagtgagactctgtctcggaaaaaaaaaaaaaaaagacatacatccagccgacaagcctatgcaaaaacattcaacatcactgctcattagagacacgcaaatcaaaaccagaatgagataccatctcacaccagtcataaaggctattactaaaacatcaaaaaacaacagatgctggcaaggtggcagacaaaaaggaacacctaaacactgttggcgggagtgtaaattagttccaacattgtgtaagacagtgtggccattcctcaaagacctaaaaacagaaatatcattccactcagcaatcccatgcctgggtatatacccaaaggaacatcaatcattctgtcataaagacacatgcacgtgtatgttcgtggcagcacctttcacaatagcaaagacatgggatcaatctgaatgcccatcagtggtagacagaataaagaaaatatggtacataggccaggtgcggtggctcacgcctgtaattccagcactttgggaggccaaggcgggtggatcgcgaggtcaggagttcgagaccagtctggccaacacatggtgaaaccccgtctctactaaaaatacaaaaaaattagctgggcgtgggggcgtgcacctgtaatcccagctacttgggaggctgaggcagaggaattttcaagggtgcagtgagctgaggcagaggaattttcaagggtactgcactccagcagcctgggtgacacagcgagactccatatcaaaaaaaaagaaagaaagaaaaagaaaatatggtacatagacaccatggaatactatgcagccataaataagaacaagatcatgtcctttgcagaaacatggatggagctggaggcgattatcctcagcaaactatgtaggaacagcaaaaccaaattactacatgttctcacttataagtgagagctaaatgatgagaacatatggacacagagaggggaatagcattcattgaggcctatcagaaggtgggaggagggacaggatcaggaaaataactaatgggtactgggcttaatacctgggtgatgaaataatcatacaacaaacccccatgacacgagtttacctatgtaacaaacctgcacctgtatccctgaacttaaaaatggtttttaaaaattatggaagtttgaactataagaatcaaaatttccagaaggttggggtgatgaggcatgaagcttccctgagtgcaaaagaactcaccattgccacccacggcaaaaagaaaagtgacatagaagcaaaaaaaaagatacaaagcatagtaacatttattcaacatctcattaaacatttcgcaagagtgaaggatagactatgcaagagggttataatggggccaggcgtggtggctcacgcctgtaatcccagcactttgggaggccaaggtgggcggatcacgagggcaggagttcaagaccagcctgaccaacatggtgaaaccctgtctctactaaaaatacaaaaatgagccaggtgtggtggtgcgtgcctgtaatcccagctacttgggaggctgaggcaggagaatcgcttgaacccgggaggcggagattgcagtgagccaagatcgcgccactgcactccagcctgggcaacagagtgagactctgtttcaacaacaacaacaaaaaaatacacatcacccaccatttcttgggtatcaacatccacctctggaatgactgaagggttattaatctaggatggtaatggagccaggttatcgccaagtttggtaagaacatccttgcctttgtcactcactgctctcttggtggagttggtaccgagacacggcccgatgtgggcagatgcttagacagggaacatggcttcctcttcctggaatggcaagaacttcgaattctgccccctctctgccaacgttagatatgtcacggttgaatgactaaacaccaaatacatatccggagcgagaaatggcatgatgctttcagaggaaggatggagctggaatttggggaatgaggaaatggcttttccctctttgtgtgtttagtgatgataagagcaatcagttctgacagctcctactggctgctacctactggctggctggagcgttggctttggttagagaaaatggaacatttcaagaggagacactttccatacacattatcataaaagtttgtttgtgagatggagttttcactctgtcgccaggctggagtgcagtggtgcgatctcggctcactgcaacctccacctcccgggttcaagcgattctcctgcctcagcctcctgagtagctgggactacaggcgcccaccaccacacccaatttttgtatttttagtagagatgggatttcaccatgttggtcaggctagtctcaaactcctgacttcgtgatacacctgcctcagcctcccaaagtgccaggattacaggtgtgagctaccgcacccagctcaataaaagtttttaaaatgttatcagtaatgctataatgatcatcataacttatggtaggtacaaactatagaatccacaactgcttaccaaggtcttataaagacctaaatctgtggtttattgaggttctttgaaacccctcaattttcttcttggtattaatgattgaatttttaatggtggggcagaatctgcccaagtattagagggacaaagaaggatacagagagctggagttccatcagttcagcctggttaatgtgtcgtttctgagcacacagcaagccctaccctgtttatgtggtaaggtctcactcctatacagaacatggcatgattcaaattctaaaaagaagatgtctggataagcacttttgattgactgtctgattagaggtacttttaatggaataggcagaaaatgcaaatatctaatgaacatgctggagaggttcaccatcggcaagcatttcattttcttttcttcaaaaattaattacagagtgtggctgcgtttctgtggattcagtgtttctaattctttcttcaattagtcctttaattttcttcccaaggagacacatggatatacaacacgtaacacagtgacattttcttgtcactgaaagaaatttcaaagttcattttcaaattcaaagaaaaggaaggctggagtggattggaaaagaggctacaggctaagaacttttaagagccctagagagagtggggtgctggtgtcactgttatttcattgattttccttgtccacagccattttcaagactcatatttcagggccttagatggtttgtctcatatcactgctgtctgtagcaacaaccactctgtagaaggctcccagggaaagacccataaggtctaccttgtttttgtttgtttgtttttgaaacacagagtctcactctgttgaccaggttggaatgcagtggtgtgatcttggctcactgcaacctccgcctcccgggttcaagcaattcttctgcctcagcctcccaagtagctgggattacaggcgcccaccaccatatgccactaatttttgtatttttagtagagatggggtttcaccatgttggccagactggcctcgaaatcctgacctcgtgatccgcccaccacagcctcccaaagtgctaggattgccggcataagccaccatgcctggccaggtctgccttataagtgatatgagcataggtggaggagttgaacactggagaaggatggatcaataactccacccaaccacaggtgctcccatttctgggtgtctaatcccaacccttgagatcatgccgccattttatcaccgttctatggtatcatgccgccattttatcaccgttctatggtatcatgccgccattttatcaccgttctatggtatcatgcctccattttatcaccgttctatggtatcatgccgccattttatcaccgttctatgatatcatgccgccattttatcaccgttctatggtatcatgccaccattttatcaccgttctatggtatcatgccattttatcaccgttctatggtatcatgccgccattttatcaccgttctatgatatcatgccgccattttatcaccgttctatggtatcatgccgccattttatcaccgttctatggtatcatgccattttatcaccgttctatggtatcatgccgccattttatcaccgttctatggtatcatgccgccattttatcaccgttctatggtatcatgccgccattttatcaccgttctatggtatcatgccgccattttatcaccgttctatggtatcatgccattttatcacctttctatggtatcatgctgccattttatcaccgttctatggtatcatgccattttatcaccgttctatggtatcatgcctccattttatcactgttctatatcatgcctccattttatcactgttctatggtgtcatgccgccattttatcactgttctatggtatcatgccgccattttatcactgttctatggtaacatgcctccattttatcactgttctatggtatcatgccgccattttatcaccgttctatggtatcatgcctccattttatcaccgttctatgatatcatgccgccattttatcactgttctatggtatcatgctgccatttcatcactgttctatggtatcatgcctccattttatcactgttctatggtatcatgccgccattttatcaccgttctatggtatcatgctgccattttatcaccgttctatggtatcatgcctccattttatcaccgttctatggtatcatgcttccattttatcaccgttctatgatatcatgctgccattttatcaccgttctatggtatcatgctgccatttcatcactgttctacgaataataacacatcagcatcgaaggagatgagggaacatgcatgatggagctgtgggagaagaatccccgccacaaaaccggcccaggatcctgggcacagagatatttccacactcaacacacagggactgaggtgaaaggagacggctgggtgggatggaggagataagggaggagacccctgatccacacagcacagccatgtttggaggggaatcataatgctacgtaggatgtctaagctctcctcaagatgcgaggctgggagtccctttccagagcctcagagagcatactggtcttaggtccaggttactgccattgaatggtagtaggcacatccccacagaactgggctggcatctgtagggatctacatcagtggttttccattggaggcctttttgtttccccctcccccaggaacatatagaaatgtctggaggtatttttggttgttataactgcggtggggggtatagtgggtacatccatgtcaagtgggtggagcccagggatcctgctcaacacgctacagtccacagcatggcctcaccacagagaatcatccagctccagatggacatactgccaaggttgacaaagcctgccttagcatgacagattgtatgcatatgtgatccatttgtctgtgtgcctatcatccaactcacttcctatcatctatcacctaccatttatctatcaactatttatagaatatctatcgacctatttaccacctatcacctacttatctaccgtctatcatttatctatttaccatttacaatcaagcatctacttatctatctaccatcatttatctatttaccatttatcatctatcatctacttatctaccatcatttatctatttaccatttattatctatcaagtacatatttatctatcatttatctatctttgatcattatatagcatctgtttactctctatctactgtctatcatctacctatcatctattgaccatcgatcatttatctacctgtcatctattacctatcattgatcacaatctatcattgaccattactatctatctagctattatctatctagctattttctgtctaactaatatctatctatgtatccatcatctatctatatcacagtggttttcaactgagcaaaatttcgcctcctcagggacaactggcatatctatctatctatctatctgtctgtcatttcctcatttatgaaattggggtaataacaatgcctgcctcaaaaattgacaaatgagatctcattaaactaaagagcttctgcacagcaaaagaaactatcatcagagcaaacaggtaacctacagaatgggagaaaatttttgcaatctattcatctgacaaaggtctaatgtccagaatctacaaggaacttaaataaattctcctgcctcagcctccctggtagctgtgactacaggcagccaccaccacgcctggctgatttttgtatttttagtagaggcagggtttcaccatgttggccaggctggtctcgaactcctgaccacaaatgatccacccatctcggcctcccaaagtgctgggattacaggtgtgagccaccgtgcctggccaggttttggcctttttgatgccactttgctttgacctttacttctttctcctgtatgcctagagagttcatcctaagagcttgtcctcatatcacctcccagaatatgcaaacttacaatctctttacttcttaaaattttaccttggggctaccaagctctgaagatggaagtgagatttcctcaaaatacacagaaatgggtaaatcctcacatgctttcacaggtatgcagtctttaacctgaggtagctcagggatacctatggctcccaggatactccaccatagcaaagggtgactgcctttggtgagccttgggtggatactagagctctgtgaacaccggggcctgtcgggaggtggggggcaaggggagggagagcattaggacaaatacctaatgcatgctgggcttaaaacctagatgacgggttgataggtgtagcaaaccaccatggcacatgtatacatatgaactagttctaggaacagttcactgaacactagcgttctatgaaccccctctccctgcctgaaatgaatgctgtcttcacatgacatcctaccctctgcccaatgtctttcccgaatgggaatctcttcaccacacggccaatttatcacaaacccttctctaaacccttacaataggcaggaaactgctcatacccctacgacggctgatggcagaggataaaatattaattctaagaaaataggccgggtgtggtggcacacacctttaatcccagcactttgggaggccgaggcaggtggatcatctgaggtcaggaatttgagaccagcctggccaacctagtaaaaccccatctctactaaaaatacaaaactagccaggagtggttgggcatggctgtaatcccagctactcgggaggctgacacagaagaattacttgaacccagaggtggaggctacggtgagccgagaccacgccactgcactccagcctgggcaacaagagcgaaactcagtctcaaaaaaaaaaagaaaagaaaagaaaaagaaaatagttcaggtaattcttggaaattgtatttttataccctctaatatttaaatgaccatcaatatacaaccagggtagggggttaataaataaaggatagcattctttgctgcatcctgggcttatttttctcattctttttctgtgacactgtctcattccatcagccaggctgaagagcagtggagcagtcacagctcactgcagcctccacctcctgggctcaagcaatcctcctgcctcagcatcttgagagggagaccagaagcatatgccatcatacccggataattttttttttttttcctgtagagacgagatcttgctatgttgcccaggctagtctcaaattcctgggctcaagtgatgctcccgccttggcctcccaaaagtgctgggattacaggcaggagccaccatggatcattcgtgtgtacaatattctcactcctttgcaccggaataaaacccagccccctggaaagctgactctgagactttgtgaggatgtgtatgtgcggtttctcatctgaatgcagccatttcacgaacaccagccattccccaggcttcagttaagccattccccatcaggaagatatagggccccctttcaagaggaaccacaatggctaaaactacaatcttcacagcacacatggcttcagcaaatacagagagatgctagccgggcgcagtggctcacacctataatcccagcactttgggaggctgaggtgggcggatcacaaagtcaggagttcaagaccagcctgaccaacatggtgaaatcccgtctctactaaaaatacaaaaattagccacgcgtggtggtaggtgcctgtaatcccagcaactcaggaggctgaggcaagagaatcgcttgaacctgggaggcagaggatgcagtgagccaagcttgtgccactgcactccagcctgggagatagagcaagactgtctcaaaaaaaaaaagaaaaaagaaaaaaaaaaaagaacgatgctacattctcagaaaattagttttacattgaagcttcatttgggaattgaaaataagaacagggaaatacatttttcttttctagagaaaataaacaaggacaaagatgcatggaaaataatattttaaatgtctcctattgacctaagttataaagtcattttttatgtaataacaaaataattggagaggcgtacccaagagcacaatagtctctgaaatgtcttatttcatgtacactcaggcacacaaagacacatacataatttataactaatttagcaaaacattatgatttgatacaactggatggtgggtacacaaatgctgttcaaattattctctgcgtctttcaaatgtgtgaaatgttttataatgaaacatttttagaaggcacattgaagttcaaacaactgctaaacaatgaaaaagataaatggttgtattcaaatgcttacgggtatttactcattaagaatattttgaggccaggcacggaggctcacacctgtaatcccagcactttgggaggccgaggagggtggatcacttgaggtcaggagttcaagaccagcctggccaacatgtcaaaaccccatctctactaaaaatacaaaaattagccgggcgtggtgccgtgtgcctgtaatcccagctactcaggaggctgaggcaggagaatcacttgaacctgggaggcagaggttgcagtgagccaagattgtggcactgaactccagcctgggcaacagaataagactctgtctcaaaaaaaaaaaaaagaaaaaaggtctcctattgacccatgttataaagtcattttttatgtaataacaaaataattggagaggggtacccaagtcacatacgtaatttataactaatttggcaaaacattacgatttgatacaactggatggtgggtacacaaatgctgttcaaattattctctgcgtctttcaaatgtgtgaaatgttttataatgaaacatttttatgaggcacattgaagttcaaacaattgctaaacaacaaaaaacataaatggttgtattcaaatgcttacgggtatttactcattaagaatattttgaggccaggcgcggaagctcacgcctgtaatcccagcagtttgggaggccaaggagggcggatcacttgaggtcaggagttcaagaccagcctggccaacatgtcaaaaccccgtctctactaaaaatacaaaaattagccaggcatggtgacaggtgcctgtaatcccagctactcaggaggctgaggcaggagaatcacttgaacctgggaggcggaggttgcagtgagccaagattgtgccactgaactccagcctgggcaacagaacaagactctgtctcaaaaaaataaataacccgggaggtggagcttgcagtgagccgagatcgcaccactgcactccagcctgggcgaaagagcaagactccatctcaaataaataaataaaagtaaataagtaaataaaaaagaatattttgaaactacacattgccttctgtgtaaattaaaagccaatgaaagcctcctgattttcagggtgtctcatttctaccctatagaagcaaacctaccacacccttcactgaggagccttcgtgaccctaccaagggggaaagagcttgtcttttcaatgagtttaagagctttgcttctgcggttgaaacttccccccagccagcatttcatgttgagagacagtggctaagctgatgtggaaataacacaagaaatcttgtctgaagatgggtgataccaacatcagaactggagacagcaggtactgtgattcaggcgaaactctcaccactaattggtggagagaagaaaagaaaatgagcaaatgaactctgattttgaagaacttcattgaatcaggcttatcttgatgtcttgtgagtcaacaagatgcagctggactagatgtgtgtgtggagtattcgtgaggggctaagggactctcctatgtgtttagtttttgtttttttttgtttgtttttctttttggagacagagtctcgccctgtcacccaggctggagtgcagtggcacgatctcagctcactgcaacctccatctcccaggttcaaacgattcccctgcctcagcctcctaagtagctgggactacaggctcacaccaccaaaattagccggggctaattttttctatttttagtagagacggggtttcaccatgttggccaggctggtctcgaacacctgacctcaagtaatccacccacttcggcctccccaagtgctgggattacaggcctaagccacagcacccagccccagctattttttgtattttagtagagacgggtttcaccatgttggtcaggctggtctcaaactcctgacatcaagtgatctgcccgccttagccttccaaagtgctgggattacaggcatgagcccctgtgcccggcccggactcccctactgaaatgtgcatgacagagaccccaaggctgtcttttccagcaggagctccgggttcatgactgaggatagatgcttcccaacctgctcctcactctccaaagagcttgcaagtgggcacagatgaaccaagctcaccttcctgacaatgacacctgcagatggcacaccatgagttttgtctacaaatgcaccattcccccagtttgaggagtcccagttcgtctttttttttgaaacagagtctcactctgtctcccaggctggagtgcagtggcgcaatctcggctcactgcaacctccgcctcctgggttcaagcgattctcctgcctcagcctccccagtagctgggattacaggcacccgccaccatgcccggctaatttttgtagttttagtagagatggggtttcaccatgttggtcaggctggtctcaaagtcctgacctcaggtgatccacccgcctcggcatcccaaagtgctgggatgacagtctgagccaccgcgcccagctgagggctttgtattttacggagacacaatcagtccatcattccacacaactgtgctgttgggaatctgtgaaggttaagaattccccactgcctttgtcttccagaaaatggttttactgaaaaaaaaaaaaaaaaaattcccttcctcattactcacagatgcttccaagtcagcctaggacaaggctggccacatcctccaaattcacattctttatttgccccttcagggatggactgaattcctcgtcttccttgacctgaacaaaattcccatctaacgtgatcacattttggttgggtttctctcctcctatcaggccccgggatgttgggccagcctcacctggagcaaacgtcagaggatcaagcaacgcttccttaggacctgctcaaaattagctatgcagccacagggtttggcagcttttatccatgactgaaccccacatcgaacgaccccaatcacggttgttccgagcatcacgtgcctgtccctagaaaagaaaatggtatgctgcctgcgctccaagaggctcccagatgtcactgctcgggtgtgcttcatggtgctataggcagcgtccaccagtggttgcattagtccctcctcctcttgttacaatagttcctcccctattaccataatccctccccgccattaccatagtcccccctcctccattaccgtagtccctccttccgttaccatagaccctcctccgttaccacagtcccttctcccgttaccgtagtccctccccattaccatagtccctcctccattaccatagacccttctacttctgttaccatagtccctcctccattaccatagaccctcctcccgttactatagtccctccttccgttaccatagtccctcctcccattactatagaccctccgttaccacagtccccccttctcacattaccatagtccctccttctgttaccacagaccctcctttcgttactatagtccctcctcgttaccatagaccctcctcctcccgttaccgtagaccctccccgttaccacagcccctcctccgttaccatagtccgtccttctgttaccatagtccctccttccattaccatagtacctcctcccattagcagagtccctccttctgttaccagtccttcctcctcccgttaccatagtccacactcctccccttaccatagtccctcctcctcccattatcaccgcccctcctcctcccattatcacagcccctcctcctcccattatcacagcccctcctcctcccattacagtagtccctcctcctcttattgcaaaagctcccatctgtgggaatgatcttttcaaatgaaactgttgctacctgtgtatctggtgtctctgtcaccatcatgggacatccctgaaaggtgtacctcactgctgcagagtagcactctctgcaggaaagtccatatcttccctgccccagacaactgtgctgtccacagctggacactgggcgcttgccagacagttagtgcaatgaggcactgagtttttcttttcccttaattatcacttatttaattttcgcgcatcacacgtgacccctgacccctgttctgggcaccatcgtcggagaaattttcttgaggctcgggtttcttctttctttgctacaaactcccagggctacttactaaggtgaagaaaacacactgttatgtaatccattatacagtcaacgtatccttaccagaaccagaaaaattcacaattttaatggtgaatcgggttgggaaatccatgcttctagttttgaggcgaaatacatgactgataaaacccttttgtattatacaagggaaccggagtggatggagttttgctatagatctcccagacgcgccccacagctccatgattgacagcgtgagtgtgtctatcacacgaaccgctgggggaaggcaggcagttgtgtcaaattggaaccgaatcacaaatgaaacataaattccaggatcccgttgagtataaaaacccaggacccaacaagggcaaacgtaagcagcgaagccccagagaccccctagagcatccagcatgttggggttttaggtttgaaagggagaggttggtatttcttttcttttccttctttgtttttttttttttgagacggagttttcctcttgttgcccaggctggagtgcaatggcgcaacctcggctcactgcaacctccgcctcccgggttcaagcgatgctcctgcctcagcctcccgagtagctgggattacaggcacccgccaccctgcccggctaattttttgtatttttagtagagagacggggtttcatcatgttggcgaggctggtctcgaacccctaacctcaggtgatccgccggtctcggcctcccaaagtgctgggattacaggcgtcagccaccgcgcctggctgggggttggtatttcttgtggctcataaaccgcggctctactttgcatctgtattagttcattctcacgctgctgatagacatacccgagacggggtaatttataaagaaaaagagctttaatggactcacagttccacggggttggggaggcctcacaatcacgacggaagacgaaaaccatatcttccacggcggcaggcaaaatggctcctgtaggggaacttccatttataaaacatcagatctcgtgagaacacactcactaccacgagaacagtatgcgggtcaccgcgcccatgattcaatttcctccacctggccccacccttcacaggtgggaatcattacaattccaggtgccatgtgggtggggacacagccatcccatcgttacagagattgttgcaagtttgccagaatcctcacactcttttcagaggagacctttcaaaagaaacatcatctagggaagctatgctgtgttctgaggcgaggctggaatttcaaaaccagcttttccactaaaacacctgctccatttcctctggggcctccattctccccacgccagaattagggggtctctagtcccccagctctaatgctttccaagcaggataaccctctacatcccatggaaaccacggctgctgcaaggaagagctgagggactgcagtgccgctgaaccgagtcaccctggagttataaattatcaggttggagaaaaggggaaggggttgttgtatctggagctgaagttttcagggctgagctgccaacgtgtgatacttcaagggcccctgcgtacctgacgcggtgtggacagttcgcacccacatagagtttgcaagccaacaggaaacctaggcaggcttcctggaggaggcatcatccggccaggaaatagaggtgagatgttgacagcaggagatggtgagaaaggaacccaggaggagggttatccaaaatagggcacacaggtgagagagtgggggaagaggaagccacaggaaggaagaaaaaaggtcaatgatattgtgacgtaaagtaagttcctgtagcatcttagcatagcaagtttgagaaacagtcgtgcatggaatgaggacaaaaaaagacctctgcacctgcacacctgccctctactcacctgtccagcccaggcaatggcctaccaccctcatgtgattagtattgttctaaagaaatggagtctcactatgttgcccagtctgatctcaaactcctgggctcatatgatccttctgtctcagcctctggaattgctgggactacacaggcatgccaccgtgcctggctgatttggattcttgacagaagagttggctctgaaataccaacatgtggttctgtttaaaaacaaaggcttctcaaaacagaccacagtgaggccaggctcagggctgtaatcccagcactttgggaggccgtggtgggaagattccttgagctcaggagttcaagaccacccagggcaacatagtgagaccccatccaaaaaataaaaatagctgggtgagcagccgggcacagtgactcacgcctgtaatcccagcactttgggaggccgaggcaggcaaatcacctgaggtcgggagttcgaggccagcctgaccaacatggagaaaccccatctctactaaaaatacaaaaattagccaggcatagtggtacatgcctgtaatcccagctacttgggaggctaaggcaggagaattgctggaacccgggaggcggaggttgcagtgagccgagatcacgccattgcactctagcccgggtgacaacagcgagactccatctcaaaaaaaccaaaaaacaaaaaacgaaaaacaaagtcttctcgaaacagaccacagcaaggccaggttcagtcctgtaatcccagcactttgggaggccgtggtggaaggatcccttgagccctggagttcaagaccacccagggcaagatagtgagaccctgtctctataaaaaataaaaatagctgggtgttggtggcatgtatgtgtagtctcagctacataggaggctgaggtgggaggatcgcttgagtccaagaggtagaggctgcagtgagccagatagcaccactacactccagcctgggcaacagagcaagaacctgcctctaaaacagaaacataaataaacaaaaatgaaaataaactatcctgcattcttcagacaacactgtgactacaggacaagcggtcacgctgtcatggaaggatggagcccatctcaaagggaatttctggagtgcagaaagcaaccacatcaggtgggaatacgccctcccagtcagcaggtgcgttctcaaatctccagcgggtaattagtgcacatcacacaatgaatgagcttccgataagtgaaagtatggtatgcacaccgcggctgtgaaatgcggttcgttcttggatatcatgggcagcattgaaaacttaaacctttttcttcttgtggaaaaggctggggcttgtcatcactgtctcctcccttcccctcgcagtttatatttagctgggcacacgccgtgtggatgcccgttttcttcctcctaggggagaatcctcagctacagggttgttttggtttccttgtgtgtttgtttcttgatttattctctcttgagtcagcaagagaacggctcgatgggatggttggttggttggtcggttggttggttggttggctggttggttggtttttgagacagagtctcactctgtcgccaagctggagggcagtagtgcgatctcggctcactgcaacgtccgcctcctaggttcaagtgattctcctgcctcagcctcctcagtagctacgactacaggcgtgcacccccacgcctggctaatttttgtatttttagtagagacggggtttcaccatgttggccaagctggtctcgatctcctgacctcgtgatccacctgcctcggcctcccaaagtgctgggatgacaggctggagccactgcacccggccggctcagtgggttttaggagcatcccagcattccccggacacaaaatgtgcctctctgtgatttttactaactcgcctggagtcaccaatgttgttgccatattttgaccaaaacagtaataaaaggggcaattttcctaggggctcttgttctggtagaagaacaacttcccgctgcctgcattgcaggtgcctctgactcaggaggaaacgcagaatttggcgaacacgtgaagtcttttttcgctaaatctaaattctacagggtggctggggccaattgcagtacggatctgaggcattgtagatggcaagagtgcatgtgtgcgtgtgtgtatgtgtctgagtgtgcatgtatgtctacacttgccataaacgaaagcacaaaagggaaatgtcagaaagaaaccagcaaaggaagccagcatcattcacaatgctggtgtctgttacccacagaggatgacatcgtcattcaggtggccatgaagaaaggctttgaatgacactcccagaacaagagcctggagatctaacatccactctgattctgcccctagccttgggtgacgtgggtttaactgtgacctcaccaagatgtgtccacccagaacctaggaatgaaagctcacttggatatcagatctttgcatacaattaggttgcactagagtagtgtcattgcatacaactaggttgtcattgcatacaattaggttgcattagagtagtgtacgctgttaactgaataactggtgtccttataagaaaaggaacattggaggccgggtatagtggctcacgcctgtcatcccagcactttgggaggctgaggcaggcagatcttgaggtcaggagactgagaccatcctgcccaacatggtgaaaccctgtctctactaaaaatacaaaaattagccgggcacggtggtgcacacctgtagtcccagctactcaggaggctaaggcaggagaatcacttgaacccgggaggcagaagttgcagtgagccgagatcacaccactgcactccagcctgggtgacaagagcaaaaactctatctcaaaaaaaaaaaaggagaagaggaacactgtggcatagagacacagagatggccacgacaaaggcagatactgtattgatgcttctacaccagccgtccccagcctttctggcacagagactagtttcatggaacacaatttttccacacacacacaaaaactgtcttcatagaaagacagtcactgtgagtgcagggggaaggatctggggatgatttgagcgtatgacatttattgtgcactttatttctatgatgatacgttaaatgaagtaattctacaatacaactcattgccatgtagactcagtgggagccccaaacttgttttcctgcaactagatggtcccatccggggggtgatgggagacagtggcagatcatcaggcattagattctcataagaagcatgcaacccagatccctggtctgcccacttcccaatagggttctcaatcttctgataatctaatgccactgctgatctgacaggaggtgacctcaggcggtaatgcgtgcagtgggaagtggctgtgaacacacatgaagctttgctcagtaccagtccacagccagggggttggagtcctctgttctacaggacaagaaacaaccaggattgctagctagcgaaggaagccagaagagatagcggaggatcctcctccagagcctccgcaaggggcacagccctgccttaatactccagaatgaaatgcatttcataattgcagtgtgcacacaatactttttttttttttttgagacagagtcttgctctgtcgccaggctggagtgcagtggcatgatctcagctcactgcaacctccgcctcccgggttcaagtgattctcctgcctcagcctcctgagtagctgggactacaggtgcgtgccaccacacccggctaattttttgtatgtttagtagagatggagtttcaccatgttggccaggatggcctcgatctcttgacctcgtgatccgcctgcctcggcctcccaaagtgctgggataacaggcatgagccactgcgcccggccgtgtgcacacaatacttcaacttactgaacgcttattctttgtgtctggtgcaatagtgacctgctggagatttgcaaatatacttagtgactggaaggttgtatttccacccggatgtgttggctttctgctccaggaatgtcctttgacacgggctctgcccttggatgaccaggtggtcagcctgccttggctgtggacttctggtgttcagagctgtcagagatttgacttctgtggctttcagccagctggtttgtagaattgtgtcgcagcagctccaggaaactaaaatattgagcctcccctatgacagtggacccttgaacaccacgggcttgaattgaatgggtgtccccttatatgtggattttcttctgcctctgccacccgagacacccccttctcttcctcctcctcctcaacgtcaagatgacgaggatgaagacatttatcatgagccacttccacctgataaacagtaaagatattttctcatccttacgattttcttaaggaaaatcacagcttactttattgtaagaatataatatagaatatttactatatttttctctaggttacttcattgtaagaatatagtatataatacatactatatttttttctcttgattaattttttttttgagacagagttgtgctcttgtcacccaggctggagtgcagtggtgcgatctcggctcactgcaacctccacctcccaggttcaagtgattctcctacctcagccccccgagtagctgggattgcaggtgcgcaccaccacgcctggctacttttttgtatttttagtacagacggggtagccccatgatggtcaggctggtcacgaactcccaacctcaggtgattcgcctgcctcaacctcccaaagtgttaggattacaggcgtgagccaccgcgcccggcctttggcttactttattgtaagaatattactatattatttgtgtctggtgcaataatgacctgcctcatgatctgtcactgtctcccattacccctagatgggaccgtctagttgcaggaaaggcttccagccaacagcaagctattagttaagttttgggggagtgaagagttacacaaggtcttcacgtgcccctaaccctcacgtggcttcagagtcccctgtaaatgaatgtgtggcaagcaaagaaagaagaacatgaagaaaagagggagaggaataccctaccactacacaagaccatatatcaccaacaccattaattcttccttctacatgataagccggcaaagtccctgtccttgataactgtgccaatgacgtctgattcccagtagatggatgatgactaattagtcctacatggcaaacaaacgaagggttaattaatctgagcctgcctgagttatctgtgaatgaggatagcccagtcacttgacaatcattttaaacaggtcaacggatgatcaatcacgactgaaattcccccgtaaaagacgtgtccactcaactggaatttatttctaggaagaaaatgagcgacctgtgggctggcagtggaggttttttttttttttttttttttttaatgatgctgctgtttcttaaaatgggctttgagttttttgtgttattctatccaggagagctcatgaaggaccctgtcagtgtggggggcatccaaaacacattaaggccagattcctagagaaagctgttttgccgaaacaaaaatgatgtctggtggcatcacaggctttctttaatccacttgggctcagtcgtaatggcaaagctaatgaacacagagggatatttgcaggataaaagcaattagaacaattatgagggtaattaactggcccaacacactcgtcaacacatctagcaggaccgccagaatctgagactccaaaacccaaggtttttcttttctgttgattccaaaatcctggatggatttcctgctaaaagattgcattggccgggcccattcgctcacacctgtaatcccagcacttcgggaggccgaggcgggcaaaccatgaggtcaggagtccaagaccagcctggccaacatggtgaaaccctgtctctactaaaaatacagagcttagctgtgcatggtggcacgtccccataatcccagctactcgggaggctgaggcaggagaattgcttgaaccgggacccaggaggcggaggttgcagtgagctgagatcatgccactgcactccagcctgggctacagagcaagactccgtctcaaaaaaaaaaaaaaaaaaaaaaaaaagactgcattgcaggatgagatgtcttaaaaaaaaaaaagtagctgtaatctctcatggaactatacaaccttagaaacatatgataaggaagcaggatgttgaaggaatacagggaaagatggtctctacaggtcctactgagtctagcagggatggttcaggagagatgtatagatatgatgtatgagtttactattgctgctgttatggtttggctctgtgtccccatccaaatctcacgttgaattgtaattcccagcgttgagggagggacctggtgggaggtgattggatcatggtggcggatttcccccttgctgttctcatgatagtgagtgagttctcacgaggtctgacagtttagaagtgtgtggcattccccccttgctctctcttcatccatcaccaccgagcattcatgctgcacacgtaaactcaaagactcaaggtcgccatgtgctatggtttcaatgtctgtgtcctctcgaaatccccattttttggttattgttttgttttgtttttgcttttgcttttttgttttgttttgttttttgagacggagtctcacacagtcgccaggctggagtgcagtggtgtgatctcggctcactgcaacctccgcctccgaggttcaagcgattctcctgcctcagcttcctgagtagcttgggattacaggtgtgcaccaccacacccggctaatttttgtatttttagtagagacagggtttcaccatgttggccaggctggcctcgaactcctgacctcaggtgatccgcctgcctcagcctcctaaagtgctgggattacaggcgtgagccaccacacccggccccagatccctgtcttgagacataacctacaaggtgatagtgttaagaggtggagccctttaagacgtgatgaggtcatgagggtggggcctcaggaatgagatgagtgtccttctaaaagggaccccagagagctccctcgacccttctgccacgtgatgacaagagtgagaaggcaccgtctgtgaaccaggaagcaggtcctcaccagacactgaacgtggcatgctttgatcttggacttctagcctccagaagtgtgagcctgaccaacagggagaaaccccgtctatactaaaaatacaaaattagctgggcatggtggcgcatgcctgtaatcccagctactcaggaggctgaggcaggagaatcgcttgaacccagagggcagaggttgtggtgagccgagatcacaccattgcactccagcctgggcaacaagagggaaactctgcctcaaaaaaataaaaatgaaaaaaataaagaggcaaaagagccagaagcaaaatgtgcatccgcctatttcccctgagggcacgtacgttccctaagagcgacaggtagagtgactaaaagcacctttgttccaacagtggcaggctgtagcatccccgttctcaggaagccacaaccaaaaaaaaaaaaaaaaaaaaaaagccagcaacacacatgaggtgagaaggattttcctgaaaacttccagcctgacaggtgcatgattattttaaaagcagagcctagatgtgcaaatctgcaggaggggtaacatgaaactaaaacatggcattgtttgcaagctacatggcttcgtaggagagtctgctgtatggggggccatggcttgcatggctgacagcatcacttctcctgcatagtgcaaaacatggacaagaagatgcctgaagaggtcctgtgggcctgcctagactcatctggcttaattacaatattcagaaatgcaacacctactctctggagaagtattccattccctctttctgggctcccacaagcacagtctttgcttggctgagccaagggagctgacagcagaatccctgagtcttcggatattagggctgttgttagctatggaaggagggcagagttgagggtgtcagacttggccaacctacccaccagaaggaggacatgcaagccacagagacttgggaggaaggacacagaacagtccacagatagtcaagtagagcaagattgtttcaggaaaaggggttggttctttcacagaatccatgaacagcaatcattaccattttcataatcatcactatcaccaccatcaccaacatcatagccaccaccatcatcattaccatcatcaccatcaccaccatcatcactaccatcatcaccatcatcatcatcaccatcaccatcatcatcatcaccatcaccatcatcatcaccatcatcaccatcaccatcatcaccaccatcatcaccatcatcaccatcaccatcatcaccaccatcatcaccatcatcatcaccatcaccatcatcaccatcatcaccatcaccatcatcaccaccatcatcaccatcatcatcgccatcatcatcactatcatcatcatcatcatcaccatcaccatcatcaccatcatcatcaccatcaccgtcatcaccaccatcatcaccatcatcatcgccatcatcattatcaccatcatcatcactatcatcatcatcatcaccaccatcaccatcatcaccatcattagcagcagcagcagcatgaccatcatcaccatcattatcatttctatcatcaccatcaccatcatcaccatcatcagcagcatcatcaccatcaccaacatcattatcatttctattaccaccactatcaccatcatcatcatcaccaccatcaccatcatcagcagcagcagcatcaccaccatcaccatcatcattatttctatcaccaccaccattgtcatcaccatcatgaccatcatcatcactgaccatcatcatcatcacatgaccatgaccatcactatcaccatcctcatcaccatcatcattatcatttctatcaccccatcatcatcaccatcagcatcagcatcatcaacaccaatattttcatcatcactatcatcaccatcataaacaccatcatcaccatcaccatcatcattatcacatcagcagcagcagcataatcattatcatcaccatcatcaccatcgtcatgatcatcaccatcatcatcatcatcaccatcatcacagtcattactatatcaccatcaccataattatcaccatcatcaccattaccactgtcatcatcattgccatcatcactaccaccatcatcacaaccatcatcaccatcagaatcaccattatcatcaacatcatcattgtggcagctgtcattcatgagatcccacaatgcacaaaatattttcctgtattttattcctttggccagtactttttatatcccagtgatgttccatggaccatcatggggctggggaaatcagtgacacaattaaacaaccaacgatacaatgtgtgaggttggcgatagaagggattaagtgtcccaagggagcagggagttgtaaggcacctggcttcaggacaactgctttacagcatgctataaaagctgagaagactagcatgaaagggacttggatggtcaggaggcagaggaggggaagaattctcaagaaccaggaaccacatgtgcacagctacagcaaacaggtggaggcatgaagggcattctgcccatatgggtttaagcaggttaagacaacagtgtgactcagcaggatctctctgactgcagtgtagacagttcagggagggaaacctggaagccgagagactagccaggaagcagagttatgaagcaggtaagggataggtgtgacctgctgtagggagtgataccgaaaatgacggagtgtttttgataagcatgtaggtggtctacagagctctcagttgccaccagggagaggaatgccaaggtggagaaaagcatctcagacactctaggatcgactgtaggcagctgagaggatggtagtccactgacttacacagagagaaggaaaatgtcaaatacattcctgcacttgctgtggaagcagggaggtgtaggaggcaggagtttggaaacaaatatattggtgagaactagcagagcagagttttggagaacacggacgtggttgcaagacctaaggaaaggtgtgtagtgtgagatgctacgaggaaacgctgaggaaaggcagcataaaagaaacagtcaagaaagaagccacacaggagggtaggtcttggagaaagcaaacccagagggtggaacctcatgagaggatggaattgaatctttcaagacagctgttaaaggacactttttaagagtgtttatcataattttgctcactcagataagtggatgattatttaattcctcactccagctggactataaattccacacaggcaagaagcaagcttatttggttgtatttaaaattgaacaatgggatcacgtggacacaggaaggggaacatcacactctgcggactgttgtggggtggggggaggggggggatggcattgggagatatacctaatgctggatgaccagttggtgggtgcagcacaccggcatggcacatgtatacgtatgtaactaacctgcacaatgtgcacatgtaccctaaaacttaaagtataataataaaaaataaataaatttaaaaaaaaaaagaaaaaaaaatatatatatatacatttgctgcgcacctgtagtcccagctgctcgggaggctgaggcaggagaatcgcttgagcctggaaggcggaggttgtagtgagccaagattgtgccactgcactccagcctggcgacagagtgagactccatctcaaatatatatgtgtgtgtgtgtgtgtgtgtgtgtgtatgtgtatatatatgtgtgtgtgtgtatacatacatacacacatccaacaagtaccatcattaccatcaccatcatcaccatcatcatcatttagggaaaggaacacaaatgtgacactggaaattcacatttgaatttggaaattcatccatgaatcagccagagggctatggtggtggctagtgatggtcatggttgctttaaaagatgcatgctttattgtggtttatgagagaaccaccaagaatggaaagaatgtagcacacagaccgtaattctcattccatagccacagcaggcatcactaattgatgactattccttgctgcaggatcattcttatctcagggtgctggcagccagaaccaatcaatcagccttaggagggaaaatccacttgccatccattcaatttgtgattcgggtgtagagcatctcctgcattccggctgctgttatgagattaattccttcagaggtttactaattaatggatgttgaattatcccaaatgcttccctgttacctaatgagaagcatcctttggtctacaggtggatgagttgcaactaagtcaggagtaattttttttttaacctggaagtctattcagtggataagattaaactagattttctttatttaggttggtaagtagaaccagccgatgatgcttctttgaaaagtgttcatttgggagtaaaacggtttactcagacacaggttggtggctctggtcactttgaagagtacagccagtagatttttggataaatggccaaatactacacaccttaggatttgtgggccataaggtctctgttgcaactcttcaaacctgtgtacctaaggcaaaaacagtcacaggcaataagtaaatgaatgtatatggctgtgtttcaagaaaactttaatgagaaaaacaagttaagggtcagatatgttccagggtcaacagtttccagattcttgatctagattgtccttgatggtttggaaaaagtatatagataatcaattatttatttatttatttatttatttatttatttatttattttgtgtgtgagagagagagagaaagaaagagagagacagagagacggagtcttgctctgtcaccaggctagagtgcagtggcatgatttcagctcactacaacctccacctcccaggttcaagcaattctcctgcctcagcctcccaagtagctgggattacaggcctgtgccaccacacccagctaatttttgtatttttagtagagacagggttttaccatgttggccaggctggtctcgaactctggacctcaggtgacccgcccaactcagcctcccaaagtgctgggattacaggcgtgagccactgcacccaaccagatattcaagaattcattaggaacacttggtggaaagttctgacggttgaaatttcagcatgttgttttatctgtgatctgtaattccatttgcatgaatttagcaaaattctaattttttgcaataagacagcctttcatcctttgcccaggaggaggtaatcaaatatgttagttgagttaagaataaattactttttttgcataagtttaaatcatatttttattacatgttatttcctctttcttgttccaattcatgctaatctgtccttgcttcttttgtgtgtggaatgaaggatgaataaatggtgggatattattctttcatttttcttaaggaaactactattgatggttttgtttttttttttttttgcttctctgctactttccttttgtatttatttctgcacaatgtcattattttcatactcctgcttcctaattttactttatttcttagaggcccagtcatcatttgcttttttatttcttactagcacgagaacttagagtgatacaaatcttctgaatattttggctgcattctgcagacagtgacagcttccatttccatggatattatttataaaacatttttgtcacctgctatgaattgtcaccctgcccacatgctttaaaaggacagtttttgaaatcaacatgagtttgggcactgggaaactgcaaacttaataaaattaaacattaaaaaagcggctctttctgcttccctatcaactgaggcagcagggttatagatgtagggggtaaggaacggaccctgtattggtcagggttctctagagggacagaactaacaggatagatatatagaaaggggcatttattcggtattaactcacacgatcacaaggtcccacaatagactgtctgcaggctgaggggcaaggaagccagcccaagtcccaaagctgaagaacttggagtccagttttccagggcaggaagtatccagcacagagaaagatgcaggctgggaggctagaccagtctagtcttttcatgtttttctgcctgcttatagtctagcctcgctggcctgctgatgacatggtggccacccagatgattaagggtgggtctgcctttcccagcccacggactcaaatgttaatgtcctttggcaacaccctcacagacacacccaggatcaatactttgcatccttcaatccaatcaagtttactctaagtattaatcatcgcagaacccattccaagggcagaagtttacagaggaaatagttaggacctcagccagctccagagtgtgcatggatcagataacaggggtgaatttcctcacagcaggcggaaaaaaaaaaaaattccctactctgagcctccaccctcccctgcaaaaaaaaaaaaaaaaaaaacgggattccctcaggtacccccagaacctaaatcttgttctgtgccagggaggcatggggtacaggagcctggctcactcctgaggaagccactgctcatagctacagggtagctgtggtcctgtggggactgatcagcctcagggcttgaggggacaatgagggcagagaaaacaggagaagggagtggtatgggtttgtccttggtcttactcaaaggagccattgggaggcatggagggaaccccatggcaagatgctgagacgatgccagcttgctgggggttgcagaaacgttttcaggtagccccttggaaagaaacactggttgtcatgggctgaattttgtccccctcaaattcatacattgagatcctcacccctaggacttcagaatgtgatcatatttggatatggggtctttaaagaggcaattaaggtaaaatgaggtttcagggggttggggggaggctgatccaatgggactggctccttataagaagaggagatgaggacacagacacacacagagggacaaccctgtgaggacacagggagaagacggtgactccaagtccagcagagagacctcaggaggaaccagccctgcccataccctgatctcagatgtccagcctccagtactgtgggagaatcaatgtctattgtttctaagccacccagcctatggtattctgtgatagcagcctgaaatggactaagatatctcataagaagaggagatgaggacacagacacagacagaggaaggactctgtgaggacacagggagaagacagcatctccaagtccaggagagagacctcaggaggaatcagccttgcccataccctgatctcagacatccagcctccaggactgtgggagaataaatgtcttgtttgtaagtcatccagcctatggtattctgtgacagcagcctgaaatagactaagacatttcataagaagagatgaggacacagacacacacagaggaaggactctgtgaggacacagggagaagacggcgtctacaagccagagagaaagcaagcctaccgacacggtgacctcagacatgtagcctctacagctgtgagagaataagtatcttttgtttaaaccacctggtctgtggatctctgtaacactcggcaacgctacaagacgaatacacggaccagagcattagaagcgccgcaggtggtctctggcagtcacgcttctgccatgagaatcagctctaaccgtctgttaccgggacatagggtaaccagccaggaaggggtcacctggtctccttcctcctctctctcacctgcacccaggtgggtgctccaatggcagctcatggggggaaagagagggaaaggctgggccagaggcagcagaaatctcccttctgaaagaggaagatgacctgagctcctgccctgggctgaatccctgaatccagactctgttttgtgatgaaagtgatggcggtaacctgggagggggtgggtaggtaggtttcgtgtccacctctgtttccatgcaggagcttgggagagggagacagggagggcacagcacatggatgacaccccacgggctgtgtgcttggcgtgctggacacgtgtgtcacagtctttcttgacctaaaacatgggtacttttatccactcatgagtgtatgatcaattgacacacacgagtcactcaccaacagctgcacaaggatgctccagagataaatcttctcttgccttgtgttttatttattcttctctgtatctccctgatctggccttttcagattcagaatcacgtgggttgttgagcatttccaatttaagggcaattacttattttattttttttttattgttttagatggattcttgccgtgtcacccaggctggagtgcagtggcatgagctcggctcactgcgacctccgcctccggggatcaagtgattctgctgcctcagcctcccgaggagctgggattacaggcttgagccaccatgccaggctagtttttgtatttttagtagagaaggggtttcgccatgtcggccacggtggtctcgaactcccgacctcaagtgatccacccgcctcagcctcccaaattgctgggattacaggcatgaaccaccgtgcccggcctcatttttaaaataatttttaattgtggaaaaatacacataacataaagtttagcattttaaccttttttttttttttttttaatggagctttgctcttgttgcccatcctggagtgtaatagcgcgatctcagctcaccacaacctctgcctcccggattcaagcgattctcctgctcagcctcccaaatagctgggattataggcgcccaccaccacactcggctaattttgtatttttagtaggaggtttctccatgttggtcaggctcgtctcaaactcctgacctcaggtgatccacccgcctcggcctcccaaagtgctgggattacgggcatgagtcaccatgcccagctgcattttttttttttataattttgaattgtggaaaaatacacatcacataaagtttagcattttaaccatttttacgtacacagtaaagtggtattaaatacattcatattgttatgtagccatcactgccatgcatctccaaaatattttcatcttgccaaatggaaactctgttcccattaaacattaagtccccaccttttcctcgcccaacccctataactaccccattctactttctgtctctaaaaatttaaaggtactctgtgtacctcataggagtggaatcctacagtatttgtcctttggggattggtttatttcacttagcattaatgtcctcaaggttagcccacattgcagcatgcatctgaatatccttccttttttatggctgtgtaatattccatcatttggatacaccacattttgcttatccatctgcctgtggagggacacagtttctctccaccttttaggattggattatttcacttagcattaatgtcctcaaggttagcccacatcgcagcatgcatctgaatacccttccttttttatggctgcgtaatattccaccgtttggatataccacattctgcttatccatttgcttctggaaggacacagtttctctccaccttcgggttattgtaagtaatactgctgctgcaaacgtggtttgtgcaaatatctgttggagaccctgtttccaattctttgaggtatatacccagcagtggaattcctggtgccatctgttcttactttttatttcatggaatgctgttttattggggacccaagaatttggcaggatcagtctatcctcagggagtcagtgaagttcaataataaagaaactctccaggtcgtccctccttaaaagtcaggttccttcaagacagaatacaagtgacctgccctcaggcaaaagggatgccggcaacgttgcaccactggtgcaacaccagtatgcaccaaggcataacccaagatttaagacgcagccaagagccctttcccaggaggagccataggtaggaattctcaggcaggcaggggactgggggaaaaaataaacccacctaggggtggaatcctgccaagtaagagaggaatatagaaggcagcagacacaggggtcacacccagaaatgcaaaggctgatgtgaaaagcctgccacgaagcacccagcccatcttaagtgaaattcaagaggactcctgtaatcccagcactttgggaggccgaggtgggcagatcacctgaggtcaggagttcgagaccagcctgaccaacatggtgaaattcccatctctactaaaaatacaaaaattagctgggtgtggtgggacacacctgtaatcccagctactggggagactgaggcaggagaattgcttgaatccaggaggtgaaggttgcagtgggccaagattgcaccactgcactccagcctgggtgacagagcgaaattccgactaaaagaaaaaaaaaggaaagaaattcaagagggactgtgaaaagagcagtgattgctacacagtccaaggcgatccatggggatgagtcagcaattatgcatccaacgaagtgaggtttgcaaggtgaggaaggaggagggaaaacgctgtcgttcaccatccctcgccacagggaggccacaggcaatgccagcaattcaaacgtgctgcttaaacaaagcatcctggtccttcctggggaaatggaaatgggtatgacggtcagggagggtgacgctaccctcaagcccagcccttcacttcaatgggatttaaatgccatgcatgttacagttcagttttatgaaacctctgcttttatctaaagcatatataatttcataaagtatatgtaaagcatttatcattttatatatgcagcacatacaattttaggaggaaatgatggtgcacgcctgtagtcccagctcctcgagaggctgaggtgggaggatcgcttgagttccagaggcaaagccagcccgggcaacacagcaagactcacgtctcttaaaaaataaaataaaataagtaggtatataattttatgtatatattaattttatattttgtatactgatatatatgtattatatattatatgttacaatgtttatttatattatatattatgatatatgcttattatatattatatttattatatattatgtgttacatagtatgatatatataaaataatatatacataaaattaaacatccaataactatagtttatacttatatattataaattcgtgtttattataaagtatgatataaaaatatatactaaatatatatactatttatagaatagcataaatatttaatataaattatttataatgacacaaatataatttatagttatcattatatatttatgtaatatatattttatatatacacaaaatgtattgtgcatattatattatgttttatatataaatatataaataaaatatatcaaagtatatcttgtatataattttatattacaaatatatgttacaaaatatatatacattacaaaatgtaacatacatatgaatgtgaattcatatgtatatacattataatataaattcatattatgtcattatgtatttaatatatacattgaacataatacatcatatataataatacattataatttaatgtatatgctttataataataaatatatagtaagtatataaacctaaaatattaatatagatcaaatatataaatgtgtatacaataaatatatgaacctaaaatatgaatatatataaagtagatgaatataacacataaacaaactataaatgtctagacattgaccatgtacaagtgtgcagtgtggacagtgaatggaaatgtgagcatgaaatgtgtgttgacgcctcccatctcctgtgcacacacaagacacagcgacctccccatctcctgcgcacacatgacacacagggacctccccatctcctgtgcacacacatgacacacagggacctccccatctcctgcacacacatgacacacagggacctccccgtctcctccgcacacacgacacacagggacctccctgtctccggcgcacacaggacacccagggacctccccatctcctctgcacacacgacacacagggacctccccgtctcctgcacacacgacacacagggacctccccgtctcctccgcacacacgacacacagggacctccctgtctcctgcgcacacacgacacacagggacctccccgtctcctgcacacacgacacacagggacctccccatctcctgggcacacaacacccagggacctccctgtctcctgcacacacgacacacagggacctccccgtctcctgcacacacgacacacagggacctccccatctcctgggcacacaacacccagggacctccctgtctcctgcacacacgacacacagtgacctgcccgtctcctgcgcacacacaacacacagggaccattcggggttcagggacgcgtgtccatggtaggatccctggcaatttttctgatttgcccgagcactcatgagtttcatgactgctatgatttttcacagaagcttggctgtgggcaagatgggttggcagatgcagggggaaccggatggaaggctgcttgtgtccgggctcactgtcctggcggctgcaggtgcctaggccatgaggacatctgagcagacagggcgccggaggagagggcaggacaagaatgggagtgcagacagcaggctccctgtgaaggccagtgggcccagctgagacccagggaggggtatacctgccccacaggagagacctggacttggcagcagcagggagctggggcaggagggaaatcggccccacccacatgctgcaagcacgtcagccaggtcagagttccaggtgaggacgaggttacagctacaggtgatatgatgtcagagctatcggtgaggatagccggttagagctacaggtgagggtaagaggtcagaatgccaggtgaagatgagattacagctacaggtgaggatgacatcacatttacacgtgaggataacaggttagagctacagatgaggataagagttggagttggggccgggcacagtggctcacgcctgtaatcccagcactttgggaggctgaggcgggcagatcacaaggtcaagagatcgagaccgtcctggccaacatggtgaaaccccatctctactaaaaatacataaattagatgggcgtggtggcacgtgcctgtagtcccagctactcagtaggctgaggcgggagaatggcgtgaacctgggaggcggaagttgccgtgagccgagattgtgccactgcactccagcctgggcaacacagtgagactccgtctcatgaaaaaaaaaaaaaagagttggagttggagttccaggtagtgatgagaggttggacttccaggtgacaatgagtggtcagcattacaggtgatggagggaggttggagtcctaggtgaggacaagtggtccgagttacaggtgatggggagaggttcgagtcccaggtgaggatcagtggtcagcgttataggtgatgataagaggttgaagttccaggtaaagataagccatcactggggccaaggacagcccgaggtcacagggctggctcaaccctgattcctccaagacctgtgttctttcctgcacctgtttccttggaacgagtctgttcaggactcacactcacctgctgcagggagctcagctctccagcccacctgcactctctccagaacccctccctgcccgtgtgaagcaggagggtgtcacagatcagcacccaacacacctcggccactggggccagccagggggtggaggggccgagctacgtaagtccctgcgcgcaccacaaagggggcttgtactgtgtctagaaacctttcatttctgttttgagtttactttctcactggggttccactcctggcagacctccctttttcccatagagaggccgcacgcagaatttccaagcatctggaaccccggctgcttggaaacatgtagcgcctcctgtcatgccccatcggtgaccagagaggactgagtaagggatgttcccgtgactgcaaggaaggcatggatgggggcgtgtccacctccagcggaacccccaggggacttggaatttggaggcagagtctgaggccaacacttcagagtgacacacgcatgttcagggtcaccttaccggaagccatgcatttccctgatgagccaggggggtgactatgtctccccaagttcttgtcccatgacctggggtcaggacacagtgtgctgatgtcacaccatgtcacacagctgtagtatgcctctatcagcaatgcaactagatattctattcctgcccgatctatgtctctactcgtctcccgaggctgctgtgacaaatgaccacacctggggaacttaattcaacaggaattcatcctctactggctctggagaccaaaagtctgagatcaggtgtctcaggaccatgctccctccgggggctctcaggaaggggcctccctgcctctcctagttcctgggggctccaggagtccctgggtttgtggccgcatcgctccagtctctgcctctgtctccacaaggccttctcctctgtgtctgtgtctcctctcctgtctcctacaaggacagctatcattggatttaagactcaccctaatccagaatgatctcatcttgagatccttaactaattacatctgcaaagaccctatttccaaataagttcctgttcacaggttctggggattaggacatggacatatcttttggagatcagcattcaaccccttgcaattgtgtttgatgctttctttctttttcttttttttttttttttttttgagacagaatcatgctctgtctcccaggctggagtgcattggcaatatctcagctcactgcaacctcagcctcccgggttcaagccattctccagcctcagcctcccgaggagctgggatgacaggctcccgccaccacgcctggctaatttttgtatttttagtagagatgaggtttcaccatgttggccaggctggtctcgaactcctggcctcaagcaatccacccgccttggcctcccaaaggtgtctgatactttctgaagactctagggggcatccttcctgcctcttccagctcctggtatccctaagttgatggccgcatcactccagtctctgtctccacatggccttatctgtgtctcccttttttttttttttttgagatggagtttcactcttgttgcccaggccggagcgcaataccacgatctcggctcaccacaacctccgcctcctgggttcaagcgattctcctgtctcagcctcctgattagctaaaattgctcttaatattttaaaggatactgcagaatacagaggcatttgaaggaataaagagaatggctgaaaacagctgaaattcagcttctttttactattattccatttttatttagagaaaagggtcttgctctgtcgcccaagctaaagtacagggtcgcgatcatggctcaccacagccttgacctccaggctcaaacgatcctcctgcctcagcctcctgagtagctgagactccaggcacgcacaccacgcctgactaatttttttatttagttgtagagacaaggtcttgccatgttgcccaggctggtcttgaagtcctgggctcaagcgatcctcctgcctctgcctcccgagtagctgggaccacagtgcaccccaccaagccagactgatttgttaatattttgtagagacggagtctctctacgccaccctgactgctgtcgaactcctggcctcaagcaatcttcttgcctcagcctcccaaagtgctggaattccaagcgtgagccaccgggcccgaccctggcattcacccctcttgagacacggtgggaaagaaactgtgaatagttattttcacacgtgccgcctgtgctctggtgggagaagagcaatgagaacactcgccttgtttctctacctcggttctcattcacagacaaaaaaaaaaacaacagtaacacagccaggcagggtagagataactccctccactgacagagacattttttttttcccattttaacaacactcattaattcttatctgttaaatagcgcgtagaatttgtgcctctaaacccactcgataatcttttgggtaattaacttgtaaaacaaccccagtcctcgttacgggcgggatggaaaaatgtgaagtagcgcatttgcaaagcagaccatacacaattacttattaaacatgccccaggtgtgccggcaagtcggcggcaagtggaagccctcagccttgtcgtctaatggaagaagattaaaaagtgccaatatcctcagagcgcgcacacacacacacacacacacacatagatacatatgccaacaggctgatctcacacacatagatacatatgccaacaggctgatctcacacacatagatacatatgccaacaggctgatatattcagggtctggagaaggattacacaaagagatgagttgcggaagggggctcgcttgcagacccttgtaggtgaacaggggcagggattaaggagctcatggtgctgcagaagtatctctgaatggatcagggcaaccgtgcattcaatagcaaaatatgtcagtatgactcatctcagaaacagccttgcttccaactgcaggcggtgatttggccagaggtgggctccaagacttgggaaacactcgtcagagcacctctaacctctacctaactctagccctaaccctaaatattagggaaatatgagactatgagttttcaaaaaatagctgggtatggtggctcactgtgcctgtcatcccagcactttgggaggctcaggtaggaggatcgcctgaggctgggagttggagaccaaaacccaaagaggctgtgaaccacaacacaccgtcatttctggaaacgcaccgactatctgggaggcccatgtgtggatgtgcttattcttaagtatttaaaggcccatggaaaggcgcttttgctctttagtgaaaatatatactgggctctatcgagccacgaaaagacgcaaagaaacgttaaatgcatattcctttttttttttttttttgagatggactctcgctgtgtcacctaggctgaagtgcagtggtgcgatctcggctcactgaaaactccgcctcccaggttcaagcaattctcctgcatcagcctcctgagtagctgggattacaggcatgcgccaccatgcctggctaatttttgtatttctatttatttgtttatttatttggagacggtgtctcgctctgtcgcccaggctggagtgcagtggcgcgatctcggctcactgcaagctccccctcccgggttcacgccattctcccacctcagcctcccgagtagctgggactacaggcacccgccaccaagcccagctaattttttttgtacttttagtagagacggggtttcactgtgttagccaggatggtctcgatctcctgatctcgtgatctgcccgcctcggccatagagatttggaaggttattaccaccctgagatatgaagagccctgaagagaaggaacacaatgagacctgcgaggaccaattaaactttcagagagtgtgggacatctatgcccacgcatgagaacacatacggtgacctcaaggaaaaattaccaacaggaacgcatgagtctatctgtttatctacgcatatgcctgtctacagcctgactcgggacacttctcgaaaacatgaaagaaacaaaaggactcactatgaaaaggaaaacagtcaataagggccattttatgtttaaaaaaaaaaaaaacacaggccaggcgtgatagctcacgcctgtaatcccagcacttcgggaggccaaggcaggcagatcacaaagtcaggagatcaagaccatcctggctaacacggtgaatccctgtctctactaaaaatacaaaaaattagctgggtgtgatggtgcacgcctgtaatcccagcatcttgggaggctgaggcaggagaatggcttgaaccagggagtcagaggttgcagtgagccaagatcgcaccactgcactccagcctgggcaacagagcaagactccgtctcaaaacaaacaaacaaaaagcaaaaaaaaaaaaaaaaacaaaaaaacacaggggctgagcttggtgtcttacacctgtaatcccagcactttggaaggtgggaggatcgcctgaggccaggagtttgagaccagcctgggcgacataatgagaccccgtctctagaaaaaatttaaaaaacaaaattagccatgtgtagtggtgcatgctactagtcccagctactcgggaggctggggtaggaagtttcctactgaggagtttgaggctgcagtgagctatgatcacaccactgcactccaacctgggtgacagagcaagaccttgtctccaaaacaacaaaacaaaaaacaaaggtaattgtgaatatatgctgaaccagaatacacatccacaatctggttaaaacttctcgggaataaacataattaatcgttggcgaacacattcacataaagtgctgtgattccaacttcagcacagacatgatctctcaaggattctatgccctaaaatcatgtcacaagaattctgtacattaaaaatggatacccaggggtgtggggagaattccatgccatcaacactcacatcatcctttttccaagtttcgcaacctccttaacaatccttctacccaatccgaaagtctacaggttgaagaaaaattctaggtgtcttcttgccccaagatatgtctgcctcctgacttggagttctcgctctgtttgatgatgaagaccagtagacacctacacagagactcttgcatgtcatcatgaataacatatgtcccagtcatgtgtcacaggtgagcctgtaaaacaggcactgaggtagattgtctcgggagccactgtgtttcaggcactgaatcagagactcagaagatacctgtgcacagaatccatctctgccctcacaaagctctgattttagcagggacaggcgatgaggagggtgagtattcccaaaacaacaaccctcatctcttgcacgtggaacgggtcacaaagagctctcttactgacaacaagcattcatcctacacttcactgactcttgtattttcaatctactcaattacgttgatgacctgttatcaaccttcatcctgatttcacagtattctgttttcatgataaattcaagtattttataggtcattggataggccaaaatgatggttcacaaagatctattttcaaagtagaagtgcctcccaaggcggcgtgcaaaatttaccttcttgacacccatcaattacagaaggcattgaccagtgatttcttttattgaaaacaaacttggtctaataactgggtggaagcacatgaaccaaacagctagtccctcttctgatgaagacggcacaagctactggaagaataatatttgggaagcttttttttttttttttttttagatgaagtttttctctgtcgcccaggccggagtgcagtggcatgatctcggctcaccgcaaacctccgcctcccgggtccaagccattctcctgcctcagcctcctgagtagctggaattacaggcacccgccaccatacctgactaacatttatatttttagtagagatggggtttcaccgtgttggccaggctggtttcaaactcctgacctcaagctatctgcccgcctaggcctcccaaagagctgggatgacaggcgtgagccatcgtgcctagccaggaagctaaatgaatcagaagatgctgtttgtgattaaagttacacaatcattatagaaaatgaggacaccgtgcaccttccaaagaggatacacagcacgtgtctagtctgatctctcttaggatttaggattacaggggttccaccatggcatgtacgagctgcaaaagagaatgggcctgccttcagtgcttttaagagtgtttaactggttatctctccccatctgagttcatttgaacacggctatgcctttctgtgtttgctttcatggagccgctggggtttgatttatttatatttggaggagtttcggtaagtgaatgagactatttgttctaagtaagacagctttcatcagcacataattacccaggagccacaaaggtgtgggcacaatggctaagtgatgataaggagtgaaaacgcttccctggaaaatccctagcttgggaaatgagccatctcgcccagattcctgaaaacaatcgcgcatttataattccgagagctcaattagccgtccttctgtgggcacgtagcttcccatgccctgcccagcgtgggatctcagaggagcacgacttcaaagacagaaagtacaacaaagtacgcaggccagagtattaacccaagaactaaggagagagaattgagagcaggaaaggcaggaggggaaagcaggctagacaggcgcccagcatgttgaaataattgtgtgactgacactccacagcaatctgtgctcctggagtcaggacgtgagccgacttgcttaaaaataaatccacatggctgaaccggggttacccgatgccgggatcccagcagagcaagaacgaaacagcacattcagctccctctgtccctcgctgggcaactggaggttgtggggacaagaatcagagttccagcaggtgcaggccagtccagagagaagcacaatttagagcaaggttcgtacgggtttggtggaggtgtgcccaggtctcagctgaggagggaagggatgcctgtaggagctgtggtcgtccataagatgttgtgggcagcagataccactcacaggcagagggcagaccctgccgtgtggctggaccacggatctgggggctcctgagcctggaggcagactcagtcgaggtaaaggctcaatggccacagccgaaatgtccccacccagctgggcctcagcatcatctatcaaggactggagagtcccccagcagtggacataccagggccaccactgatgaatgtccaaacctgttcagattttaaacttttttcttttaaaaaaaaaaattgcatgcacacatagtaggtgtatatatttatgggataatgaggtattttgatacaggcatgcaatgtgtaatactcacatcagggcaaatagggtatccatcccctcgagcattcatcacttgtttgtgtcactaacattccaattacacctttaattggtttctttttttttttttttttttttgagatggagtctctgtagtccaggttggagtgcggtggcacaatctcagctcacagcaacctccgcctcccagattcaagcaattctcctgcttcagcctcccaagtagctgggactacaggtgtgcaccaccacgcccggctaatttttgtgtttttagtagagacggggtttcaccatgttggccaggctggtctcgaactcctgacctcaagtcatccacctgcctcggctttccaaagtgctgggattcaggggtgagccaccatgtccagcaacttttagttatttttaaatggaccatgaaggattgttgactgtagtcacccttttgtgctatcaaatacgagaccttactcattctatctaaagtatatttttgtgcccattaaccatctccacggcacaccccatcttcccaccctcttacaagatggtaaagcttttaaacagccacagaaagtgcaaacgattcttttcttcttttctgtaagattggcttaaaggccatcggtatttatatgccacaagtaaactaacattttttaatggtggggacaaatcatgtattcgtcatgctacttgtccacaaaacactgcactttaaaaactgatgatcgaatatcctacacaaacttttccaagaaaacagcaatgatttgttattgtggtcagatgcagtggctcacgcctgtaatcccagcaatttgggaggctgaggtgggtggatatctgaggtcaagagtttgagacaagcctggctaacacggtgaaaccccatctctactaaaaatacaaaaaattagccgggcctggtggtgggtgtctgtgatcccagttactcgggaggctgaggcaggagaatcgcttgaacccgggaggcggaggttgcagtgagccgagatcacaccactgcattctaacgtgggcaacaagagtgaaactctgtctcaaaaaaaaaaaaaaaaaattattggtcaaaattcatgttgtctaaatctgaaacattttcagaatctaataaaattaagttggtgattataaatcattgtttcttggctgtcattttggttaggtggatcacatatgtgaattttggggaactatatatagtttttaagccgttcagattaaaagcaaaaagtcatgagaaaagaatgcctcacttgtcagtttccagaaacttctctttgggctccagattgatggttgaatgccttcaggacagcagcaagtgtaccatttgaaggtgcgtggggatcatttaacggcctcataagaatgcagattccagggccccgcccccacccccagaggccccgattcacagatgggccctgggcacctgcatttcttgtttactccccggaaatgctgatgtgacaggcccggagaaggcacttttggattcattgtgttagaaaatgccactcctttgaaaacctgctgcaaatgaggaagggccaaggtggcagggaataggaccccctgtcacagatgaaacaggaattttaaaaaatttaaaaatgtataagcaaaaactcagttgtatgtaagaaaacccagttctccctgaggaagagaaagagttgaagtccattaaaaattaactgcctgtttttctgcggctaataagccttgtctcttcctttcccaagcattataaaaactctgcttctctagctatacagctacaaagtcactaggcaaataatctcaaatcataaaacatattattccttaaaaaataaaaaataatataatgcatgtgtcaattaaacaactgtctttgtttctcacttctatgatatacttccccctacacagagctccccccgccccagaaaatacttaaaaaataaccaaactctttgttcaaaactcggtcctttaaatgttaatccgacggggtcggtacaaataaataattaaataattcctcctcaacccctcggtgtctctaattccttaattatccctctacacagaaaccaatccttttgccccaaggcagatcctaatgaggagaaaagatctggccaggctgctgccactctgtgacattgtacactgggcttggctctggctgagcgggagcccctgtgggagtgtgttcctgaaaatcacagggatcctgcaatgccggctatgaaatttcaacataccccagcccttggcagaggtaataacaaggtgtttcacagcagcttagggtagaaaggaggagataggggcataggcagtgaccaggctcagctctgtgtagcgttcatttcactctcatggctttaaaaagaatcaaggccgggcgcggtggctcacaccggtcatctcagcactttgggaggctgaggcgggtggatcatgaggtcaggagttcaagaccagcctggccaagatggtgaaaccccgtctctactaaaaatacaaaaattagccgggcttggtgggtgggcgcctgtaatcccagctactcgggaggctgaggcaggagaatcgcttgaacccgggccacagaggttgcagtgagccgagatcacattgctgcactccagcctgggtgatagagtgagactctgtctcaaaatattaataataatcgtcatcatcatcaaaataggccaggcacagtggctcacacctataatcccagcactttgggaggccgaggtgaatggaccgcttgaacccagtagttcaagatgaacctgggcaacaaggcaaaaccccaactctacaaagagtagctgggtgtggtgctgcacacctgtattcccagctactggggaggctgaggcaggagaaacacttgggcctgggaggcggaggttgcagtgagccgagataacaccactgtactccagcctgggcaacagagtgagaccctgtatcaaaaaacaaacaaacaaataaagaatcaaaatacacccatcccccacttgggggaattctcaaaacaccatctcaaattcaaacagccaaggaagggatgtgcatttaaaaaaaaaaaaaaaataaggtaccacacataaacatggccgagaaaagcacttagcatttggatggccaacaggtatatgaaaaggtgcttataggaaaaggtagtcggccgggtgcagtggctcacgcctgtaatcccaacactttgggaggctgaggcgaacggatcacgaggtcaggagttcgagaccagcctggccaacatggcgaaaccccgtctctattaaaaatacaaaaattagctgggcatggtcgccaatgcctgtaatctcagctactcaggaggctgaggcagaagaatcgcttgaacctgggagccggaggttgcagtgagccgagatcgcaccactgcattccagcctaggtgacagagtgagactccgtctcaaaaagaaacaaaaaaataaacaaagaaaaggtactcaacatcactaatcatcagggaaatgcaaatgaaaaccaccatgagctactatctcacaccagctaaaatggatattgtcagaagggtgtttttgtttgtgtttttttgttttttgtttttttttttctttgagacagagtcttgctctgtcacccaggctggagtgcaaaggtgtgatctcagctcactgcaacctccaactcccaggttcaagcaattctcctgcctcagcctcctgagtagctggggttacaggcccctgccaccacgctcggctaatttttgtatttttagtagactcgaggtttcaccatgttagccaggctggtctcgaactcctgacctcaggtgatccacccgcctcggcctcccaaagtgctgggattacaggtgccagccaccacgctggccagaatgatgatttctacagttaattacaagtgttggggagggtgtagagaaaagggggcccttgtacaccactggtgggaatgtcaattagtacagtcactatgaaaaacagtacagaagttcctcaaatcattaaaaataaaagcaccacataattcagcaattccactgctaggcacagactcaaagcaaatgaaatcagtgtatcaaagagatgcctgcattcctatgtgcattgcagcactattcacaggagccaagatatggaaacaacctaggtgtccaacaacacacgaaagcataaagaaaatatatatctatacctgatggaatactatgcagccatgaaaaaggaggaaatcctatctcctgcagcaacacagatggaactggaggccattaccctaagggacataactcagaaaccgaaagtcaaataccattcttcttaggtcgagtccaatttgctgggtccgactcgcagactttggctgagcgacggatgaacaaatgcactcagacacagatttccagtgaaagcgtgggctaggggatggggccactcacagacactgaggagggtgttttaaagagtcagcagccacggctttgacaagctgctgctgtgggcctttatttagtatacatttaatgacaaaggccttgagtcaacacattcgtgggcaattcatatggtcgtcccccgcaacccggagagagggagagagtagttctgtgcgtggatgattaaaggccaggttctgaggcctaagcaaactaacttatctagatcagtttctttacatcccctcgttatctaacctaagctttcaggcactggataagagaatctggctgccttcagccaaatcttattcgggagcatttgcaaaaccttctggcctcccaagaaggtttgcatcttctacaatttttcctaccaccctgaccgacctcctacattcttacttataagcaggagctaaataatgtgtccacatggaaagagtggaataacagagactggagactcagaagggtgggaggtggaagaggagcaagggatgagaaattacctctcgggtacaatgtacgtgattcaggtgttagctatactaaaagcccagacctcaccactacgccattcatccatgttaacaaaactgtacttgcactccctacctgtatacaaatgaaaaataaaataataaataaataaaaggacagagcattgagaatctagatggatattagaaagttgtgtgcacaccttccttagtgtgaacagacagaaagagcacaccagaatttggtctagcacctggtcgaaaatcttaagggcaagcatattcctgtttgatttatctttttttctttctttcttttttttttttgagacggagtcttgctctctctcccaggcagtcccagattcaagcgattctcctgcctcagcctcctgggtcattgggattacaggcacatgccaccatgcctggctaatttttgtatttttagtagagattgggtttcaccatgttggccaggctggtctccaactcctgacctcgtgatccacccgcctcagcctcccaaagtgctgggattacaggcgcgagccactgcgcccggcctgatttatcttaagtcaagaactcccaaccagcagaggcacctcctggcatgtgccctggaggtcaacaggaaaggacaatggctcctgttccctggggaacacacatttgagtaagagtgcaagctaccagcacatctgcatgcctttcctagcagatgtcagagctgagtgatgctatcttcgccttgccttgaccatctcctgctctaggatggggccagaaatccccaaaagaagagtgcaaaaatcagagccatctctcccaaatgccacctggcacgtgactgaagctcagccatgaaccacgcaaacgacctgtcccaaggaaaaaaaaaaacaaaaaaaagccattggagtatctctcggtacctttgtcgttcaaggtttcttcttttattttgcttacaacttgtttggctttgctgtcattatttccagctaaaaggaaaaagaaaaaaaagatacggtgacttgtaggattatccagaaactattaactgcaaaaaaaaaaagaggttttaagagaagtataacacaaatctgaaatgtgcctttgatggactttccctttatcctagcgtctaacttgacagccattttggcagactaaagctatccatttaagagtcattttctttagcctgcattggcaaaaagtacaaatgcatttgacattctacttttcaatagtgacagggacccggggcacctgctggtgtaatttgcacgtgagagctgagaatagcataagcataaaaaatgtgcattaaaatgtcaggatggaaacgaattttcgaaggagcttttatgctggaaacatcccagtgtgcacacacagactgcacgatgcacgtgatcacagaccgtggttcctactacgtgctcaggatttctttctgtttcttttttttaattctactttaagttctggggcacatgtgcggaatgtgcaggttggttacataggtatacacgtgccatggcagtttgctgcacccatcaacccatcatctacattaggtatttctcctaatgctctccctgccctgccccctcaacccctcgacaggccctggtgtgggatgttcccctccctgtgtccatgcgttctcattgttcaactcccacttatgaaggagaacatggggtctttggttttctgttcctgcgttagttggctgtgtgctcaggatttcttactcctctcactgcacttccgtaaaactctccaagtgaggtttcaggaacacgcctttagaaggatggaaagaggtgttttgcttgttatagctaaaataaagactaggaaatccggggtgaaagaatgttaattgggtttttttgttttgtttttttgttttgttttttttttgagacagaatcttgctctgttgcccaggctggagtgcagtggtgcgatctcagctcactgcaacctccacctctctgattcaagtgattctgctgcctcagcctcctgagtagctgggattagaggtgactgccactatgcccagctaattttttcgtatctttagtagagagggggtttcaccatgttggcaaggctggtcttgaactcctgatctcaggtgatcctcccgcctcggcctccacagtgctgggatgacaggtatgagccaccacacccggcctggtttctttaatgtcttaggaagtgaacatgcgttgaacaggagactatagtttgatgttgtcttcgtcattttttcaaatgtctttgacccgggaggttggattttaaggtgtttctgaaggggcggctctttaggggaaaggagtttggcaaatttttcctccttcagcctcatccttcattaacctgttggcaacatgtgggattagctgctttccagggtgagccaagcccaaaactccctttcagggagggtcacggaaaaagtgttgagagaagggagatgagaactagcaggggaagcgcacaggcttgaacaagaacgtcttgggtgcccggagagcttcaaacagctgatctgcaaggagcagttaccaagggggtggggccggtctatctccatcctacctgcacccagcccgggccagtgaggtgttctgtagtacagcaccgtccccgggtctccatgaaaatacattaccaaataatccctctctttggcattcctgaatactgagtcaacacggcgtattgaatttacacactctaacacaaggaagagaccatgctgtttgatatcctatcattgtattcggtattctttcttctgtgttaaggccatgggctcccaaattaactattagaatgcacttttcaaaaaacaatgaaaatgttttcagcaaagagtgaaaaaatatataaaagaggagaagcagtgaaacttatgaagttggaaatgtttttggctccagtgggagacggctaagataaatagtgcaaagtccatcctttggggcagagtaaatggaatatctaaattgtcacttccttgaaggaattcaaagttgcagacatcagaagactgaagctgcaaaggtaatttgcacctttgacttccttaaagaaacagaacatgataccattattacatttttgctttgacagtcctttggcactgaggaggcagcaggcatttcagggaggtgggtttcgacgggagggagaggaagaaatagcctgaaaggtatattccatctataaatgtcctatgcatcaaacacaaaacaaaaaaagaaaggataaaaaaattcaaagtcaaggtaacctttacactggggacttgtacattcatgagcttatttatgaaatcccatgaactttttaaatgtaagcactcatccactgctgggctgctctgccgtatcagccatctcaagatcaaagggtgcggccgggtgcggtggctcatgcctgtaatctcagccctttgggatttgggaagccgaggcaagcggatcacgaggtcaggagttcaagaccagcctggccaacatgaggaaaccccatctctactaaaaacacaaaaattagatgggcatggtgatgtgtgcctgtaatcccagctactagggaagcggaggcaggagaattgcttgaaccaggacccgggaagcagaggttgccatgaactgagatcacaccactgcactccagcctgggcgacagagcccaactctgtcccaaaaaaaaaaaaaaaaaaaaaagttagccagacatggtagcaggcacctgtaatcccagctactctggaggctaaggcagaagaattgcttgaacccagtaggcagaggttgcagtgagatgagattgcgccactgcactccagcctgggcaacacagcgagactccatctcaaaaagaaaacaaaacaaaacaaaacaaaaaaaaacaaagggaaacatgccggaagctgggacgaagtaagatgggagcctccaccttctcaagaaagacaaaagtgaccagaaaaagctgggagcatcaaaaaaagccaggtgaagtgattatttgggaagaccaccttcatgggcaggccattttccatggtggcaccgtcaacgctggcataggacagaagcaccacactggaggaatggagaaggtgaggtggcacgtgcggtatcttctttggccaatgtcaccttcagcaattgtctcctcagacctggagggagctgctttaaggaactggacgtgggacatttggcctcatatgcatttgctggagtggttcctacatttgctgagcaagtactgcatatgcagaaacaccgcacacgtcccaaacacagtgcatctgccttctgcttcatcctttgtatttgggggggcaggggagggcgttacatgttatatgtgcaatggaaattggtatagccattatggaaaacagtggagatggggtttcactatgttggccaggctggtcttgaacgcctgacctcgggtgacccgtttgcctttgcctcccaaagtgctgggatgacagacatgagccactgcacccggcctggtttttttcacatcttaggaagtgaacgtgcttggacaggagactatagtttgatgttgtcgtcatttttttcaaatgtctttgaccagaaaggttggattttaaggtgtgtctaaaggggtggcctttttttttttaagagttcctcaaaaaatgatcattatgcctaccataggatctagcaatctcactcctctgtatagatccaaaggaaatgaaatcagccccttatagagatatctacacccccatgttcgttgcagcatgattcacaagagccaagatatgaaaccaacctaagtgtccatctaaggatgggtagataaataaaatgtgggatagctacaccatggaataccattcagtctttgaaaaccagaggaccctatcctgtgatacaacatggatcaaccaggagtacatcatgttaagtaaaataagccacataaaaccaaatcccacatgatctcacccatatgtagagtctccagaagttgaactcacaagaaaaagtattatgatgattattggccaggcgtggtatctcatgcctgtaatcccagcactttgggaggccaaggcaggtggatcacaaggtcaagagatcgagaccatcctggccaacctggcaaaagcctgtctctactaaaaatacaaaaattagccgggtacggtggcatgcacctgtagtcccagctactcaggaggctgaggcaggagaatcgcttgaacccaggaggtggaggttgcagtgagccgagattgcgccactgcactccagcctggtgacagagtgagactccatctcaaaaaaaagaaagaaagaaaagaaaaagaattatggtgattaccaggtgctaggggggtgggttgctgagattttgttcaaatgacaccaaatgtcagtttgacagaaggtataagttcaagagatctattgtacttaaggtgactaaattagtgactataatcttgaacctgactataattagtcacagtgactataattaatatttgaaaattgcaaagagagtagattttaagtgtttccaaaaacacacacaaaaagaaacatgtaaggtaatggatatgtgaattagcttgaattggccattccagatggaaacatatatcaaaaccacattttgtacaccataaaaatatgtaacttgtttttgtctattaaaataagtaaatagataattaaatacaagtttaaatattttacacgtttcacatgtactattcatggacaatacaaagtatatgtggcacaagtcatttttaaaagacagttgcaatttagataacctaaccaactagacttcctgtgacctacaaaactagattttatgatgaccaacgcaactacacctcatcatactctaacccaactaaatctcattaggactaaccaaaatacacctcatcataacttaacccaaatagatctgattataccctaacccaactagacctcatcatgacctaacccaactaaatctcattataacctagcccaaataaacctcaacatgacctaatacaaacaggtatctttatgaccaacccaaatacacctcatcataacttaactgaatctcatcacaaccaacgacactagacctcataacctaaccaaactagacctcatcatgacctaatacaactagatcacatcatgaccaactcaactagacctcatcatgacctgacacagctaaatctcattataaacaagcccaacaagaactaatcatgactgactatgactagatttcatcatgaccaacccaactacctcatcgtgacctaactaactctcatcatgaccaacccaactatacctcatcataacttaacccaacttaactacatcataacctaactcaacaagacttcattatgacctaatacaactacatctcatcaaggccaacaaaactagtcctcatcatgacctaacaaaatctcatcatgaccaacccaaatagacctcatcacaaccttatccaagtaaatctcctcataccctaacccaactagaactcatcatgacctaaccaaactagacttcatcataacctaaccaaactagacctcatcacgacctaatacaactatatctcatcaagaccaacccaactagaccttatcatgacctaattatatctcatcatgaccatccaactagatctcctcatgacataatccaacaagatttcatcataaccaaaccaactagacctcatcataacctaacccaactaggtctcatcatgacctaatacaactagatcccatcatgagcaacacaactagactgcatcataaacaaattacatctcattatgacaacgaactagatcttatcataacctaacacacctgggtctcatcatgacccaatacaagtagatctcatcatgaacaacctaccagagctcatcatagcctaggccaactagatttcattatgacctaatacaactaattctcataatgaccaatcccactagacctcatcatgacctaaccaaactggacttcatcataacctaacccaactagacctcatcatgacatgagacaactagatctcatcacgacctacccaactagaactcatcacgacctaactagatcacatcgtgaccaaccaaacagatcccattataacttaatccaactagatctcatcataacctaatacaactagatctcatcatgaccaatgcactagacctcatcatatcctaccacaactagatctcatcatgacctaatccaactagatctcatcataacctaatacaactagatctcatcatgaccaatgcactagacctcatcatatcctaccacaactagatctcatcatgacctaatacaactagatttcattatgaccaccgcatctggacctcatcataacctaactggatctcaacatgaccaaccaactagatctcatcataacctaacccaactataactcatcatgatctagtacaactagctctcatcatgacaaactcaatgagacctcatcataacttaccccaactacatcacatcatgacctaatacaactagatctcatcatgaccaaccaactagatatcatcgtaatataattcaattagatctcatcatgacctaatacaactagatctcataaagaccagcccaactagacctcatcataacctaactcaattaaatctcctcataccctaacccaactagacctcatcatgacctaacccaactaaacctcatcataatctaacccaactagacctcatcatgactgaatatgactagatctcatcacaaccaacccaaatagacctcatcataacctaattagatctcatcatgaccaaccaactagatcgcatcataacctaacccaaccagatctcatcatgaccaacccaactagacctcataataacttcacccaattagatcacatcataacctaatacaactagatctcctcatgaccaatctaactagacctcatcagaacctaactagatctcatcatgacctaatacaactagttctcatcatgaccaacccaactagacctcatcataacctaacccaactagatctcatcaagacctaatacaattagttctcctcatgaccaacccaaccggacctcctcataacctaactagatctcgtcatgaccaaccaaccagatctcatcacaacctgacccaactagatctcgtcatgacctaatacaacttgatctcatcctgaccaacacaactagtcctcattatagcctaactaagtctcatcatgaccaatcaactagacctcatcagaaccttacccaactggatctcatcaggatctaatacaactagatctcatcatgaccaacccaagtagacttcatcataacccaactaaacttcattataacccaactagacctcatcattatctacccttcctgaggactgtacaagagatttcttatattggaaaaaagcagtataatttcctcttactaaataaaaagattttgagcccaaaccagagtcaccaatctgcggctaaacctggcctgcagctggatattgtacaaaaagttttacagcaacatagactttcctgttgttttaagtattacctatgggtggttactcactactagggcagagctcatagttatgagagaaacatatgaacacatttattatctgtctctttacagaaaaagtttacccaccccactttcatcttagatgacagtccattgagcattatgaaaaaaaatgatcccccaccaaaataatattttgaaacaatgagaactaagatcttgtggacagatgggaatttgaacaactgatatatgtgtctagtaatattaatgtgcttcagttggacccaggttataatctgaattattttacaagtaattgattattctttaaatattaataaatttttaattaaaattttgaagttaaatttcccatctcttattttgtatttaatataaaattcattgtgttcaatgatattttttcattaattgactttgaatcaaactgccatacaaaatgaaaaaatgcctctctcagaatatatccaattatcctcaaagtcacacaggggaaataagactgcataattgattggattgacctgaagggtcaaaactgtaactcacagtgaaaattaaacactgacatcaggagctctgtgggataggagacacaggtggggtgcagatgtggtgtttactttctgtttatctcaagaaaaaaggcacattggtgctgacatatactgctcctgatgctcagtaaacatcatctaaatgaagtggtaacacttgagattcccatgcacatgaacaagaagcttgctcacatgtcttcattgctttgtgcctacaaagtcctcagtcaactagacctcactgtgacctaaccaaaccacacatcatcatgatctaactcaacctgtcatcatgatctaatccaagaggactttattgtgttctattcaactacctcatgatgacataacccagctggaccttatcatgacctaatccaactagaccttatcatgacctaacccaactagacctcatcatgatctatccactaggcctcatcatgaccttcctaactagatctcctcatgatctaacccaattagacgtcatcatgacctacccaactagacgtcaatgtgacctgacccaactagaactcattgagtcttaacccaactagacttcatcatgacctagccaaaccacacatcaccatgatctgatccagctagatctcatcatgctattactgaagtagacttcattaagacctaattaaatcacacctcataatgatctaactcaaccagtcatcctaatctaatccaacaagatttcatcacattctactcaactacctcatcatgacatagccaaactaaacattatgatgaactaatacaactagacttcatcatgacctaaccaaactgtaccttaccatgatctaatacaaccaaacctcatcatgacttaatacaaatagacctcatcatggcctacccaactagacctcaatgtgacctaactcaactacatttcatcaggacctaactcaacaagacctcatcatgacctacccaattagatctcaaagtgacctagcccaacaagatttcatcatcacctaaataagtcacacatcatcaagtctaatccaactagatctcatcatgctgttactgaactagacttcattaagacctaatcaaaccatacctcataatgacctaactcaaccagtcatcatgatctaatcgaacaagacttcattacattctactcaactacttcatcatgacataaccaaaggagacgttatcatgatctaatacaactagacttcatcatgaccaaaccaaactgtacctcagcatgatctaactcaaccagacatcatcagaacctaatacaactagacttcatcatgacctgcccaactagacctcatcatgacctaaaccaccacaatgaggcaaaaaagcacaaagaaatggggtgttttcttcctttcctagtttgattaagaattaaactaataattaaacattgcctagctaaattaagaattaagaagatgaaaaagatcattgcactggaggagacaaaagatcaaatataaccagtaatggatgtgagccctcccatctttgttcaaccttgagggtctctcttcatcctactccaccatcattgaagccactaggctcacatccagccaaccttcagagaatacctattgctctccctgttcaaaaaatcagcatcattttgacccagtcatctcaaatattggcagaagtctgagatatagaaagtcctggaaagtttgtcatgttgttaatgatacagcagatatccacctagcatggatggtcaaaaccaagggttgccatccatcaccacctcacagtctccaagctaaatctcagaaccccccctgccctacatcttgtctctaatttactcaggtcccagggagatgtaaacagatcatggaggtgctcaagttcataagaagttctagaaatacactctcagatgggcaccctctcccctggggtctcctcatctaaacccaatccttttgcatctagagggggcgcaataaactgaatgtttgtatccctccaaagttcctatgttgaaattctaacatccccagtgattctgttgggaggcggaggctttgcgggatgattaggtcacgagggtggagcacaatgaatggaattagtacccttataaaagagaccccatccaggttccaccatgtgaggacacaggagaaagtggccatccacaacctagaagacagactacaccagaatctgaccacactgaccccctggtcttgggacttccagccttgagaactgtaggacaataagtttctatggtttattgtggaagtcagtgtggcgattcctcagggatctagaactagaaataccatttgacccagccatcccattactgggtatatacccaaaggattataaatcatgctgctataaagacacacgcacacgtatgtttatagcagcactattcacaatagcaaagacttggaaccaacctaaatgtccaacaacgatagactggattaagaaaatgtggcacatatacaccacagaatactatgcagccatcaaaaatgatgagttcatgtccttcgtagggacatggatgaagctggaaaccatcattctcagcaaactatcgcaaggacaaaaaaccaaacaccgcatgttctcactcataggtgggaactgaacaatgagaacacatggacacaggaaggggaacatcacacaccggggactgttgtggggtggggggaggggggagggatagcattaggagatatacctaatgctaaatgacgagttaataggtgcagcacaccagcatggcacatgtatacatatgtaacaaacctgcacgttgtgcacatgtaccctaaaacttaaagtataataataaaattttaaaaaaaaagtttctatggtttgcaaggcactcaggctacagcagcccaaacacaccaagacaggagagttagggacatggatgaacttgacaatttcaagaaattgtcataaagttttaacttgtcccagtctattaagagaatgaggccgggcgcagtggctcacgcctgtaatcccagcactttgggaggccgaggcaggcaaattacgaggtcaagagatcaagaccatcctgacctacatggtgaaaccccccctctactaaaaatacaaaaaattagcttggtgtgctggcacgcgcctgtaatcccagctacttgggaggctgaggcaggagaatcgcttcaacccgggaggcagagtttgcggtgagctgagatcgcgccactgcactccagcctgggcaataacagcgaaactccatctcaaaaaataataataataataataataaaataataaaataaaataaagagaatggggccgggcacagtggctcacgcctgtaataccagcattttgggaggctgaggcaggtggatcacaaggtcaagagatcgagaccatcttggccaacatggtgaaaccccgtctctactaaaaatacaaaaattagctgggtgtggtggtgtgctcctgtagtcccagctactcaggaggctgaggcagcagaatcgcttgaacccgggaggcggaggttgaagtgagctgagatcgcgccactgcactccagcctgggcaacagagtgagacttcatgtcaaagtaaaaaaaaaaagaatggataaaaaaaatgctcaagtgggagttaggcacaactttgaggaaaataactgcttgatggaaagaaagagactgatatagaccaaaaagtgctcacctgcttccgaagctcaacaagtcattaactaatccaacaagatttcattatattctactcaattgcctcattatgacatagccaaacacgatgttatcattatctaatacaactaagcttcatcatgtgaaacagtacacatctctgtatactattttacaaaccctgaagtgcatcagagaaagatggttatatgaggaatggaactgcgtgtacaaaattattattttaaaagactctgggcacagtggctcacacctgtaatcccagcactttgggaagccgaggcaggcagatcgcttgaactcaggtgtttgagacaagtccaagcaacatggtgaggccccatctctactaaaactacaaaaaattatccaagcctggtggtgcacgcctgtggtcccagctacttgggaggctgaggtgggaggatcgcttgagcccaggaggcagaggttgtagtgggctgagatcacgccattgcactccagcctgggtgacagagtgagacgctgtctcaaaaatgtgaaagttgggaagagccatgacatagaaaaatttcaagttttgcattcatgttttgcaaaagccaaaaaggctcaaacttaagtgaaggacggagcaaggagccatgtgcgctgacatggaccacgcatctccagggagaccagaaggccacatgggctgaacatggggtttccccatctgagtcaaagactcctggggattcctgcatgaaattcaggaggttagcatcagcaaggttagcattttcttcttttgtaaatgaagatgagaaaacacagaggtgtgggcagcagccgtgcatttgccccagcagaaactgccatggagatttttggagagagctaactcaaagccaagtggatggccatcgaggctcagaacgctagcagctattgaaacgcatgaggcccaggaccagagcagctatttaaacgcatgagtatatcacagtttttatcgtatagatgtaatgcatacaatgatgtggagagttcattttttccttataccttttatctgcatgtcaacttcatcgattcgtaacatgatgacttttagcctgtccaatgagcaccaacagatgtccagaggttcaaggcctggaaagactctttgctgagccctggtcaccagatcagactcatgctcttatgcttgagccttttgggctatcgcaaaggcattcaaggcccagaaaagtgtctgtcctggacagagctcctcaaagataaggaagaactgagacaaattcatgttgaaatctccagccctaagcattgtttatgatccatgatcatctttccataatgacaacaagggaaagaaggacagagaatggcggagaggaagaagtcaatcaataatgggcattggttttggaaagtctttttttgagacagagtctcactctgtcacccaggctggagtgcagtggcgcgatctcggttcactgcaacctccggctccctggctcaagcgatgctcccgcctcagcctcccgagcagctgggattacaggcatacgccaccatgccgagctactttttgtatttttagtagagacggggtttcaccatgttagccaggatggtctcgatctcctgacctcgtgatctgcccgcctcggcttcctaaagtgctgggattacaggcatgagccactgctcccgtcctggaaagtgttaagtcaatacgatcctgcatatctcaaaccagacctacagtatgatgtttataaaagcagacaccataaaagttattaaaagcaaagggtgcccaggcctagtggctcacacttgtaatcccagcactttgggaggccaaggtgggaggatcacttcaacccaggagttcaagaccagcctgggcaacatagcaagacccagtatctccaaaacattttgtttatttttttgagactgagtctcgctctgtcacccaggctggagtgcagtggcgtgatctcagctcactgcaacctccgcctctcaggttcaagcaattcacctgcctcagcctcccgagtagctgggactacaggcgcccaccaccacgcaggcactcacccccaagcccagctaatttttgtgtttttaggacagtcagggcttcaccatgttggccaggctggtcttgaactcttaacctcaagtgatctgcccaccttgacctcccaaagtgctgggattacaggcataagccaccacgcccagccgccaaaataacttttttaaatgagccagggccaggcacggtggttcatgactgtaatcccagcgctttgggaggcggaggtgggcagatcacgtgaggtcaggagttcaagaccagcctggccaacaaagcaaaaccccatctctactaaaaatacaaaaattagcagggcatggtggcgggcgcctgtaatcccagctactctggaggctgaggcaggagagtcgcttgaacccaggaggcaggggatgccgtgagccgaggtcgtgtcactgcattccacctgggtgacagagcaagattctgtctcaaaaaaaacaataataaataaataaataaaatgagcttggcatggtggtgcacgcctgtcatatcagcgactcatgaggctgagtcaggaggattgctggagcccaggagtttgaggttgcagtgagctatgattatgtcactgcactgcagtctgggctgacagagtaggatcctgtctgaaaataattaattaaatgcagatagtgtcaagagtgggcataatacacattaaggcttttatttttccaagctcgtctccacacatcatttaagctagctgatttagacttccccaggtatgcaatagactctctcccctcctccccgccccccactccgtctccattggcagtagtggaatgggttaatttgaactgtcctcatattcccagttgaagggagacctgaagaggtcacagaggaagaggagtcagagatcacgataagcttttagagaaattttcaaaaagaagagcagaaatcaaaccgtgagtgtctataggtcatggttgcagaagaaacaagtatcccgcaacattgttcagattctgttaggagcttgtgtttgaacaaaattcataaattgaagtcctaaagcccagggcctcagaatgtgactgtgtttggaaataaggtctttaaagtggtgattaaggtaaaatgaggtcaccagagtgggccccgatctaattgaactggtgtccttataaggagagcatatgaggacacggacacacacagagggatgaccctgtgaggacacagagagaaaccaaggagagaggcctcaggaggaaccagccctgcccacacctggatctcagacatccagcctccaggactgtgggaaactcaatgtctgttgtatataagctgcccattctatggtaattctgttatagcgcctgaaatggactaagacatctcaggagaagaggagatgaaaacacacagagggacgaccctgtgaggacacagggagaagatggtgtctacaagccaaggagtgaggtgtcgggaggaaccagccttactcacactgtgatattgaacctccagcctctggaattgggaggaaccagccctacttacactgtgatattgaacttccagcctctggaattgtgaaaaataaattttggctttttaagcaacctccagtctccttgagatactttgttataacagccctagtaaagtcataaagatatatggttatttttttccagtaaaccatgtgaaagaaacacaggatcaatatttaagcagaatatatatctacttccaaaagggtacaacaattttctgtgttttctaggttgtgaatatcaccttcatgagctttctggatctgactgaattttctatatgcacatcaacatttgcatacatgtctgaatcgacacctaagtagctcacattaggtataagacacaactaactctgccaggcgcagtggctcacacctgtaatcctagcactttgggaggccacggcaggcggatggcttgagctcaggagttcaagaccagcctggccagcatatggaaactctgtctctactaaaaatacaaaaattatccaggcgtggtggtgcatgtctgtaaacccagctactcgggaggctgaggtaggagaatcactttaacccaggaggtggaggctgcagtgagccaagattgcaccactgcagtccagcacgggttgacggactgcgatcctgtctcagaaaaaaaaaaaaaccgaaaaaacaaaaaacacaagtaactgtaaaagtcatcacctatgataacatgcatgccaagtctcgccagatgcttcgctgtagaatagccaatgccatctgtccctcccgtcactatagcgacacggtcaggtcgtggggggaaaactgaaaaagaagaagagaaaatcatcaaactaagatttgaaagcagagcacatatttgtaagaattaagcctccagagaggcaagatgccaaagggagttatggttcatttatttctggttctgttcctcttgaattcccacaggctcaggaggcatgaatgtattaaagtggattcgcccccagtaatgacagtgcagtaaaaaaccacctgataaatcccctgtcatcccctgtgagtccctggcaggctctgcaatatgccgtcagtgtgaccggcagaaaggtctgcagaacggataccctttacagaggcgagcaagaatcctggaataacctctgctctcagggcagcactgagcaggacatttttgttcgtttgcgttgtaaaatgtagactttattatgatgtaggtatggtggggccaacagatcaggagactgccgttaagcaagtggtttgttactcacaggtcccaagaggaggggcgtgttgacaccactcaggaccacacaggggcgcaccaagtttggtcaggtgggaagacaaaggagaccagagctctcactgtggtttccaagggaaggaacaggcgagtaggcttacagttggctagtgtgaatgatttcagcaggctctggggcataggggctgtccctgactctctggtacctggctttggggtggttagggcaggtggagagtgacgtggaatatgcaaccccaataaaggagatggctggggggtggattctggattgatgggtttgcatatgaaagacaggttcataggtgggctcttcaccacctctggggattcgctagctatgggaggggcagggtctctagggttgacaaggccatgaaagtcatgcatcagaacacagaaaataaaagacttggttaatacagtttgcttcatagctgctggtatcacacgtgcagatagcatctcacttgaatttctggttaagacgagtgatccacattttgagggagatttgtatttctttttcttccttccacttgtcctcccttccttctctccatctttccttccttccttccctctttccttccttcctccttccttctctttttcctttcttccttcattccttccttccttcattctttccttccctccctctttccttccctccctccttccttccttccctccctctttcctttcttcattccttccttccctccctttttccttccttcctccttccttctttccttccttccttccctctttcttttcttcattccttccttccctccctctttccttctttcctttcctctttccctcctttcttctttacttccttgtctcactccttctttcttcttttcctttttccttccctccctttccttcctttctccttccatcctttcctcttcacttctttctctcactttttccttccttccttcccttcccttcctttcctctttacttccttctctcactctttccttccttctttccctctttccttccctccctctttcctttctttcctccctctttccttcctttcttcctccttccttctgtccatcttctaacccttccctccttcttttataaaatatgtgtagagcccacactctgtgcccagcatacagggaaatgaattagacaaagataaacatgttgtctgcctcaaggacatttggttcccctgggaaagataccaaccactctaaatacacagatgtgtctggcaataatgcagaactttccagatctcacatcttccagttatgaatgaacttcaaaggaagaagaggaaagggagaagcagtgattctggacggagggttagagaacaatcttccaaggaggggctcctgagctgatgttgtgacggtgagagcaaaagtctagcaggcctgggatattccaggaagaggaaggcggctggctggctagctggagccaagcacatggaaggagggaagagaggagggaagaaggagtaggggcaccccagagttcgtgagcttctctctggcagacagggcgtcatcacggggctctgagccaatctgtgatatgtttcacaggaaggaatagattcatggagaatccacttgagctggaggaagacaaggctatcaagggtctcctgaagcagctgcagggactgacgggggagctccgccacagttcagcacaggtggtatgagaggtgctggattcagaatatgtctcacaggtactggccacaggggtgctggtgggagtcagacttctcgcgttcaaaataaaaagaaatcacaagacaaggacagagagggggacatgatgaggcaagaatgactccttgtactgggggctgagaaaattcaaggagggaatttccatgaattcccttgagaaagaaagactgagggaaaagtggattttgcaggcaggtagtcaggaaagtccctttctgtgaattattataggcacatatgatctttttcaagttaggagattattttgttcaacatatttggaatgttctttattaaaatataaagcctaagtgtccaccatcagacaatttgattttttaaaatatggcacatatataccatggaatactacacagccatgaaaaggaatgatgttgtgtcttttgcagcaacacgaagggaactggaggccattatcctaagtgaaatggctcagaaacagaaagtcaagtaccacatgttatcccttataagcgggaattaaataatgtgtacacgtcgacatagagcataaaaaatagacatcgaggactcagaagtctcacagggtgggatgggatgagggatgagaaattacctattggctaccatgtacgttatttgagtgatggcctcactaacagcccaaacattaccactatgcaatatattcatgtaacacaagtgtactcatacccacaaaatctataaaaatacaaaggtaatttaaatagaaataggtttataaatcattccactataacgacacacacacgtatgtttattgcagcactgttcacaatagtaaagacttggaaccaacccaaatgcccatcaacgatagactgaataaagaaaatgtggcacatggacaccatggaatactatgcagccataaaaaaggatgggttcatgtcctttgcagggacatggatgaagctggaaaccatccttctcagcgaactaacacaagaacagaaaaccaaacaccacatgttctcactcacaagtgggagttgaacaatgagaacacatggaaacagggaggggaacatcacacaccagggcctgtcaggaggtgagggactaggggagggagagcattaggacaaacacctaatgtagatgatgggttgatgggtgcagcaaaccaccatggcacgtgtatacctatgtaacaaacctgcacgttctgcacatgtaccccagaacttaaagtataataaaataaaataaaacaataaagcctatgctgcttttccatttcacctttccaagtataaaatgttgtgtctcctctccccccaaaataattcctatgttgagaacatacaatcgccagggtgatggtatcaggaggtggggcctgtggaggaggcttcaacatataatctgttatttgtcagcccgtacatttcgttgtcagtattgtgcgaacaatcctcttggtgtgtaagactttcattttgtttttcttgatacacgcatgaatcgatgaaaaggtatgttcacttagaaaattgccgaataagttttccatatgcttaggttttctggtgtatccctcgtaacctgaagatagaacctgtacaatgacattcccgtgttcctgacccaagctgagggacttgcaaatactatatgtagtatcagtagatgtattgatgttcttaatttactaagtttattttaaaaataggaatgtattattaaattgtaattacagacacacagtatgcatatatactgtgtatgtatacatgtgtgtctgtgtgtgggtgtgtctgtgtgtgtacatacatatttctcagccccaatgccaacttcctagtcaataaagaaatctctaaaatcttccagctaaacttggaaaagcagcaagtatccatcctgttctctgtgatgcttttttttttttttgagctggggtcttactacattgcccaggctgcagtgcagtggtgcaatcatggctcgctgaagcctcgacctcctggactcaaatgatcctcctgcctcagcctcccaagtagctgggactacaggtgtgagccaccacacttggctaattttttttactattttttttttgtaaagatggggtcttgctgtgttgcccagaccggtcttgatctccggggctcaagtcatcctcccaccccggcctcccaaagagctggattccaggagtgcaccctgtcatttaacatgctactggagatcttatccaacatggtcagacaaataattacaacagacacaagaacggcagagggagagtcaaaatatactttgcagatgatatgatggtatgccaggaaaaaactaacaaaatcaacattaaataaatccaagaagagaattcaggaaggtagtcagatagaaaactcagaagcaaatatcaatagcttccatacatacacaaacaattggcaggttaaaaaggtaggggaagagacagtcctgcttataatatagaaacaacagcaacactgaaatgagacttggtcatcgagagtgtgcaaaacctatatcaggaaacctaaagacataaaagtagagttgaggccatggaaagatgccctcgggtctcggtgaggatgtcatgccacatggttttggaggtgcccgtggggtcttccctgaaaacgcacagtgagccgtgattgtgccactgcaccgcagcctgggcaaggtagcgagaccccagctcaaaaaaaaaaaaaaaagcatcacagattgcagaatggacccttgctgcatttgtaactttagctagaagagtttagtgttttccttacggaccaggaagctggcattggggctgagaagtatgtatgtacccacacagacacccccgcacacaacaggttgcaacaatcgcctgacaccagccacccggtgcctctgcagatggggaacatgtttcgcaagatcgggcttcctcagggttttgggttttcacagccaatgactcggcatgaccagagaactggctggacgctccttctacccaattcctcgccgtctctttcttcacaggtgtgaggcacctacaccatcacctgcaagccttcctccactcttctgccagcgcctgtttgacccttcacacacagttcccctagtaaatctctggcccatcatgttccttcttggtgtgtgcttctccaaagacccaaatgggtcaggcgcagtggctcatgcctgtaatcccagcactttgggaagccaaggcaggcagatcgcttgagcccaggagttcaagaccagcctgggcaacatagtgaagccccattgctacaaaacaaaaaaaaaggtacaaaaaaattagccaggcatggtggcacacggctgtcatctcagctacccgggaggctgagttcagaggatcacgcaagactgggaggttgaggctgtagtgagctccgatcataccactgcactccagcctgggtgacagagcaagactgtctcaaaacaaaacaaaaaaaagacggccgggcacggtggctcatgcctgtaatcccagcactttgggaggccgaggcgggtggatcacgaggtcaggagatcgacaccatcctggctaacacggtgaaacccggtctctactaaaaatacaaaaaattagcctggcgtggtggcgggcgcctgtagtcccagctactcggaaggctgaggcaggagaatggcgtgaacctgggaggtagagcttgcagtgagccgagattgtgccactgcactccagcctgggcgacagagctagactccatctcacaaaaaaaaaaaaaaagacaaaaaaaacccccaaactttgtccaatccggagttgacagacacctaagtttgattccatgtctttgcttttatgaatagtgctgcgatgaacacacagtacgtgtgtctttttggtagaatgacttactttcccttgggtagatacccagtaatgggattgctggctcaaatgttaattcaattcttaggaagacatggtgcatctataccatggaatactatgcacccattaaaaagaatgaaatcatgtcctttgcagcaatatagatgcaagaggaggccattctcctatgtgaattaacacagaaccaggaaactaaatatcagacgttctcacttcttactgggaggtaaacatcaagtacagatggacataaagatgggaacaataaacactgagcaattcaatggggcaaggaagggatggggcaagggttggaaaactattgagtgctgtgctgactacctgggtgacgggatccttgtgctccaaacctcaacatcacacaatatacccagggaacaaacctgcacatgtacccccgaacctaaaatagaagttgaggccagatgcggtggctcacacctgtcatcccagcactttgggaggccgagacgggtggatcacgaggtcaggagttcaagaccagcctggccaacatggtgaaaccgcatctctactaaaaatacaaaatttagctgggcgtggtggtgtgtgccacctgtaatcccagcgactcgggaggctgaggcaggaggatcgcttgaacccgggaggtggagcttgcagtgagctgagatcacgccagtgcactccagccagggcgacagagccagactccgtctcaaaaaaaaaattttttttaatttaaaaaataaaatagaagttggagggggaaaaaaaatctaaactgatacaatcctaaaggtgtcagaatgacccaagtcaatatgcaaatttgatgtgatccaataaagatagttcacagaatttcttttaggcaaactggacgaatcgattcgaaaattgctgtggggaaaagaattccaaatgaggcggcaaagaggaaaattctgatatgtacaaagattgagaacacaatggccctgtaggagattaaaacatttgagaagcttctataattaaacgggaggtactacaggcattaatggaggaaggaacagggtacaatttccaaaaataggccaactgcatgtggaaattgagtacacgacaaaaggggcaaaagatgggcgttttaataaaccgtgttggggcacgtgaagccacattaggaaacagataaaattagtgccagacctcatagcatgcatgagtgaactccaaggcaaaaacaaagttaaaccatgagaagattgcaagaaagcaggaatcattagtttaacctccacagaaagaaaatgcttcctaaacgaaaattcagaaagatggttagatagatttcactatttaaaaaactacttgtttaaaaaacaggccgggcagtggctcatgcctgtaatcccagcactttgagggctgaggtgggggtatcgcttgaggccaaaagctcaggaccagcctgggaaacagagagaggcctcatctctacaaaaaatttaaaaaattaaccgggtgtggcggtgcgtgcctgtagttccagcaagctgggaggctgagatgggaggatcacttgagcccaagggatggaggttgcagtgagccaagatcgtgccactgcactccaggaggaacaagacactatctcaaaaaaaaaatcacatggtaaaaaacaaaacaaatctccataagcaaagtaaaaaataaataatgagctggaagaaaatttgcaacttccatcagaaatattaacagctatttttcagatatctaaaaagttcaactccagaaaaaccccaaacatgctacaaagaaaagggcaaaaataagagtttatatacagaacaggctcaaatggccctcaacacatatgttctcctttatatctaataacagacatcctaattcagaccatattgaaatactatttcttttttttttaaagttctgggatacatgtgtagaacgcgcaggtttgttacataggtatacatgtgccacggtggtttgctgcacccatcaacccatcatctagcttttaagccctgcatgcattaggtatttgtcctaatgcgctccctctccttgttccccagcccccagcaggttctggtgtgtgatgtccccctccctgcgtccctgtgttctcactgttcagctcctacttgtaagtgagaacatgtggtgtttggttttctgttcctgcgttattaggctgagaatgatgccttccagcttcatccatgtccctgcaaaggacatgaactcatcctttttatggctgcgtagtattccatggtgtatttttctaaccttttcttttttgagatggagtctcgctctgtcgcccaggctggaatgcagtggcgcaatatcagctcaatgcaagctccacctcccgggttcacgccgttctctcacctcagcctcccgagtagctgggactacaggcgcccgccaccacgcccggctaattttgtttttgtatttttagtagagacagggtttcactgtgttagccaggatggtctcgatctcctgatctcgtgatccgcccgcctcggcctcccaaagtgctgggattacaggcgtgagccaccgcgcccggtctataaagagctcttctaaccaaaccccagtccctccacaaatgggtaaaggaaatgaatatgcaatttggagatatgaaataaaacataagcatatgaaacaaagttcagtctcgctgacaatgaaataatgaataaagcaattgtgagctttcatcaatcacatggaataggttaaaaagtagggttgttatccagaatgcgtatgccttggagaagttagaagtttacatactcagttcaaatgtacccaccaagactgcattttcttaggagataagttgacaatgactcctgaaaggtgacaggcagccaggcctggtagcttatgcctgtaatcccaacactttgagaggccaaggtgggaggatcagcggaggctaggagcacgaggcccagcctgggcaacatagcaagaccctacctctacaaaaataaaaataaattagccagacgtggtgatgctcgcctgtagtcccagctaccctggaggctgaaatgggaggatcactggagcccaggaggtcgaggctgcggcaagctatgattgcaccactgcactccagcctgggtgacagagcaagacgctgtctctttaaaataaagaaaagaaaatttacatgcattttctttttggctcagctattccacttccaagaattacttgcacagatacactcccacacatatgctaagatatacgagaaaaccattcatggctgccttgtttagaatcaaaaaccatttagtttcatcgccattttataaaagactttttgcaggtgttacttaaaaagaaacatcttattgttcttagcaacaacttggatggctctccagggaattctattgagtgaaggaaaaaaagacacacgtgatttgaaaggggttacactctgtatgactccatttatatgacattcttgacatgagaaaaggtacagaaatagagaacagactagtaattctcaggggttcaggacaggagaggaggttgaggtaggatgcaggttggtacagaaatagagaacagactagtaattctcaggggttcaggacgggagaggaggttgaggtaggatgcagagagagaaacaggaggggttgttggtgaaagaaatgctctgtgtgttgcggacaatgctggcttcacaaacctgcacgcactatgaaattgcacagaactcggtacaaaaacccacacggatacgagtaaaacataagatcaatgcattattgcctgaatgtgaatatcctccttgtgacatggtattattgctttccaagatgttaccactgggggaagtagacacaagattctttcctattatttcttacaactgcttataaatctacaatgatctcaaagtaaaaaccttaattggaaaaaaaaaaaaaaagtctaggcaggaagcagtgggtcacacctgtaatcccaacactttaggaggtcagggtgagacaatcacttgaggccaggagtttgagatcagcttgggcaacatagcaagaccccatctctacaaagaaatttaaaacttagccaggcatggtggcttgcatgtgtagtcccaggtacgtgggaggctgagatgggaggattgtttgagcccaggacttgaaggctgcagtgagctatgattgcattactgcactccagcctgggcaacagagcaagatcctgtctctaaaaataaatgaatagataagtaagtaaataaataaatctatgcttacgccatatgatatttcattcttaaaaaacaggaaaaacaaaagtcctatccttcttgatcctagtacagttgttttgaaaatatctatatgtttcatgggggctgggcgcagtggctcacgcctgtaatcccagcactttgggaggccgaggcaggcggatcacgaggtcaggagtttgagaccagcccaatcaacatggtgaaaccccgtctgtactaaaagtacaaaaattagccgggcatggtagcacgcacctgtaatcccagctactcgggaagctgaggcaggagaatcacttgaacccgggaggcagaggtagcagtgagccgagatcacaccactgcactccagcctgggtgacagagggagactccatctcagaaaaataataacaacaaaaataaataaataaataataaaacaaaactaaaaaaataaaaactatgtgttttatgattcccgtttgaactgctgatcttcccacaccctggtcccttcatctaacactgagggctggagacacagtgagttttgtctactgtcatgagcttcagggcatggcaggtacaggtgttgagtttttgttgttttatcatgaggttggtgcaaaagttaatggcaaaagcagcaattacttttgcagcaacatattattattattattattattattattattattattactactactactactgatagggtcttgctctgtcaccccggctggagtgcagtggtgaaaacacagctcactgcagcctcaaactcccagacttaagcaatcctcctgcctcagcctcctaggcagctgggactacaggcacgtgccagcacatctgccagttttttttttaatcttttgtagagacagggtcttgctccattgttcaggctgatctcaaactcctgttttcaagtgatcctcctgcctcagtcccccaagtagctggaactacaggtgtgtgccaccatgccccactaatttatttttatttttgtagagatggggtctcactatgttggccgagctgatctcaaactcctggcctcaagtgatcctcccaccttggcctcccgacgtgttgcaattataggcatgaacaggctacagaccccaccgtcatctcctccatcaaagaggttcctgaactttactttcatgtttggtatacactgccttgaatcctttctctttttttgagaccgagtctcgctctgttgcccaggctggagtgcagtggtgcaatctcggctcactgcaagctctgcctcctgggttcatgccattctcttgcctcagcctcccgagtagctgggattacaggtgcccgccaccacacctgactaattttttttgcatctttagtagagatggagtttcaccgtgttagccaggatggtctcgatctcctgacctcgtgatccgcccacctcagcctcccaaagtgctgggattacaggtgtgagccaccatgcccggacacaaggtcatattgaaaagatgctcagccgagtctggtggctcatgtctgtaatcccagcactttgggaggccgaggtagaaaaatcactaggtcagaagttcaagaccagcctgaccaacatagtgaaaccccgtctctactaaaaatacaaaaattatccaggtgtgatggtgtgcccatgtggtcccagctactcaggaggctgaggtgggaggattgcttgagcctgggagagcaaggctgcagtgagccatgttcatatcagtgcactccagcctaggtgacagagcaagaccctgtctcaaaaaaaaaagaagaagaaaaaaaagcatcatttcattgttgatataccattgtttcctaagagagacagagagagagagagagagagagagagagtgtgtgtgtgtgtgtgtgtgtgtgtgtgtgtgtgtcacagtcctcaaatttgggagagtaaagtgaagatgaccagcagccaaaaacccaacaaagctggtcccaggaacacattttcctgatatgcagtgtaacttaggttcttatagaagaaagaccgtgtcactcaaccaccataattaagaaccttcagagtccaattcatgaaaactcaccggcagaacaatatgtggcaaccattctaagcgaacctcagatgaagcaccttgaaggcttcacgagcctgtgtgctattggataaccatggggaaaaaaaaaaaactgaattctggccgggcgcggtggctcatgcctgtaatcccagcactttgggaggccgaggcaggagaatcgcttgaacccgggaggtgggcattgcagtgagccgagatcatgccactgcactctagcctgggtgacagagcgagactccatctcagaaaaaaaaaaaaaaaacctgaatggtcattcattttaggaacagaatgatctaggagtattggactgcagaggagagggagggagagagcagctggagcttcatatagttacacattacagaatgcatacacacacacacacacacacatatatatgcattcatcttaaagtaagattgacagcaaagcatcaataaagactgcaaaccggccacgtgcagtggcttcacgcctgtaatcccagcactttgggaggctaaggtgggctgatcacctgaggtcagaagtttgagaccagcctgactaacatggtgaaaccccatctctactaaaaattaaaaaattagccgggcgagatggctggcgcctgtaatcctgcctcaggagggtgaggcaggagaatcgcttgaacccaggaggcggacattgcggtgagccgagatcacgccactgcactccagcctgggggacagagcaagactccatctcaaaataaaaaaaaaaaaaatggtcgttcatttcaggaacagaatgatctaggagagtactggactgcagaggagagggaaggagagagcaggtggagcttcatatattcacacattacagaatgtatacacatacatatatatgcattcgtcttaaagtaagattgacagcaaagcatcaacaaagacctgcaaactggccagttgtggtggctcacacctgtaatcccaacactttgagaggccgaggtgggtggatcatgaggtcaggagttcaagaccagcctggccaacatggtaaaaccctgtctctactaaaaacacaaaaattagcccagcgtggtggctggcgcctgtagtcccagctactcaggaggctggggcaggagaattttttgaacccaggaggtggaggttgcagtgagctcagatcatgccattgcactccagcctgggtgacaagagcgagacttttttgtctcaaaaaaaaaaaagcttaaaaaataaaaacagcttaaaaataaagtaaaataacataaaagcttaaaatataaaataaaatttaagaggtcattcatttcaggaaaagactgatctacgagaattggactgcagaggaaagagagggagagagcagctggagcttcatatattcacacattacagaatgtatatacatatatatacgcattcatcttaaagtaagagtgacagcaaagcatcaataaagaccttcaatccatactctgacaagttcctttgtccagtggtcctcaagctttttggcaccaggaaccagtttcatggaagaccatttttccactgatgtggggtgggggatggtttggggatgattgaagtgcattctatttatcatgcactttatttctattattattacactgtaatagagaatgaagtaattatgaaactcaccatcgtgtagaatcagtggaagccctgagcttgttttcctgcaactagacggtcccatctgcgtgcgggtgatgagagccagtgacagatcatcaggcattagattttcatacggagcacgccacctaggtccctcacatgttcagttcacagtagggttcatgctcctatgagactctaatgccaccactgatctcataggaggcagagctcaggaggtaatatgagctatggggagcagctgtcaatacagatgaagctttgctcactcacacgctactcacctcctgctgcacagcccagttactaaaaggctggggaccggtactggatgcaaggatacaaggatgcaagagatgctaaaattcattaaaatgggtccacggatgccctgcattcttcacactctccaattaatcttgtgaattcagcattgagtcactgaaggtcacagtgagtcccacttctgatttacccacttttgaaatgaacagaatgcagaaaggaaaacaaggtcagtagcatctgtcagcaaagtttgccaacggctgtacccacacaaagaagagaggtgtgtctgtcttcttatttgttcttttttctttttcttttttttgagacaaggtctcactctttcacccaggctggagtgcagtggggcaatcatggctcactgcagcctcaacttcccaggctcaaccaaacctcccatctcagcctcctgagtagctgggactacaggtgtgcaccagcatggccagataatttttgtgtttttttgtagagacagggtctccgtatgttgcccaggctggtttcgagctcctaggctcaagcaatccacccaccttggcctcccaaaatgctgggattacaagcagaagatgccgcatccagctcatttctgctttttaaatgtttttctttctttctttttttttttgaaacggagtctcgctctgtcacccaggctggagtgcagtggcgggatctctagccttcatctttctcccatgctggatgcttcctgccctcgaacatcaagaccccagggtctttgggttttggaccgttggacctacaccagtgatttgccaggggctcctggaccttcgaccacagactgaaggccgcactctcagcttgcctacttttgaggttttgggccttggactggcttcctggctcctcagcttgcagacggcctattgtgggacttcaccttgtgatcgtgtgagtcaattatcctagtaaactccccttcatatacacatcagtcctattcgttctgtccctgtagatcaccctgacttgaacagcatgaagagcaacgctgtaaccagccctgtcctgactgaggcagccgaatgagaatcagcaatgaggagctacagacgacgcagacggcaccagtagctaccgcccaggatgcatggacactctagtttccacagccacattcaagttctggaacaccacggcttccggctgtcttcagtgaagacggagcacgtgtcagtcccagggtgcaatgatcacacctcggagctttccaaaattctatctcatcacgttcaccaacaaagacatccaaggagcagaattcaaagtcaaggaagcctgtgaaattcacaaggagcaagaagaacaaaggctaaggactatttgacaggaggggaagaggcctggtccctgggttctccaaggcaacgcggtggaatgtgttttgacgtgtcttcaagtctgaaaggaacctggtccttccattccctggatgctatgtctctcttagtggctttgcaatgatgtcatctgtggacacagatctgcatgagtgacagttctgcagagaaacaaccagtaggatatatatatagagagaaagagattttaaagaactggctcccaagatgtgggggaggggcaaaaccaaaatgtgcagggtagaccagcaggccagatgcccatggagacatgatgtcgcagctcaagtctgaaggtggattccagatagaattccctcttccttggaggagggactctttttacctcttaagaccttccactgattaggcaaggcccacccacattatgaacagctatcggcttcactcaaagtctactgaaaatctcattattgggtacacacccagaggaatataaattgttctaccataaagactcacacggctgggcacagtggttgacgcctgtaatctcagcactttgggaggctgaggcaggtggatcacgaggtcaggagttcaagaccagcctggccaacatggtgaaactccgtctttactaaaaatacaaaaaaaattagctgggtgtggtggcgtgcgcctgtaggcccagctatttgggaggctgaggcagaagaattgcttgaacccagaaggcagaggttgcagtgagctgagatcatgccactgtcaatcaacatgtattttgtatttatatatattatatactacattctcaacacatgtttgtatttattttgtgtttctatgtattatatactgcattcttacagtaaagtaagctagagaaaagaaaatgctattaagaaaatcttaaggaagagaaaacatatgtactactcatcgagtggaagtggatcatcctaaaggtctccatcctcatcgtctccatgctgaagaagctgaggaggaggaggaggaacaaaaagggttgttcttgctgtctcgggggtggcagaggtggcagaaaatccacatataaatggacctatggagtttacacctgtgttgttcaaaggtcaactgtatatattataatatatatgatatatgatgatatataattacattgtataatatattatgggtgtctatgtgtgtgtgtatatatatatattcagttccatccaggtatggataataaagcccagtacgtatgcaacacactggccatcagcgtcacgcctagttatcatgctggccggtaaacaacgtgtctttgcagtcctgtgcctgagatcatacccttcccagtgccacaggtccccaaatcactgcattatttctagaaaaacccagccgcgatttcctagaaacaagaaccccaggaaatgtaatcaagtaccatcttctggaaattgagacatctgagatgaaaagtgtgacttgttaactgccacgtagaagctctcaggaatattccctttccgaagacatttgtacaaactgaagggttctgtactaacagagaatgctattgcctctttccccaaggaaacacagcttaaggaatgttcccctcaatgcaccatctgtcaccagacacgtgcgtgttccgtcacatgtcactatgataagacaatgacttgtgtgtgtgtcaatctagaagctgagtattaccttgaaatcaagagggaggcggagtttctcaacctcattttactttttatttgtgtttcgtagagacagggtctggctctgtcacccaagctgtagtgcagtggtgtgatcatggctcactgcagcctccacctcctgggctccagtgatcctcccacctcagcctccaaagtagctgggagcagatgcacaccaccatgtccagctaattttttttaaattttatatagacgggggtctcactgcgttgcccatgctcctcttaaactcctggactcaagtgattttcccacatcagcctccgaaagtccagggattacaggcaccagccaccgtggctggccctcaaccttactttagcccaggggtctaactcctgggcagatatcctaagattcttacagaaaaccaaaggcaaacaagtccagtcaaggcagcatgcaaaaccaccatacttggcaagtgatgtacattctctacccattctccaaggggagttctgcctctccggacacagcaccccgaaacgagaccctgttactcaaatgagctgcatgacaggggaaatgatggatcaagcaatgacagcatttgggctctgctcttatttttaacttgtatcacatgctgggcaccgttacactcacctggaagcaatgctttaaggacaagttctttccaacagtgagaataactcgtgtgagagaagatgagatggtaaaaaaaagagccaatgggccgggcacggtagctcacgcctgtaatcccagcactttgggaggccgaggcgggcagatcacgaggtcaggatatcgagaccatcctggccaacacagtgaaaccccatctctactaaaaatacaaaaaattagccgggtgtggtggcggaagcctgtagtcccagctactcgggaggctgaggcaggagaatggcgtgaacccgggaggtggagcttgcagtgagctgagatcacaccctgcactccagcctgggcgacagagcgagactccgtctcaaaaagaaaaaaaaaaaaaaaaagggccaatgaccatggccaattccaagcctgagttggaggcctggaagccattggggaaataacctaccatcaccgttttccctctaaaaatctaaaatctgcttattccacagcccctcagtaggctgctactgtttgtttttagccgtctactaaatttcattgatacatgtttctgccttcttggtgatcccaaatacaacaatttattcacacatgaaattgaaaatgtgataattctgcaagcacacaccccttaagatatgactctcagctcacaggctttctcctctaaacatttatattcagtaacaggtatttgattcctcttgaattttaatgaggaaggcacttacgaggactcttagaggccgtgtttaagggtcattcattatgccctccattaaatcaagtggcaacagcaaaccatgcaggtgaggagacctgggcggcagacgggacagtgtctgagggtatgtgtttgggtttctctagctgttgaacaattacacacatgagggactgggcactgtgccccatgcctgtaatcccagcactctgggaggcccaggtgggaagatccattgaggcccagagttccagacgaacctgggaaacatagtgagacgccatctctacaaataatttttttaaaaacttgcctgggcatgatggcacacacctggagtcccagctatcatgaggctgaggtgggagcatggcttgagtccaggaggtcaaagctgcagtgagccatgatcatgccactgcactctagcctgtgggacacagcaagacccagtctccaaaaaaaaaatgttaaaaattaaaaataataaaaaattaggctgggcggagtagctcacacctgtaatcccagcactttgggaggccgaggcgggcagatcacctgaggtcaggagttcgagaccagcctggccaacatggagaaaccccgtctctactaaaaatacaaaaattagctgggcctggtggcggacaccggtaatcccagctactcaggaggctgaggcgggggaattgcttgaacccaggaggtagaggttacagtgagccaagatcgcaccactgcactccagcctgggcaacaagagtggaattccgtctcaaaaacaaagaacattagatagtaccggacacgctgggttggacacagggccgaaaagggctaactataaacaacttttaggcaatttccgaaaaagttgcatgtcagaaaaaggaaaggtgggctttcccaggaactgcgtaccacctatattttgccgtgaccaggatttttatataagcccacgtcctatgtgtatttcacagcactaaccttcaccttcaaaacaaggagcgtttctttgactcctccttcttggaaaatttatcaatcaagaaaaaaaaaagcttaaccattactgtatttttttaaagaatggtatttgctactatctgaaagtttgtgttcctcccccaaattcctgcgttgaaatcctcacccccaagggaccgctgccgtgggcacactgaagactttccctaagaatgcggccaagggaccgctgccctgtacacaaggaagaggttccctaagaatgcggccaagggaccaccgccatgtacacactgaagatgttccctaacaatgtggccaagggaccaccctgaagacgttccctaagcatgcagccaagggactgccaccgtgtacacactgaaaacattccctaagaatgcagcaaaggaacagcactgaagatgttctctaggcatgtggccaagggactgccaccgtgtacacactgaggacgttccctaagcatgtggctaagggactccgccatgtacacactgaagatgttccctaagaatgtggccaagggaccgacgccatgtacacactgaacacatttcctaagaatgtggtcaagggaccgcactgaagacgttccctaagaatgcagccaagggaccgctgctgtgtattcactaaagacattccctaagtttgtggctaagggaccgccatcatgtacacactgaagatgttcccgaagaacgtggcaaagggaccgcactgaagacgttccagaagtgtgcggccaagggactaccaccatgtacacactaaagacattccctaagaatgtggctaagggactgccgccatgtacacactaaaaatgttccctaagaatgtggccaagggacccacaccatgtacaaactgaagacgttccctaagaatgtggacaggggactgccgctgtgtaggcactgaagacattccctaagcatgtggccaagggacctcactgaagacgttccctaagaatgtggccaagggaccgccaccgtgtacacactgcagacgttccctaagcatgtggcccaagggacgacagctgtgtacacactgaagacggtctcgaggcttgtggctaagggaccaccgccatgtacacactgaagatggtccctaacaatgcggccaagagaccaccgccatgtacacactgaagacggtccctaagaatgcggccaagggaccacctccatgtacacactgaagacattccctaagcatgggctaagggacggtagccatgtacacactgaagaagttccctaaaaatgtggccaagggaccaccgccatgtactcactgaagatgttccctaagaatgtggccaagggatcgacaccatgtacagaagaagacgttccctaagaatgtggacaagggactgccactgtgtaggcactgaagacattccctaagaaagcagccaagggaccgcaaggaagatgttcccaaagaatggggccaagggaccgttgcagtgtacacactgaacatgttagctatgtatgtggctgaggggccgccgccatgtacgcactgaagccatgtacgcactaaagacattccctaagaatgcagccaagggacggcactgaagacattccctaggcatgaggccaagggaccgccacgggtacacactgaagacattccctaagcatgtggctaagggaccaccgccctgtacacaaaccgtgtacacactgaagatattccctaagaatgtggccaaggaacagcactgaagacgttccctaagcttgtggctaagggaccaccgccctgtacacaaaccgtgtacacactgaagatattccctaagaatgtggccaaggaacaccactgaagacgttccctaagcatgcagccaagggactgccaccgtgtacacactgaagacattcactaagaatgtggctaagggactgctgccatgtacacactgaagatgttcccaagcatgtgaccaagggaccaacgccgtatacacactgaagatgtttccaaagaatatgaccaagggaccgccaccttgtacacagtaaagacattccccaaggttcagtcatgggcctgtgaaacatcacaggaaagaatgatgtgcaggatccagttattccaccataaggtgtgtacccaaaggaaaggaaatcagcccatcaacgggatacctgcaccccctgtgcactgcagcactactcacagtttccaagatatagaatcaacccatgtgtcaatcaacacatgagtgcctcaagcaaatgtggcatagacacacagtggaatagtatgcagccatgaaaaaggaaatcctgccatttgcaacaacatggatgggactggaaaatacaatgtgaagtgaaataaaccaggcacagagagaataccatatcatctcgtatgtagaatctaaaaaagctgaatgcataaaagcagagagtgcaatggtggttgccagggaagaatgcttcatgaagtgtttgtcaaagaacataacatttcagttggaggccaggagcggtggcttatgtccggaatcacaatgctatggaaggctgaggaaggaggaccactgaaggccagaagtttgagacaagcctgggcaacgtaatgaaaccccatctctaaaaaaaaaacaaaaacaaaaaaattagctgggtatggtggcatgcacctgtagtcccagctacttgggaggctgaggcaggaggatcacttcagcccaggaattcaagaccagcctgagcaacatagcaagatcccatctacataaaaaatttaaaaattaaccaggtgtggtggtgtgcacctgtagtcccagctacctgggaggctcaggagggtcacctgagccaggagttggaggctgcagtgagctatgaacatgacgctgcactccaccgtgggtgatagggtgagactgtctcaaaaaaatataaattacattaaaattaaattttttcagttacataaaagaaataaattcaaagatctatcacaccacagtgatcatagttaataatacatcgcatctttcaaaatgactaaaagtagattttacatattctgaccacaaaaaaaagtaggtgaggtgatataggttagagttaaggttatgtgaatatgttaattagcttgttaatatgttaattagcttgattgttaatgtgtttattagcttgattattaatatgttaattgacttgattgttaatatagtatctagcttgatttaatcaccgcacaatgtgtacttggattaaaacatcacgtacctcatatatatgtatacgattattttttgttaatgaacaatacattttctataaaaatgactcgcatttccaggcagaaagcaaaacaagtcccagttttgaggacagctgtgacatatttaatggtgtctcttcttaattcaacacagtttacacgaccatgacacaaggggttccaagtttccaaggaaaggattccagttatgtgctcaaggtgtatccacactgggccgggcgcggtggctcacgcctgtcatcccagcactttgggaggctgaggcgggtggatcacctgaggtcaggagttccagactggcctgaccaatatgctgaaaccccatctctactaaaaatacaaaaattagctgggtgtggtggcgggcgcctgtaatgccagctactcaggaggctgagacaggagaatggcttgaacccaggaggtggaggttgcagtgagctaagatcgcaccactgcactccagcctgggcaacaagagtaaaactctgtctcaaaaaaaaaaaaaaatgtgtccactctgcaccctgaccagaagagacgaccttcaaatgatcacacgaggtcatctcacaaagcggcgagtgttcccagttattactcggagggccgggcctgctcaggagggttggtgagatcaggctgtcccctaacacacaccatggcagggctcatcctcctgagtacatgcaaggtgcactgagacagctccccatagaactccaaaaatagcccagctgggaagaaatggaacattctgggggacactgattttcatattgaaatttcctatctttttaaatttattgtggttgagacagggtcacacccaggcgattgcccaacctggagtgcagtggcatgatgctagctcactgcagcctcaacctccttgggctcaggcgatccttcagcctcagcctcccaagtagctgtgaccacacacgcgtgccaccacatttggctaatttttatgtttgtatttttagacacagcacctctcgcttggttgcccaggctgtggtcacagctcactgcagcctccaactcccacactcaagtgatcctcccacctctgcctcctgagtagctgggaatataagcacatactaattttttctatttttagtagagatggagtttggccatgttgcccaggctggtctcaatctcctgtactcaagcgatccaccggcctaaagtgctgggattacgggcgtgagccaccacgcctggccatgcagctgttttaataagcaattctgagaagacacaaatgcccccctgctcttttgtaataatactaacacagattaccgaattacactgacgaaaacctcacatgcgttacctaaggaaacacagagcccccagtgttagatctgaattgtttctccacccaggacaaataagtgcattccaattagtgcctcaaaaaaaaaaggaaaaaagtaccaataaataaataaataaataaaacacagtagagcagtttcaacaaactccagcccttatttttggaaggcccacttgtcaagaacagtgtttatgtttataaatgttttttctgaatttctcaatgcttagggaaaaaaagtcaaaagagcaatattatttcttgacacaacatttatataaaatttagtaatccaaactactcaggaggctgagacaggagaatcgctcgaacccgggaggtgaaggttgcagcgagccaagatcgcgtcactgtactccaggcttggcaacaagagcaaaactctgtctcaaaaaaaaagaatgttagatagtatcggacatgctgggttggacacaggactgaagagctaactataaacaattttaggcaatttccacaaaagttacatgtcagaaaaaggaaaggtgggctttcccaggttctgcgtaccacctatattttaccgtgaccaagattttataagcccaagtcccacgtatattttacagcactaacattcaccttcaaagcaaggagggtttctgtgtctcctccttcttggaaaatttatcaaattaaaaaaaaaaaaagcttaactattactgtatgtttttaaagaatggtatttgctatatatagtctgaaagtttgtattcctcccccaaattcctgcattgaaatcctcacccctaagacaatggagtcaggaggtgggagacttgggaggtgatgagatcatggggatcgagcctcatgaatgggatcagtgtccttataaaagggaccccagagagctccctcgccccttccacgcagagaaaatgcatcatctatgaaccaggaagtgggtccccaccagacactgaatccgccacgatcttaaacctccaacctttagaactgtgagtgacaaatgtctgtagtttataaattacccaactgaaggtattttattttagcagctccctactcaggaggctgtggcaggagaatcgcttgaacccgggaggcggagggtgcagtgagctgagatcacagcactgcactccagcctgggcaatacagcaagactccatctttaaaaaaaaaaaaaaaaaagttgcatcaagaatgaaaggtgcacaaaggcagccagggatgcaagccccttccaccctgggccctggaactgcacaggccaccttcaaaggtttctttcctgtcatcctcccaagtctacacgaatataaagaaacacactagaagcctctgataggatgggggcatctccagaaatccgaagattcaggttctgaacctctgatctgggtggggctgggagctgcagttccagaaagcaaatgaagccttggctgtgattcagaccatttcttggtagcaagcgtgtaggggaagaagaatgtggacggggcaggggaaggaatgaattcggtcaggacggtggctggagaatgtctgagacggccacgtgcagagaggagcaggctggctgcgtctctcactgtgcctgggacaggcggtgacagagaaatgggattccacatgagagtcagagacacccagtgaagaaacaaaagcagcttacagggtgaaaaggacacagacagacactgacactcagaagaatgttgccaagggaccgccactgtgtatgaactgaaaaggttccctaagaatgcggccaagggactgctgccgtgtacacactgaagacgctccctaagaatgcaactaaaagacaacactgaagacgttccctaggcatgtggctaagaaaccactgccatgtacacattgaagacattccctaagtatgtggctaaggcaccactgccatgtacacactgaagacgttccctaagtatgtggttaagggactgccgccatatacacactgaagatgttcactaagcaggtgactaagggatcgccgccatgtactcactgaagacgttcactaagcatacggccaagggactgccgccgtgtacacactgaagacattccctaagaatgtggctaagggaccgccgccatgtacacactgaagatgttcccaaaaaatgtggccaagggactgctgccatgtgcacattgaagacgttccctaagcaggtggctaagggaccaccaccatgtacacactgaagacgttccctaagaatgcagccaagggacggcactgaagacgttccctaggcatgtggtcaagggaccgcactgaagatgttccctaagcatgtagccaagggactgccaccgtgtacacattgaagacattccctacgaatgtggataagggacctccgccatgtacacactgaagacgttccctaaccatgcgcccaagggacctccgccatgtacacagtgaagacgttcccgaagaatgtggccaagagaccaccatgtacacactgaagatgttccctaagcatgtggccaatggaccgcactgatgacgttccctacgcatgcggccaacggactgccactgtgtacgcgcggaagacattccctaataatgtggctaagggaccactgccaagtacacactgaatatgttccctgagcatgtggccaagggacggccgtcatgtacacattgaagacgttccctaagaatgtggccaagggaccaccaccttgtacacagtgaagacgttccaaaggtccagtcatgggcctgcgaaacatcagaggaaagaatggtgtacaggatctagtcatcccaccactgggtgtgtacccatcaatgggatacctgccccactgtgcactgcagcactactcagtttccaagagacggaataaacccatgtgtcaatcaacagatgagtgcatcaaacaaatgtggcatagacacacactggaatagtatggagccatgaaaaaggaaatcctgtcatttgcagcaacatggatgggactggaagatacaaggtgaagtgaaatgaaacaggcacagagagacaaataccatatcatcgcatatgtagaatataaaaaagctgaacacataaatgcagagggtacaatggttgttgccagcaaagaatgctgaagtgtttgtcaaagaacacaaaatttcagttgctggccaaaagcggtggctcatgtctggaatcacaatgctatggaaggctgaggaaggaggatcacttgaggccaggagtttgagataagcctgggcaacagaatgaaaccccatctctaaaaaaaaaaaacaaaaaattagctgggtatggtggcatgcacctgtactcccagctacatgggaggctgaggcaggaggatcgcttcagcccaggaattcaagaccagcctgagcaacatagcaagacaccatctctacaaaaaatttaaaaattaaccaggtgtggtggtgtgcacctgtactcccagctacctgggaggctgaggtgggagggtcacctgagccatgacttggaggctgccgagagctatgaacatgatgctgtactccagcctggctatagggtgagactgtctcaaaaaatacataaattacattaaaattaatttttttcagttagataaaacaaataaattccaagatctatcacaccacagtgatgatagttaataatacatcgcgtctttcacaatgactaaaagtagatttgacatattctccccacaaaaaaaactaggtgaggtgatataggtcagagttaggattatgtgaatatgttaattagcttgattgttaatatgttaattagcttggttaatacgttattagctttattttaatatgttaattaactttattgttaatatggtaactagcttgatttaatcattgcacaatgtgtacttggattaaaacattacattgtaccatatatatgtatacaattattttttgttaacgaaaaataaattttctataaaaatgacttgcatttccaggcagaaagcaaaacaagtcccagtttcgaggacagctgtgatatatttaacagtgtctcctcttaattcaacacagtttatatgaccatgacacaaggggttccaagtttccaaggaaaggattccagttatgtgctcaaggtgtatccacactgggccgggcgctgtgactcacgcctgtcatcccagcactttgggaggctgaggcgggtggatcacctgaggtcaggagttccagaccagcctgaccaatatgctgaaacgctgtgtctactaaaaatacaaaaattagccaggtgtggtggcaggcacctgtaatcccagctactcaggaggctgaggcaggagaattgcttcaacccgggagatgttggctgcagtgagccgagattgagctattgcactccggcctgggcaacaagagagaaactccgtctcaaaaaaaaaaaaagacatattcatgttgagatttctacactgtgaaaaaagatctccaatagtgtgcatcaggcaccccaaaaattcccaattctattaaccaatcaaatctactaggaaattgcaattggaatgactccacggtttcccagaaaggccaacaccattctaatagaaagcattcactgtttttatgcaaatcatttcatccatacctcaaaacgacgtcatgtagactggataaagaaaggtgggagcatatacactatggaatactatgcacccatgaaaaagaatgggattggttgggcgtggtggctcacgcctgtaatctcagaaatttgggaggccgaggcgggtggattacctgaggtccggagttcaagaccagcctgtccaacatggagaaaccctgtctctactaaaaacacaaaattagctgggcgtggtggcatgcacctgtaatctcagctactcagaaggctaaggcaggagaatcactggaacccgggagccagaggttgcggtgagtcaagatcacacaattgaactccagcctgggcaacaagagggaaaccccatctcaaaaaaaaaaaaacgggatgatgtcctttgcaggaacctgcatggaggtggaggccattatccttagcaaacttacacagcaacagaagacaaaatacctcctgttctcactgataagtggtaggtaagcattgggtacccgtggatataaagaagggatcagactccggggcctgctggaaggtggagggtgggacaaacgagaggattgaaaaattacctatcaggtggtagtaggcttattacctggttgatgaaataatctctacactaaacccccaggacatgcaatttacccgtgtaacgaacctgcgcatgtgcccctcaacctgaaataaaagtaaaaacaagtaggccgggagcagtgattcctaatcccagcactttgggagggcaaggcgggtggatcacttgaggccaggagttcgagaccaccctgaccaacatgatgaaaccctgtcactactaaaaatacaaaattagtcgggcatggtggcacacacctataatcccagctacgtgacaggctgatgcgggagaatcccgtgaaccctggagacggaggttgcagtgagccgagattgtgctactgcactccagccttggcgacaagaacaaaacttcgtctcaaaaaaaaaaaaaaaaaaaacaataaaaagcacacacaaaacactgcatgcttctatggggaacattttactgatttttttttaactcttttaaaatgttagattagtgtcttaggaaatcagggatttccagaggcaggacttcacgacaccaacgttgagtgtcaaaaggattcctttcaatgtagaaggtgcatgcctgctctgggcttccacaaatccccgagacttaataagacacctggctccgtcactgatcaaagaatgggtaccacgacttagcatccactgcaaagctccatggtgcctagctttagccagtttgttcacagccgtgattaaggtgtccacagcatcctcaccagcctcaggaacagggcacagtcaactcaccacaggggtgaccccagaaacaagagacacgactgtaacagggacaatgtgcgggacgccaaaaaccagaacaagagacaggaatattataacagggacaaagtcgacaccacatggaagatggatgactcatttgtcacaggtagaaacagtttatctgcgagtttgtaaccaggtgaatcaagaatgaagggtgcggccgggcgcagtggctcatgcctgttatcccagaactttgggaggctgaggcaggtggatcacctgaggtcaggagttcaagaccagcctggccaacatgatgaaaccccatctctactaaaaatacaaagattagccatgtgtggtggcaggtgcctgtaatcccagctactcgggaggctgtggcaggagaatggcttgaacacaggaggcggaggttgcagtgagctgacatcacagcactgcactccagcctgggggacacagcaagactcctcttcaaaaaaaaaaaaaaaaaacagctggatgaagaatgaaaggtgcacaaaggcagccagggatgcaagccccttccaccctgggccctggaactgcacaggccaccttctaaggtttctctcctgtcatcctcccaagtctacacgaatataaagaaacacactagaagtctctgatgggatgggggcatctccagaaatccgaagattcaggttctgaatctctgatctgagtgcggctggggagctgctgttccagaaagcaaatgaaactttggctgtgattcagaccatttcttggtagcaagggtgtagggaaagaaggatgtggaccgtgcaggagaaggaatgaatggggtcaggacagtggctggagaatgtctgagatggccacgtgcagagaggagcaggctggctgtgtctctcactgtgcctgggatgggtggtgacagatgagtgggattccacatgatagagacacccaatgaagaaataaaagcagcttacagggagcaaatgacacagacactcagaagaaagtggccaagggatcgtccccatgtatgaactgaagacgttttctaagaatgtggccaagggtccacactgaagatgatccctaagaatgtggccaagggaccaccaccatgtaggcactgaagacgttccctaagaatgtggcagcgggatggccactgtgtagaaactgaagatgttccctaaggatgtggccaagggaccaccaccatgtacacactgaagacgttccctaagtatgtggcgcaagggacctctgctgtgtgcacactgaagacgttccctaagcatgtggctaagggactgctaccatttacacactgaagacattccctaagatgcagccaagggacagcactcaagacattccctaggcatgtggccaagggaccgccaccatgtaaacactgaagacgttccctaagcctgtggctaagggacagccgccatgtacacactgaagacatcccctaagaatgccgcaaaagaaccgccaccgtggacatgctgaagatggttcccctaagcatgtggttaaaggactgccgccctgtacacactgaagacgttccctaagaatgtggccaagggactgccaccatgtacacactgaagacgttccctaagcatgtggcccaagggacagccacggtgtgcacactgaagacgttccctaagcttgtggctaagggaccaccaccatgtacacactgaagacgttccctaagaaagcagccaagagacggcagggaatatgttccgtaagcatgtagccaagggaccgccaccaagtacaaactgaagacattccctaagcttgtggctaagggaccaccgcagtgtgcacactgaagacgttccctaagaatgcggccaagggactgccgccatgtacacactaaagacattcccgaagaattaggactagggactgccaccgtgtacacactgaagacattcgggaagaatgtggctaagggactgctgccagctacacactgaagatgtttcctaagcatgtggtcaagagaccaacatcgtgtacacactgcagacgttccctaagaatgtggccaagggacccccaccttgtacaaagtgaagacgttccctaaggtccagccattggcctgcaaaacatcagagcaaagaatgttgtgcaggatccagtcatcccaccgctcggtgtgtacccaaaggaaaggaaatctgcccatcaatggcatacctgcaccccctgtgcactgcagcactactaatagtttccaagatatagaatcaacccatgttcaatcaacagataagtgcatcaagcgaatgtggcatagacacacaatggaatggtatgcagccatgaaaaaggaaatcctaccatttgcagcaacatgggtgggactgaaagatacaatgtgaagtgaaatgaaccaggcacagagagacaaatatcgtatcatctcataggtagaatctaaaaaagctgaacgcataaacgcagagagtgcaatggtggttgccagggaagaatgcttcatgaagtgtttggcaaagaacataacatttcagttggaggccaggagcggtggctcatgtctggaatcacaatgctatggaaggctgaggaaggaggatcacagaaggccaggagtttgagagaagcctgggcaacataatgaaaccccatctctaaaaataaaaaaaaatgaaaaaattagctagatatggtggcatgcacctgcagtcccagctacttgggaggctgaggcagaaggatcacttctgcccaggaattcaagaccagcctgagcaacatagcaagaccccatctctacaaaactttaaaaattaaccaggtgtggtggtgtgcacctgtagtcccagctacctgggaggctcaggtgggagggtcacctgtgccaggagttggaggctgccatgagctatgaacatgacgctgcactccagcctgggtgatagagggtgagactgtctcaaaaacataaattacattaaaattaaattttttcagttacataaaagaaataaattcaaagttctatcataccacacagtgattatagttaataataatacattgcatctttcaaaatgactaaaactagattttacatattctcatcaccaaaaaaacgaagtgaggtgatataggttagagttagggttatctgaatatgtaaattagcttgttaatatgttaattagcttgattgttaatatgttaattaggtcaatggttaatatgttaattcacttaattattaatgttaattagcttcattgctaatatggtaactagcttggtttaatcactgcacaatgtgtacttggattaaaacatcatattgtaccatagagagagagagagagagaatgtgtgtctgtgtgtatatatatatatatatatatatatatatacacacacatacaatatatatatacacacacacacaattattttttgttaacgaacaataaattttctataaaagtgactcccatttccaggcagaaagcaaaacaagacccagttttgaggacagctatgacatatttaacggtgtctcctcttaattcaatacagtttatatgactatgttccaaggggctccaagttgtcaaggaaaggattccagttatgtgctcaaggtgtatctacactgggccgggcgcggtggctcacgcctgtcatcccagcactttgggaggctgaggcaggtggatcacctgaggtcaggagtttgagaacagcaaggccaatatgctgaaaccctgtctctactaaaaatacaaaaattagccgggtgtggtggcgggcgactgtaatcccagctactcaggaggttgagacagaagaatggcttgaacccaggaggtggaggttgcagtgagccgagatcatgccattgcactccagcctgggcaaaaagagcaataatccttctcaaacaaacaaacaaacaaaaaaagtatccacactgcagcgtggaccagaagagatgaccttccagtgagcacacgaggtcctctcacaaagcggcgagtgttcccagttattactcggagggccgggcctgctcaggagggttggtgagatcaggctgtcccctaacacacaccatggcagggctcatcctcctgagtacatgcaaggtgcactgagccggctccccatggaactccaaaaatagcccagctgggaagaaatggaacgttctgggggacactgattttcacattgaaatttcctatctttttaaatttattttggttgagacagtcgcccaggctattgcccagcctggagtgcagtggcatgatcgtagcttatggcagcctcagcctccttgggctcaagcgatccttcagcctcagcctcccaagtagctgtgaccacacacgtgtgccaccacgtctggcttttttttttttttttagagacagcatctctctccttgttgcacaggctggagtgcagtggtgcgatcacgtttcacagcagcctccaactcccaggctcaagtgatcctcccacctcagcctcctgtgtaactgggactacaaatgcacaccttatgtccagctaatttttttattgttactagagacaaggtctcattatgttgaccaggctggtctcaaacccctgagttcaagtgatcctactgacttagcctcccaaagtgcaggtattacaagcatgagccaccacacccagcctatttttattttatttttgtaggcacaggatctcgctgtttgcccaggctgatctcaaactcctggtctcaaaaatcatcctcctgcctcagcctcccaaagtgctgggatgacaggtgtgagccattgtgcccggcctcataccatttttgaatcatgaaactttattattctttgcagtttttcccccaagaatttagacatgtaagaagcaaaccaacaccttttaaaacttaaacataattcctagcttgtggatccagttttggaagcgatttaaattctagaaagcctgcagtaaactggctatttgatacgttctcagagttcctgcctttccagttaaacacaaataaaataggagtccggtgacctcgaacaccccagggtaagaacgcacaagctaaaagccagttggagcctgaatgtgaaaaggcaatcgttccttctgcatcaaaacatctgcacccacgggtccacccgtcagccaaaagccacctcagcaatgctaccaaaacagggaaaagaaaggctaccctctttctttcatgcaagccctctaagataacgcacaacctactagctcacgtaaattagggcacaaagaacccaactgaaatcccggcagaacaagcacaacttctgcttaatcatgaacttatttatttatttagagacagggtgtctctcactctggtgcccaggctgcacgacagtgatgcaatctcagctcactgcagcctcgactttgtgggctccagtgatcctcccacctcagccacccaggtagctgtgaccacacacgcgtggcaccatgtttggctaatttttatttttataattttagacacagcatctctcgcttggtttcccaggctgtgatcacagctcactgcagcctccaactcccacgctcaagtgatcctcccacctctgcctcctcagtagctgggactacaggcacgctctcactttttgtatttttagtagagatgaggtttggccatgttacccaggctggtctcaaactcctgggctcaagcgatccaccggcctcggcctcccaaagtgctgggatcacaggcatgagagccaccgcggctggccatgcagctgttttaataagcaattctgagaagacacaaatgccactctgctcttttgtgataatattaacacagattactgaattacagtgacaaaaacttcatatgtattacctaaggaaacacagagcccccagtgttagatctgaactctttctccacccaggacgaataagtggattccaattagtgcctcaaaaaaaaaaaaaaagaaaaaagtagcaagaaaaaaaaagaacagtagagcagtttccacaaacgccagcccttatttttggaaggcccacttgccaagaacaatgtttacttgtcaaaaacagtgttgacgttcataaatgtttttttctgaatttctcaacggttaagggaaaaaaaggcaaaagagcaataatatttcttgacacaacatttatataaaatttagtaatcccagctactcaggaggctgagacaggagaatcgcttgaacctgggaggtggaggttgcagcgagccaagatcgtgccactgtactgcagcctgggcaacaagagcaaaactccatctcaaaaaaaaaacaatgttagatagtatcggacatgctgggttggacacaggactgaagggtaactagaaacaactttcaggcaatttccacaaaagttacatgtcagaaacaggaaaggtgggcttccccaggtactgcaaaccacctatattttgccatgaccaggaattttttataagcccaagtcccacgtgtattttacagcactaatattaaccttcaaaacacggagggtttctgtgtctcctccttcttggaaaatttatcaaattaaaaaaaaaaagcttaactattactgcatttttttaaagaatggtatttgctacaatctgaaagtttgtgttcctcccccaaattcctgcattgaaatcctcacccctaagacaatggtgtcaggaggtgggagacttgggaggtgatgacttcatggggatcaagcctcatgaataggatcactgtccttataaaaggagccccagagagctccctcgccctttccaccatgtgagcaggcagagaaaatgcgtcgtctatgaaccagggagtgcatccccaccacacactgaatctgccatgatcttgaacctccagccttcagaactgtgagtgataaatgtctctagtttataaattacccaactgaaggtattttattttagcagctccctactcagagaggctgtggcaggagaatcgcttgaacatgggaggcggaggttgcagtgacctgagatcacaccactgcactccggcctgggcgacacagcaagactccgtctcaaaacaacaacaacaacggttggatcaagaatgaaaggtgcacgaaggcagtgatgaatggaagccccttccaccctgggctctggaactgcacaggccaccttctaaggttgctctcctgtcatcctcccaagtctacacggatataaagaaacacactagaggtctctgatgcgatgggggcatctccagaaatccgaagattcaggttctcaacctctgatctgggtgggggtggggagctgcaattccagaaagcaaaggaagccttggctgtgattcagaccatttcttggtatcaagcgtgtaggggaagaaggatgtggacaagggaaagagaaggaatgaatgcggtcaggacgctggctggagaatgtctgggatggtgacgtgcagagaggagcaggctggctgcgtctctcactgtgcctgggacaggcggtgacagaggaaagggattccacatgagagtcagagacacccaatgaagaaaaaaaagcagcttacagggtgaaaaggacacagacacagacacgcagaagaatgtggccaagggatcgccaccgagtacgaactgaagacgttttctaagaatgggtccaagggactgccactgtatgcactgaagacgttcggaaagcatgtggccaaaggaccactgctgtgtacacactgaagacattcgctaagaatatggctaagagacggccacctgtacacactggagacgttccctaagtatgtggctaagggaccaccgccatgtacacactgaagatgttccctaagtacgtggctaagggacggccgccatgtacgcactgaagacgctccctaagaatgcagcgaagagatggcagacgtttcctaggcatgtggctaagggaccgccgtgtacacacttaagacattccctaagcacgtggcccaagggaccattgccctttgcacattgaagacgatccctaagcttgggttaagggaccgctgccatgtacacactgaagaggttccctagcaatccggccaagggccgctgatgtgcacacactgaagacgttccctaagtgtgtggctaagggactgctaccatatacacactgaagatgttccctaagaatgtgggtaagggaccgccgccatgttcgcactgaagacgctccctaagaatgcgtccaggggactgctgccgtgtgcacactgaagatgttccctaagaatgtgggtaagggacccccgccatgttcgcactgaagacgctccctaagaatgcgtccaggggacagctgccgtgtgcacactgaagatgttccctaagtatgtggctaagggaaggcagccatgtacacactgaagacgttccctaagaatgcagccaagggagggcactgaagacgttccctaggcatgtggccaagggaccgccaccttatacacactgaagacgttccctaagcttacggctaagggaccgctgacatgtacacactgaagacgttctgtaacaatgcagccaaggaacggccaccatgtacacactgaagaattccctaagcatgtggcgcaagggactgataccatgtgcacaatgaagatgttccctaaccataggccaacagactgccactgtgtaaatacttaagacattccctaagaatggggctaagggacccccgccatgtacacactgaagacgttccctaagaatgcagtcacaggatggcaccgaagacgttccctaggcatatggccaagggacctcactgaagacgttccctaagcatgcggcccagggacagccaccgtgtacacactgaagacattcccaaagcatgtggccaagggaacaaactgaagacgttccctaatacaaaagctaagacattgtgggtgtaccacacacttcctacagctgtgggaaaatgaggctcttcagggcgcctccatgactagccacgaacccagctaggtgagccacggaaagaatggcgtgttgtaactgcagtaattaccaagacataacaggatctaatcgctttctaaatacatggctcccttaagtctccccatccctcctcaatcacgccaaagaagacctgtttagcatacaaaatcaagctgtgaggagtaaaactttggcaatgtcatttcatcacagcacagagccactgtgagtccagcacctcttatgaaaagaaaacagacggccaggcaccgtggctgacacctgtcatccgagcactttgggaggctgaggcaggtggatcacttgaggccaggagttcgaaaccagcctgcccaacaggtgaaaccccgtctctactaaaaatacaaaaaaaaagaaaaatcagggtgtaggggcaggcacttacaatcccagctactccagaggctgaggcaggagaattgcttgaacccaggagatgatggctgcagtgagcccagattcagccattgcactctagcctgggcaacaagagcaaaactccatcgcaaaaaaaaaaaaaaaaagagaaaagaaaacagacatattcatgctgagatttctacactgtgaaaaaatatctgcaacagggcatcacgcaccccaaaaattcccaatgctcttagctaatcaaatctaccaggaaattgcaattcgaatgactccacagtttcccagaaaggcaaacgccattccaatagaaaacattcactgcttttatgcacattgttacatccattcctgaacacgacgcctgttacatccattcctcaacaggacgccatgtagactggataaagaaagggtggagcatatacactatggaatactatggacccatgaaaaagaatgggattggttgggcgtggcggcgcatgcctgtaatcccagcactttgggaggccgaggcaggcagattacctgaggtcggtagctcaagaccagactggccaacatggagaagccccgtctctactaaaaatacaaaattagcccagcgtggtggtatgcgcctgtaatctcaacgactcagtagcctgaggcaggagaatcacttgaacccaggaacaggaggttgtggtgagctgagatcacaccactgcactccagcctgggcaacaagaaggaaacccagtctcaaaagaaaaagaaaaaaagaaaacatgggatgatgccctttgcaggaacatgcatggaggtggaggccattatccttagcaaactcacgtaggaaaagaaaaccaaatatcacctgttctcactcataaacggcagctaaacattgggtactcatggatacaaagaagggaacagctgcaggggcatgctggagggtggagggtgggagaaatgagaggatcgaaaaactacctatcaggtggtactggacttattacctgcatgatgaaataatctgttcactaagcccccaagacatgcaatttacctgcgcacgtccccctcaacctgaaatcaaagtgaaaaaagtaggctgggggcggtgattcataatcccagccctttgggaggccaaggcgggtggatcacctgaggcaaggagttccagactaccctgatcaacatgctgaaaccctgtcactactaaaaatacaaaagtagcagggcatggtagcgcacacctataatcctagctacctgacaggctgaggtgggagaatcccttgaatgcgggagacagagattgcagtgagccgagatcgcgccattgcactccagcctgggagacaagagcaaaagtccatctcaaaaaaaaaaaaaaaaacgctacatgactacatgtaacagctactgggaacattttattgaaattttttaagccctttaaaatgttagggtagtgtcttaggaaatcagggatttccaaaggcaggacttcacgacgccaacttgagtgtgagaaggattcctttctacgtagaaggtgcatgcctgctctaggcttccacaaatccccgagacctaataagacatctggctccgtcactgatcaaacaatgagtacaacagcttagcgtccactgcaaagctccgtggcagttagctctagtcagtttgttcacagccgtgattaaggtgcccacagcatcctcaccagcctcaggaacgcggcacagtcagctctccacacgggtgaccccagaaacaagagacaggactgtaacagggacaacgtgcggcacaccaaacaccagaaacaggagaccggactgaaacagggacaatgtgtgagatgccaaaaaccagaacaagagacaggaatattataacagggacaaagtccagaggacatggaaggtggaagactcatgtgtcataggtggaaacagtttatctgtgagttgcaaaccaggtggatcaagaataaaaagtgcagccggacgtggtggctcacacctgtaatcccagcactttgggaggccaaggtggatggatcacctgaggtcaggggtttgagaccagcctgaccaacatggagaaacctcatctctactaaaaatataaaattagccaggcatggtggtgcatgcccgtactcccagccactcaggagaatcgcttgaacccaggaggcggggaggttgcagggagctgagatcacaccactgcactccagcctgggcgacacagtaaaactccgtctcaaaaaaaaaaaaaaaaaatgttggaccaagaatgaaaggtgcacaaatgcagccagggatggaagccccttccaccctgggccctggaactgcacaggccaccttctaaggtttctctcctgtcatcctcccaagtctacacgaatataaagaatcacactagaagtctctgatgcgatgggggcatctccagaaatccgaagattcaggttctgaacctctgatctgggtgggctggggagctgcagttccagaaagcaaaggaagcctgtgatgtgattcagaccatttcttggtagcaagggtgtaggggaagaaggatgtggaccgggcaggggaaggaatgaatgcggtcaggacgctggctggagaatgtctgagatggccacttgcagagaggagcaggctggctgcgtctctcactgtgcctgggatggtcgctgacagaggaaacggataccacataagagtcagagacacccaatgaagaaacaaaagcagtttacaggatgaaaagtacacagacacggacactcagaagaatgtggccaagggaccgccactgtgtatgcactgaagaggttccctaagaatgcggccacgggactactgccatgtacacactgaagacgttccctaagtatgcggccaagggaccgccgccatgtacacactgaagacattccctaagaatgtggccaagggacctccaccatgtacacactgaagacgctcccaaagaatgcagccaaaggacggcactgaagactttccctagggatggggccaagggaccaccaccgtgtacacactgaagacattccctaagcatgtggtccaaaggactgctgccatgtacacactgaagacgttccctaagcttgtggctaagggaccaccgccatgtacacactgaagaagttccctagcaataaggccaagtgaccgctgccgttgcacactgaagacgttccctaagtatgtggctcagggaccaccaccatgtacacactgaagacgttccctaagaatgccgctaaaagacagcactgaagacattccctaggcacgtggctgaggggcctccgccatgtacacactgaaggcattccgaagcatgtggctaagggaccactgccatgtacacactgaagacgttccctaacaatgcgcccaagggaccaccaccatgtacacaccgaagacgttccctaagaatgcagccaagggacggcactgaagactcgttccctaggcatgtggccaagggaccgcactgaagaagtcccctaagcatgcggccaagggactgccaccgtgtacacgctgaagacattccctaagaatgtggataagggaccgccgccatgtacacactgaagacgttccctaaaaatgcagccaagggaccgccgccatgtatacattgaagacgttcccaaagaatgcagccaagcgacggcactgaagacactccctaggcatgtggccaagggaccgccaccctatacacactgaagacgctccctaagcatgtggctaacagactgcgaccatgtacacactgaagacattccctaagaatgtggccaagggaccgccaccgtgtatgcactgaagacgttccctaagcatgtggccaagggactgcactgatgacgttgcctaaggatgcagccaagggactgccaccgtgtacacacggaagacattcactaagaatatgactaagggaccgccaccatgtacccactgaagatgttccctaagcatatagccaagggaccgacaccatgtacacactgaaaacgttccctaagaatgtggccaagggaccgccaccttgtacatagtgaagacgttccaaaggtccagccataggcctgcaaaacatcagaggaaagaatggtgtgcaggatccagacatcccaccactgggtgtgtacccaaaggaaaggaaatcagcccatcaatgggatacctgcatcccctgtgccctgcagcactactcaggttccaagatatacaatcaacccatgtgtcaatcaacagatgagtacatcaagcaaatgtggcatagacacacagtggaatagtatgcagccatgaaaaaggaaatcctgccatttgcgcaacatggatgggactggaagatacaatgtgaagtgaaatgaaccaggcacagagagacaaatactgtatcatctcgtatgtagaatctaaaaaagctgaacgcataaacgcagagagtgcaatggtggttgccagggaagaatgctgaagtgtttgtcaaagaacataacatttcagttggaggccaggagcgctgtggctcatgtctggaatcactgtgctatggaaggctgaggaaggaggatcactggaggccaggagtttgagacaagcctgggtaacgtaatgaaaccctatctctaaacaaataaaaaaaaaactgaaaaaattaactggatatggtggcatgcacctgtagtcccagctacttgggaggctgaggcaggaggatcgctttagcccaggaattcaagaccagcctgagcaacatagcaagaccccatctctacaaaaaatttaaaaattaaccaggtgtggtggtgtgcacctgtagtcccagctacctgggaggctgaggtgggagggtcacctgagccatgagttggaggctgctgagagctatgaacatgatgctgtactccagcctggctataggatgagactgtctcaaaaaacatataaattacattaaaattaatttttttcagttagataaaacaaatgaattccaagttctatcacaccacacagtgatgatagttaataatacatcacgtctttcaaaatgactaaaagtagattttacatattctcactacaaaaaaaagtaggtgaggtgatataggttagagttagaattatgtgaatatgtaaattagcttgattgttaatatgttaattagcttcaatgttaatatgttaattagcctgattattaatatgttagttaatgtgattgttaatatggtaactagcttgatttaatcattgcatgatgtgtacgtggattaaaacatcacgttgtacctcatatacgtgtatacaattactttttttaacgaaaaatgaattttccagaaaaatgactcgcatttccaggcagaaaacaaaacaagtcccagtttcaaggacagctgtgacatatttaacagtgtttcctcttaattcaacaccctttatatgaccatgacccaaggggctccaagttgccaaggaaaggattccagttatgtgctcaaggtgtatccacactgggctgggcgcggtcacgcctgtcatcccagcgctttgggaggccgaggtgggtggatcacctgaggtcacgagttcgagagcagcctgaacaataggctgaaaccccttctctactaaaaattcaaaaattagccgggtgtggtggcaggcacctgcaatcccagctactcaggagactgaggcagaattgctcaaacccgggagatgttggctgcagtgagccgagattgagccattgcactgcagcctgggcaacaagagcaaaactccatctcaaaaaaaaaaaaagacatttacgttgagatttctacactgtgaaaaaagatctgcaatagggcatcaggcaccccaaagattcccaatgctattaaccaatcaaatctactaggaaattgcaattgcaatcactccacagtttcccggaaaggtgaacacccctccagtaggaagcattcagtgttttcatgcacatcgcttcatccatttctcaaaacaacgccatgtaaactggataaacaaagggtggtgcatatacactatggaatactacatacccatgaaaaagaatgggattggttgggtgtggtggctcacacctataatctcagcactttgggaggccgtggagggcagattaactgaggtcaggagttcaaaaccagcctgggcaacatggagaaaccccgtctctactaaaaatacaaaattagccgggcgtggtggcatgtgtctgtaatctcagttactcagaaggctgaggcaggacaactgcttgaacccgggagctggtggtagcggtgagccgagatcacaccattgcactccagcctgggcaacaaaaaggaaactgtctcaaaaaaaaaaaaaaaatgggatgatgtcctttgcaggaacatgcacggaggtggaggccattatccttagcaaacttacacaggaacagaaaaccaaataccacctgttcccactgataagtgacagctaaacattgggcactggtggatataaagaagggaacagctgcaggggcctgctggagggtggagggtgggacaaatgagaggatcaaaaaactacctatcagatggtagtaggcttactacctggttgatgaattaatctgtacactaaacccccaggacatgcaatttacccgtgtaatgaacctgcacacgtgcccctgaacctgaaagtttaaaaagtaggccaggagcagtgattcataatcccagcactttgggaggccaagatgggtggatcacttgaggccaggagttcgagaccaccctgaccaatatggtgaaaccctgtcactactaaaaatacaaaatcagccgagcatggtggcgcatgcctataatctcagctaccttacaggctgagatgggagaatccttggaacccgggagacggaggttgcagtgaacccagatcataccattgcactccagcctgggcgacaagagtgcaaatcatctcaaaaataaataaataaataaaacactacatgtgctgctattgggaatattttactgaattttttttaagtcctttaaaatgttagggtagtgtcttaggaaatcagggatttccaaaggcaggacttcacgttgccaacatgagtgtgagaaggattcctttcagtgtagaaggtgcttgcctgctctgtgcttccagaaatccccgagacttaataaggcacctggctccgtcactgatcaaagaatgggtaccacaacttactgtccactgcaaagctccatggcacctagctctagccagtttgttcacagccgtgattaaggtgcccacagcatcctcaccagcctcaggaacgtggcacagtcagctcgccacaggggtgaccccagaaacaagagacaggactgttacagggacaacacgtgggacgccaaaaaccagaaacaagagacaggaatattgtaacagggacaaagtccagaccacacggaaggtggatgactcatttgtcacaggtggaaacagtttatctgcgagtttgaaaccaggtggatcaagaatgaaaggcgccgccaggcgcgggggctcacgcctgtcatcctaacattttgggaggccgaggcggatggatcacctgaagtcaggagttcgagaccagcatgaccaacatgaagaaaacccatctctactaaaaatataaaattagccgggcgtggtggcacatgcctgtattcccagctactcaggagactgaggcaggagaattgctcgaacctgggaggcaggggttacagtgagccgagatccctccactgcactccagcctgggtgacagggtgacagagcaagactccgtctcaaaaaaaaaaaaaagaatgaaaggtgcacagaggcagccaggacacaagccccttccaccccgggccccggaaatgcacagaccaccttctaaggtttctctcctgtcatcctcccaagtctacacgaatatagagaaacacactagaagtctctgataggatgggggcatctccagaaatccaaagattcaggttctgaatctctgatctgggtggggctggggagctgcagtgccagaaagataatgaagccttggctgtgattcagaccatttcttggtatcaagcgtgtaggggaagaaggatgcggacagggcaggagaaggaatgaatgcggtcagcacggtggctggaggatgtctgggatggcgaggtgcagagaggagcaggctggctgcgtctctcactgtgcctgggatgggcggtgacagaggaaagggattccacatgagagtcagagacacccaatgaagaaacaaaagcagcttacagggtggaaaggacacagacacagacactcagaagaatgtggccaagggatcgccaccgtgtacgaactgaagacgttttctaagaatgtggacaagggactgccactccgtatgcactgaagaggttcccaaagcatgtggccaagggaccatcgccatgtacacaatcaagacaatccctaagcatgtgattaagggactgccaccatgtacacactgaagatgttccctaagaatggggccaagggaccactgccatgtacacactgaagacgttccctaagtatgtggctaagggaccgcccccatgtacgcactgaagacattccctaagaatgcagccaaaagacggcactgaagacgctccctaagaatgtggccaagggaccacaacggtgtacacactgaagccattccttaagcatgtggcccaagggactgccacgctgtgcatactgaagacgatccctaagcttgtggctaagggacggcggccatctacacaccaaagacgttccctaacaatgaggccaagggaccactgctgtgcacacactgaagatgttccctaagtgtgtggctaagggacctctgccatgtacacactgaagacgttccctaagaatgcagctaaaagatggcactgaagacgttccctaagcatgtggccaagagactgccaccatatacacactgaagacgttccctaagcttgtggctaagggaccgccgccatgtacacacttaagacgttccctaagaatgcggccaagggaccgccaccatgtacacactgaagacgttccctaaaaatgcagggaagggacagcactaaagatgttccctaggcatgtggccaagggaatgcactgaagatgttccctaagcatgcagccaaagaactgccaccatgtatacactgaagacattccctaggaatgtgggtgagggactgctaccatgtgcacactgaagatgttccctaagaatgcaaccaagggaccactgctgtgtgcagtgaagacactccctaagtatgtggctaagggacctccgccatgtgcacactgaagacattccctaagaatgcagctggcactgaagacgttcccctaggcataatgaccaagggaccccactgtatacaactgaagacgttccctaagcatgtggctaagggactgccaccaagaacacaatgaagacgttccctaagcatgcggctaagggaatgccgacatgtacacactgaagaggttccctaagaatgcgaccaagggaccgccaccatgtacacactgaagacagtccctaagcatgtggcacaagggaccgccgccctgtgcacactgaagatgttccctaaccatggggccaacagactgccaccgtgtacacactgaagacattccctaagcatgtggctaagggaccgccgccaggtacacaatgaagatgttccctaggcatgtggccaagggatcacactcactgaagacgttccctaagcatacagccaagggactgccaccgtgtacacactgaacacgttccctaagaatgtggttaagggaccgccgccatgtacacactgaagatgttccctaagaatgtggccaagggaatgcactgaagaccttccctaatacaaaagctaagacattgtgggtgtaccacacacttcctacagctgtgggaaaatgaggctcttcagggcacctccatgactagccacaaacccagctaggagagccacggaaagaatggggtggtgtaactgcagtaattaccaagacataattcgatctaatcgccttctaaataaatggctcccttaactctgcccagcccacttgattcacaccaaggaagacgtctttaacatacaaaatcaggctgtgaggagtaaaacttggacaatgccatttcatcacagcacagagccacggtgagaccagcacctcttatggaaagaaaacagacagctggccgccatggctcaggcctgtcatcccagcactttcggagtccaaggcaggtggatcacttgaggccaggagtttgagaccggccaggccaacatggtgaaaccctgtctctactaaaaacacacacacaaaaaaaaattagccaggcatggtggcagatgcctgtaatcccagctactccagaggctaacgcaggagaactgcttaagcccaggagatgttggctgcagtgagccaagattgagccattgcactccagccttggcaacaagagagaaactccatctcaaaaaaaaaaaaaagaaagaaaagaaaagaaaacagacatattcatgctgagatatctacactgtgaaaaaaatatctgtaatagtgcatcaggcaccccaaaaattcccaatgctcttaattaatcaaatctactaggaaattgcaattgcaatgactccacagtttcccaggaggcaaacaccattccaatagaaagcattcactgtttttatgcaaatcatttcatccattcctcaaaacaacgccacgtagactggataaagaaaaggtggtgtacatacaccacagaatactatgcattcttgaaaaagaatgggattgaccaggtgtggagactcacacctgtaatcccagcattttgggaggccaaagcaggcggattacctgaggtcgggagttcaagaccagcctggccaacatggaaaaacccgtctctactaaaaatacaaaattagccgggtgtggtagtgcatgcctgtaatcccagctacttgagaggctgaggcaggagaatcccttgaacctgggagacggaggctgcagtgagccgagatcataccactgcactccagccttggcaacagtagcaaaactccatctcgaaaacaaacaaacaaacaaaaaaacaccacatgtgctgctattaggaatattttactaaattttttgtaagtcttttaaaatattagggtagtgtcttaggaaatcagggacttcacgatgccaacatgagtgtgagaaggattcctttcaatgtagaagctgtttccctgctctgggcttccacaaatccccaagacctaataagacacctggctccgtcactgatcaaagaatgggtaccacgacttagtgtccactgcaaagctccatggcacctagctctagccagtttgttcacagccgtgattaaggtgcccacagcatcctcaccagcctcaggaacgtggcacagtcagctcgccacacgggtgaccccagaaacaacagacaggactgttacagggacaacatgtgggatgcaaaaaaccagaaacaagagacaggaatattgtaacagggacaaagtccagaccacatggaaggtggatgactcatttgtcacaggtggaaacagtttatctgtgagtttaaaaccaggtggatcaagaaagaaaggtgcggccaggcgcgggggctcacacctgtcatctcaacactttgggaggccgaggcggatggatcacctgaggtcaggagttcgagaccaacatgaccaacatgaagaacacccatctctactaaaaatataaaattagccgagcgtggtggcacatgcctgtattcccagctactcaggagactgaggcaggagaattgctcgaacctgggaggcaggggttacagtgagccgagatccctccactgcactccagcctgggtgacagggtgacagagcaagactccgtctcaaaaaaaaaaaaaagaatgaaaggtgcacagaggcagccaggacacaagccccttccaccccgggcccgggaaatgcacagaccaccttctaaggtttctctcctgtcatcctcccaagtctacacggatataaagaaacacactagaagtctctgataggatgggggcatctccagaaatccgaagattcaggttctgaatctctgatctgggtggggctggggagctgcagttccagaaagcaaatgaagccttggctgtgattcagaccatttcttggtatcaaacgtgtaggggaagaaggatgcggacagggcaggagaaggaatgaatgcggtcagcacggtggctggaggatgtctgggatggcgaggtgcagagaggagcaggctggctgcgtctctcactgtgcctgggatgggcggtgacagaggaaagggattccacatgagagtcacagacacccagtgaagaagcaaaagcagcttacagggtggaaagaacacagacacagacactcagaagaatgtggcagggacacattctggccaatggactgtcaccttgtacaaactgaagacgttttctaagaatgtggccaagggatcacactgaagacgttccctaagaatgtggccaagggactgcactaaagatgttctctaagcatgcggccaagggaccaccagtgtgtacacattgaagaggttccctaagaatatggctaagaaacagcactgaagacattccctaagcatgtggttgagggaccgcactgaagacgttccctaagaatgacaccaggggactgccaccgtgtatgcactgaagatattccctaagaatgtggccaagggaccaaccagggctgtgactgaagacgttccccaagcgtgcggccaagggaccaccattgtgtaggcactgacgacgttcccttagaatgtggcccggggaccaccaccatgtaagaagtgaagacgctccctaagaatgtggccaagggaccaccacggtgtacacactgaagacgttccctaagtatgtggctaagggaccaccgccatgtacgcactgaagacgttccctaagaatgcagccaaggcaaggcactgaagacattccctaggcatggggccaagggatggccaccatgtacacactgaagtcattccctaagcatgtagcccaagggaccaccaccgtgtgcacactgaagatgttccctaagcttgtggctaagggaccacagccatgtacatactgaagatgttcgctaacaatgcagccaaaggactgctgccctgtacacactgaagacgttccctaagcatgtggcccaagggactcccaccctgtgcacactgaagatgatccctaagcatgtggctaagggaccaccaccatgtacacactgaagacattccctaagcatgtggcccaagggactcccgcactgtgcacactgaagatgatccctaagcttgtggctaagggacctccgccacgtacacactgaagacattccctaagaatgtggccaagggaccaccaccatgtgcacactgacgacattccgtaagaatatggccctgtgcacactgaagacattccctaagcatgtggctacgggaccaccgtgtacgcactgaagacattccgtaagaatgcgaccaggggaccgccacatgtgcacactgaagacattccctaagaaaacggccaagggacggcacttaagacgttccctaagcatgtggcccaagggaccactgccctgtgcacactgaagatgttcgctaagcatgtggctaagggactgccgccatgtacacactgaagacattccctaagaatgtggccaagggaccgccacagtgtacacactgaagacgttctctaagaatgtggccaatggaccacactgtagacgttccctaagcatgcagcaaagggactgccaccgtgtacacactgaagacattccctaagaatgtggctatgggactgtcgccatgtacacactgaagatgttccctaagcatgtggccaagggacggacgccatggacactgggaagacgttcactaaagtccagaaacgggcctgcgaaacaccaaaggaaagaatgttgtgcaggatccagtcatcccaccgcttggtgtgtgcccaaaggaaaggaaatcagcccatcaatgggatacctgcaccccctgtgcactgccaacactactaacagtttccaagatatagaatcaacccatgtgtcaatcaacagatgagcgtatcaagcaaatgtggcatagacacacaatggaatagtatgcagccatgaaaaaggaaatcctgccatttgcagcaacatggatgggactggaagatacaatgtgaagtgaaatgaaccaggcacagagagacaaatactgtatcatctcgtatgtagaatctaaaaaagctgaacgcataaacgcagagagtgcaatggtggttgccagggaagaatgcttcatgaagtgtttgtcaaagaacataaaatttcagttggaggccaggagcggtggctcatgtctggaatcacaatgctatggaaggctgaggaaggaggatcactggaggccaagagtttgagacaagcctgggcaacataatgaaaccgcatctttaaaaaaaaaaaaaaaaattagctgggtatggtagcatgcacctgcagtcccagctacttgggaggctgaggcaggaggatcgcttcagcccaggaattcaagaccagcctgagcaacatagcaagaccccatctctgcaaaaaacttaaaaaattaaccaggtgtggtggtgtgcacctgtagtcccagctacctgggaggctgtggtgggagggtcacctgagccaggagttggaggctgccatgagctatgaacatgatgctgcactccagcctgggtgatagggtgagactgtctcaaaaaaaataaattacattaaaattaaatttttccagttagatagaagaaataaattcaaagttctaccacaccacacagtgattatcattaataataatacattgcgtttttcaaaatgactaaaagtagattttacacattctcaccacaaaaaaaagtaggtgaggtgatataggtcagagttaggattatgtgaatatgttaattagcttgttaatatgttaattagcttgaatgttaatgtgttaattagcttgattattgatatgttaattaggttaataatatggtaaccagcttgatttaatcattgcacaatgtgtactcggattaaaacatcacgtcgtacctcctatatatgtatacaattattttctataaaataattctataaagatagctcgcatttccaggcagaaagcaaaacaagtcccagtttcgaggacagctgtgacatatttaatggtgtctcctcttaattcaacagtttatatgaccatgacacaaggggctccaagtttccaaggaaaggattccagttatgtgctcaaggtgtatccacactgggctggtcgcggtggctcacgcctgtcatcccagcactttgggaggctgaggcgggtggatcacctgaggtcaggagttccagaccagctttaccaatgtactgaaaccccgtctctacgaaaaatataaaaattagctggctgtggtggcagacacctgtaatcccagctactcaggaggctgagacaggagaatggcttgaacccaggaggcggaggtttctgtgagccgagatcgtgccattgcactccagcctgggcaacaagagtgaaactgtcttaaaaaaaaaaaatggtatccacactgcagcatggaccagaagagatgaccttccagtgagcacacgaggtcgtctcacaaagcggcgagtgttcccagttattactcggagggctgggcctgctcaggagggttggtgagatcaggctgtcccctaacacacaccatggcagggctcatcctcccgagtacatgcaaactgcactgagccggctccccatggaactccaaaaatagcccagctgggaagaaatggaacgttctgggggacactgattttcacattgaaatttcctatctttttaaatttattttggttgagacagtcgcccaggctattgcccagcctggagtgcagtggcatgatcgtagtttatggcagcctcagcctccttgggctcaagcgatccttcagcctcagcctcccaagtagctgtgaccacacacgtgtgccaccacgtctggctttttttttttttttagagacagcatctctctccttgttgcacaggctggagtgcagtggtgcgatcacatttcactgcagcctccaactccctggctcaagtgatcctcccacctcagcctcctgtgtaactgggactacaaatgcacaccttatgtccagctaatttttttattgttactagagacaaggtctcagtatgttgaccaggctggtctcaaacccctgagttcaagtgatcctactgacttagcctcccaaagtgcaggtattacaagcatgagccaccacacccagcctatttttattttatttttgtaggcacaggatctcgctgtttgcccaggctgatctcaaactcaggctcaaaaatcatcctcctgcctcagcctcccaaagtgctgggatgacaggtgtgagccattgtgcccggtctcataccatttttgtatcatgaaactttattattctttgcatttctttccctcaagaatttaaacatgtaagaagcaaaccaacaccttttaaaacctaaacataattcttagcttgtggatacagttttggaagcaatttaaattctagaaatcctgcagtaactgcctatttgatacgttctcagagttcctgcctttccagttaaacacaaataaaataggagtccggtgacctcgaacaccccagggtaagaacgcacaagctaaaagccagttggagcctgaatgtgaaaaggcaatcattccttctgcatcaaaacatctgcacccacgggtccacccgtcagccaaaagccacctcagcaatgctaccaaaacagggaaaagaaaggctaccctctttctttcatgcaagccctctaagataacgcacaacctactagctcacgtaaattagggcacaaagaacccaactgaaatcctggcagaacaagcacaacttctgcttaatcgtgaactcatttatttatttatttagagacagggtctcactcttttgcccaggctgcacgacagtgatgcaatctcagctcactgcagcctcgactttccgggctccagcgatcctcccacctcagtctcccaagtagctgtgatcacacatgcgtgccaccatgtttggctaatttttattattattattattatttttagaggcagcatctcttgctttattttccaggctggagtgcagtggtatgttcacagctcactgcagcctccaactcccaagctcaagtgatcctcccaccttcgcctcctgagtagctgggactgactacagacatgcgcctccatgcctggctaattttttgtatttttagtagggatgaggtttggccatgttgcccaggctggtctcaaactcctgggctcaagcgatccgcctgcctcggcctcccaaagtgctgggatcacaggcatgagagccactgcacctggccatgcagctgttttaatcagcaattctgagaagacacaaatgccccccggttcttttgtgataatattaacacagattactgaattccagtgacaaaaacctcacgtgtgttacctaaagaaacacagagcccagagtgtgcgatctgagctgtttctcaaaccaggacaaataagtggattccaattggtgcctcgagaaaaaaaagggaaaaagtggcaaaaaaaaaaaaaaaaaaaagtagtttcaacaaagtccagcggttatttttggaaggcccactcaccaagaacagtgtttacattcgtacattttttttctgaatttcttaatggttgggggaaaaaaagaagtcaacagagcaataatatttcttgacacaacatttatataaaatttagtgcccacgaagtgggagtggaatacacggagtctcgctcttgtcgcccaggatggagcgcagtggcacgatcttagctcactacaacctccgcctccctggttcacgcgattctcctgcctcagcctcagtacctgggattacaggtgcccaccaccatgcccagctaatgtttgtatttttagtagagatggggtttcaccatgttggccaggctggtcttgaactcctgacctcaggcgatccacccgcctcggcctcccaaagtgctgggatgacagatgtgagccaccacacccagcaatggatgcttttagacacaacggcaaaactaagttgttgagagacagagaatgcatggtccgcggagccaaaaatatttcctctctgaccccttaaagttgacaccatcagggtactcatgccaaggacctcccgcatctgactgcaacacaaaaggacaggcagccgcagctaggaaggagcctggctgcaaagccctgaaacccgaaagcttcccagaagttgctcagaaaggaactcatgcagtttgagaaaatctggaagaaacgagccaaaccctgctgttttcgtcgtctgaagaaatgagcaaaacactgccgttttgctgcagacggtcctgtgagagtttgcattctctgttcaccaggcaggggcatggcgagttcattttataaaactctcaggtgagccccacgatttgacggagcagaaatcactgggaaaggacggggcggcgggcctgagatcacagaggggaaaacagtagaactgctgcccaagcacatctgagactcgcagaaggcgcaggaagatggtcggaacaaaagcaggagctggctgcgccaggaacccggtctctgggcctcctctgcactcacgagcaaatgaacgtcaccaccgagatttcggcaccccagaaacagcccaaccggctccttcccaccagctgcctctttactaaaacatccgaaacctttttctcactttccccaagctgttttcctcacccttcagaggcctgctgggaaaacagttcgaagcaggcaattctgcaaagtgggggggaaacaaaaacaaccagctcagagttagggctgtgcagccagatgcaagcgtgaaaacaaaaccgaaccgaaaaatcccaccactgtgcggaaggagtgccacacaggctgggatgagaaccgtcggggttagggaaatgtctctgtaagaaaccctcaaggactagaattactcctaatgggaaaaacgtgtaaacatgtcccacttaaatgaacatcacgatgcaaatgcttagttatgaggactgaaaatgaacccctttcaacccaaaacgtgcaagaaagagaaatttcggcattttaatgatgcccaaggacaggcagtcaaccaacagcacttggaaagggcaagtctgggcagaggtgcacatcccggccttcctgtgtttcttgggggccattgttttctcaggagggaggaaaagagggagggaggaaggaaaaagggatggaaggaaaacgaaagaggaagggagggagggagaaaagggagggagggacagagggagggaggaaaggaaggaaggaggaagggagggagacagggagggacagagggaaggaaggagggagggaggagagggaaggagggagggagggatgggggaaggagggaggggaggaaagggaggcagagagggaggggagggagggaacggagagaaggaagggagaaaagggagagaagggagggaaggaagggagagaaggaaggaagggagaaaagggagagaagggagagaaggaaggaagggagagaaggaaggaagggagagaaggaaggaagggagagaaagaaagaagggaagggagggaaggaagggagagaagaagagacaaggatgggagggaaggaaggaaggaaagaaggaagaaaggaaggatttgttggctgaagaagagagggagggttggacggaaggaggagggaaggaagagaccatgtgagaggaggtgaggaagacaggaagagaggggtgataaggaggctggggggagagggaaggcgctgatgccatccggatccatccaggctgcctcgtccatggggcctccgtttatacaactatccactaagtgaaggaaccggcaaaaatctctgctcccggggaacactttcaccagctgccggctttattcactcagaaattttgatgccaaaacacccgaaagtacatcataacttgaggatttacagacaagaaagaggagcacagaactgaccgtgggtgccctggaaaaagttgctttcaacaaggaccacaacaaaaataaaaataataataatgataaacctccctccactcccaggatcaaggggttcagacaaactgcagtccagacggacacgcggcagacaaatgaatgaggagctaatgcattgctctggtttattgaacaacagtccaactttacagcattaaataaggggcaaccgttcaggaggggaacgatggcttaaaaataaaaatgaagacagagccgggacagttcacatttccacgtgagtgaggaaaagcgaaggattgttagagacgtgaagagaacgctggcaatgctacagaatggagcccacggaggcgtgggctgccctgcgtccccggcctcggggcagaacagggagcaaccccaaagcctgccccactgtgtcccttccagctgcccttctgccgagaacacccggagctgagggttccaagttcacggcggaaccgcttcccttaaaaagaaagcaaaggttacgtggatttctcccgtgcttccttttccacagacttaaaccggctcaggacgtaaggataacattctgtgctgcttgcagccctgagaagtcagcagccgtgaaaggcaggtagttcctttgccctctgacaccccgagttcttggggtctcggcagaacactgcctggagctgagtggggtcatccctcctagacaccgttctccccagcccagcttgtcttcacggaggcagagaacccgctgcacgtagaatccaagcaatatgctaagcctcctgaagtatttttcctccagttaaaaagcagttctacatgttggaaaacgtctttctgtttccctgaatgactgaaagcaactcgcaggaatccagccacggaaaacccctccgggggcaatattttaaaattcatttcccctatggtattcagtttaaaagagaagaatcaagagtcctttccggtaatcaaatcaaaaacaccttatgtggaaaagctggccgcacgggggaactggacttttagggctgagacaccgaagacataacctccggacccgtgagccacccacttttgttttgttttgagacggagtctcactctggcctccaggctggagtgcagtggcgtagtcttggctcactgcaacctccacctcctgggctcaagcgaatcttccgcctcagcctcccgagtagctgggattacaggcgggtgccaccgcatctggctagtttcttgtatttttagtagacacgaggtttcaccatgttggttggccaggctggtctcgaactcctgacctcagcgtgagccaccacgcccggccaccgcccagttttaaggaccaactccgcaaagtgaaatttcggcaggcagcaggaagcaggctctctggcagcaacctgtcgaaaatacaacacattccacacttttttttctgtttgctttttgttaagtgtctgcatttttgtactcatctgtcacatttttaaccgaacattaaaaaaaaaggtctctctttttaagaagggcattttggctaaaaggtctcttccccatttctcagaagcaagaggtccctgcttgcacgagaatgtaaacatgaattcagtgatctggacctcgcagaagtcacacatgatgatcgggaaaggctccttcgacgccacccagaatgttcctgcgtttcttctaaaccctcccagggagaactcgaatcagacatggtggaggtcttaagtatctgtgaaggaaggaacagctcctctaggctctgctgcacgcaattcccaagcagaagcgttggcagttcccaagcagaagtcgtccgggccccgggaataggggaggaaaggaaacccactcaaagccacctctcttgtgtcttcttttttctttttgagagagtctcgctcttgtcgcccaggctggagtgcagcgatctcagcttactgcaacctccacctcccaggttcaagcgattctctggcctcagcctccagaagctgggattacaggcacatgccatcagtcctggctaatttttgtatttttagtagagacggggtttcgccatgttggccaggctggtctcgatctcctgacctcagctgatctgcccacctcggcctcccaaagtgctgcgattatagacaggagccaccgcccccgaccctctctcacttctcaaatctctttcctttttccaccttctaggtgtcaaagacagtggatggtctctgaggttcaaaaccaagctgaccgggtaagtatttacagcaaagcatccaatgggctgctgcggggatgacttgtaagacaacacgcttcctcgctacaggaagctgctgtccctaatgccaaagaaaccgccgctgacgccatcccccaaggagaacacctgctcctggtccaggccccactccccctcgtcctggtcctcgggttccgcctctgccccactccgggcgttctcatacagaaacacctgctcgtccacgtgcgcgggagccagccggttcctcttggcgctgaccacgttggcggcggatccgaagagacgctcaggggcgacgcgcgtggccgtcacgcaccagtacttctgcagcaccttgggcagcagggggaagagggccaggcggtctgaccaccacttgagggggtcttcgttgaggccaagcaccttctgggacttgaagttgctcagctcctccaccacctgggcatgccactcttcctggtcctccacgccgcctgtctggcagaagatctcggccagcatgttgttgatgacgctggcgggcggcggcgtggatgtccgcatgagcttcttgacgggaggctcctcgggcaccgggaagatcttgtcctcagccggccggtagccgccgtctttgaccttgtccagcaggcccttggcctcttccaccacgcgattctccacctgctgccgctcgaaggcggagaggaagggcagcctcttgtagcgggggtccaggaaggtggccacgttgagaaacatgtcgatctcgggcgtctcctggtaggtcttggaaagctccttggcgatgacctccttggccatgctgagctccttggagtcggtctccttgatgttgagcgtggtgttcaggagcatgtgcagcagcggcttcaccatgctgatggtggggtacctggaggccgacagcatctcggccacctgcttgaagggctgcaggagctccaccagcccctcgatggtggcccactcgctggcctccagcatgaggtggtggttgttgctgtcctccaccaagaccccggcgatgacgaactgctgctccttgaggcgctgcagcatggccagcgtgctcccccaccaggagacgcggttgctcaccagcatgcagtgggccacgttctgctgcttctgcttctcatagagcatgtacatggccacggcagactgctggaagtactccaccagtttgcggcagcgcgacagcagcgcccccagcttcgggagctggaaggcctgctggatgccggcattgaaggtgtggcccaggcagggcatgtgcactgcgacgtccagcagggagcacgccttcacgatgtccttgccatagttggtggtggccccgaagaccttggcgctgatgccccactcgatgaagacctcatagagcactcgcgtgatggtctccgccgtgttctcttcgggcacctcgaaggtcttcaggcagcgggagcccatggacaggcagttgggggcgcccaggcccaggaagtgggcggccagcgtgacgtaggcgcggttctgattctcactcctccacatgtcggtggagatgccacaccaggtggcctcggccagctccttcaggatcacctcccggacggccccgtacttctcagggatggccttggtagagatgtacttccggctgggcagctcataccgggggtcggccgtcttcagcagcaccttgaaggtgggctcgtccacgatggaggctgggtacagcccctcgcagatgaggcccagcacggcggccgtcagctcctgctgcttcttgctgtcgtagccgtggccggccttgacggccagcgcgtcctgcccgggctgctgggacgactcgggcttcagcttggagaaggcggtggcgaaggcttcacgcatctgctccgtgttgctcttgacgaactcgcagaattcctcggggtggttcttctccaggtggtaggacaggttggaggtgtttccggagtaggcgatctgggccatgcagatgcggcagtagattttcttccactgcaggatgcatccctcggcgttggtgtcgaagccgaaatacttccacaccttgctcttggcgcgggggtgggccaccagcttcaggtctgtctgggagctctccaggcttttattctccattgcttctccaccggagcctgcctgctggacggctgctcatgcgtggggacctgctgagaagggccaagacaaacacagcatgagaagggacccaggcacgcacgggagccctgccggggagacagacagggtgccggggcagctccgctttcaaccaaagggcactggggccggacggctggaccttccttgcgggtcacttttgcagagtggaggagggaacctagcgcaggaatacgctctttcttccacgttaatccgactgcagcgatgccgcacgtgtcaacatacaggtttgcgagtgagcacggcatttttgcagggctgtacctgacaagtgcctttagtttttttttttttttttttttgagacagagtttcgctctgtcacccaggctgcagtgcaatggcgtgatctcagctcactgcaacctccgcctcccgggttcaagcgatcttcctgcctcagcttcctcagtagctgggatcacaggcacctgccatcacgcctggctaatttttgtatttttagtagagacagggtttcaccatgttggtcaggctggtctcgaactcctgacttcaggtgatccacccgccttggcctcccaaagtgctgggatgacaggcgtgagtcaccgcgcccagcctgacaatgcctctgtcatcgcaggggcttgttgttcctgtcctaagagtttcccaagcacctgccacgtgggaaagctgcgtagatcttttctggggatgaagcctacatagaagaatccacaagtggccaggcagaccccccactgccaaccatcacagcaggactctctgaatgccacctgagcttcattcactgcattaaagaagccaaacaggacctccatctgactaaagccagctttcctatggctaagaggcactgcacactcttctcaaactttatggtttaaaatgaagccatgtggaacgtcacaggtgcatccgtgatctgtaagcacgtctgaagaagcatggatttctcaatccctggaacttctcaaaatgcccattgtgtccagtcacacctgtgggcagaaaggcccaactgggcaaatatcacacacctgtgcaaacatcaggcagtcggtgtggaggcttagatgacccagaagccagtccccagggttcctgttgaggttgaatgctcacacatacaggcccttccagctgccactcaggaggccacctctgtgactgggttgcccaaaatgacagctgggctttgttaaaaggtgtaattgtgtctccaagtgtccagtacagtgctcaggagggtaaatatcaaaatgcaccacccaggcacgttcagagtgttgggatacagtcagtgcaaggaggcatatttcaatgatgactatagtgggttgaaaagcgtcctcccctaccaaagaaaatctgtatccacctggtacttgtgtatgggaccttgtttggaaaaagggtctttgcagatgtattaataatgaaggtaaggatctttagatgagattattctcaattgaggtggtcctaaatgcagtgaccagtgtccttaatagaagacagatgaggagacacggacacacaggagaagaccacatggagacagaggccgagactggagtgatgcggccacaaacccagaacgcctggagcccccaggagctgggagaggcaggaaggatcctcctctagagcctccacaatgaactggataaaatcatggtggattgaacagtggcccgcagaaagatctgtccacagcctaaagcccaggatgtggaatgagatcttacttggttattagaaattttgtagatctcatgagttaaggatctggagatgagatcatccgggatttgagtgagccctaaatgcagtgacagatgtccttataaaagacagaagaggagacacagacacagagaaggccacatggagacagaggcagagactagagtgatgatgtggctggcctgaagcccagggacgccaggagcccccaggagctgggagaggcaggaagcaccctccgcgtaagcctccggagggagcgcagccctgagacactttgattacagacttctggcctccagaactgggagagaataagctatggttttaagccctccggtttctggtactttattaaagcaaggtattctgaaggttaattttgcccgaaataatgagtggaggtcttagaaaggccccccgtcttcacgggcagtcgcggcctgcgttgctggctttccgtcaacggtgcccgcccagtgctttttagggagacgccgccacgtgccaggtgagctgggcattgccagagcccagcagtgccacttcccaagactggggtgcaaggaggggggtcctgtggccaatgccagcaccctggtttgttctaaggtgctgagagaatgaataacatgaccgggacttccacaaaacgaggaacccccaaactgcatcttctgcagccgagttagggtggggcccctggattacacagtcaacggagggggaaaagaatctcaagaggcctcctaagtccgacctgagtgacaggacacagctgtatcagatcctccatcatcatcatcatcatattattatttggctgaaacaggttttggtaattgggaggaaaaggtttacattccattattattatttgtgctattgggctgaaagaggtcccagtcctcaaacaaaagtttaaattctatttattattattattatcattattattattattatgtggctgaaagcggttctggaacctgaaggaaaggtttcaattccattattattattatttttattattatgaagattaggctggaagaggtcccagtaccagtaacaaaggtttatattctaattattattgttacggttgttattattattaggctgaaaaaggtctcagtacctgtagcaaagatttttatgctggcaccaggcacagcggctcacgcctgtactctcagcactttgggaggccaaggtgggtggatcatctgaggtcaggagtttgagaccaccctggacaacatggtgaaacccctcctctactaaaaatacaaaattagccgggcgtggtagtggcacatgcctgtagtcccagctactcgggaggctgaggcacgagaatcgtttgaacccgggaagcagaggttgcagtgagccgagatggcgccattgcactgtagcctgggcaacaagcgcaaaactccgtctcaaagaaagaagaaaacaaaaaaaaagatatatatgctattattactattgtttttaggctggaagaggtcccgatacctggaagaaaagtttgtactcggttattattatctgtctgaaagaggtcctgaaagctggagcaaacatccatattctattattattattattattgtgattgtttgactgaaagaagtcccagtgcctggggccaaggtttatattctattatcattgctgttattattatttggctgaaacaggtcctggtacctgtagcaaaggcttatattattacattattattattattaggctggaagaggtctcgacacctggaacaaaaattttcattctatcattattattattattaggctgaaagaggttctagaacctggagcaaaggtttttattctattattattacttttgttattaggctgaaagaggtcccagtaacagaacaaaagtttatattctattttattactatttggctgagaaaggtgccaggacctgtagtaaaggtttatattctatgattattattaggctgaaagaagtccgggtacctggaacaaaagtttatattttattattattatttagctgaaaaaggttctggcacttcagtcaaaggtttatgttctattattatcattattattattatttggctcacaggtgtcccagtacctggaccaaaggtctgttttctattaatactattcttattattactatttggctgaaaaaaggttctggtacctagagccaagttttatattccactattattatttggttgaaagaggtcccagtacctagaagaaaagtttatattctattatcattataattattattactgtcattattgttggtctgaaagaggtcctggtactgtgaacaaaggtttatattctattattattcttatttggctgaaagagctcccaggacctggagcaaaggtttatattctatcattattatcattattactactgttattattattactgggctgaaagaggtcacagtaccctgaacaaaggtttatattctattgtcattattattattattgttattatttggctgaaagacgttccaggagatgaagcaaaggtttatattctatcattattatcattattactattattattattattactgggctgaaagaagtcacagtaccctgaacaaaggtttatattctattatcattaatattattattattatttggctgaaagacgttccaggacgtgaagcaaaggtttatattttatcattattatcattattcctattgttgttattattattgggctgaaagacgccccagtaccatgaacaaaggtttatattctattattattaatattattgttattatttaggtgaacaaaggtttctattctattatgatgatcatcatttggctgaaacaggtctagtacctggagtgaagttttgtactaagagccaaaattcccaaacccctaaccaagtgactcctggaaggagaaacaagaagctccctcccacgtctcctgctgtcagaattccatgggattcccaggtaaagaaccgtccacacagtaggtgggttccacctgaacccacgtaacagccacagcagagctgaccttctgcagtgagtaccctccttcctccttcctcctcccttgcagcgcttccgagcacacaaggccacgaataaaggttgctgtaaaccagcctctcactgcctcattcttcaagactggtgcagcatccccagtgcggggggaggggggtttgggggggacactccccaaaacgctctcagggggccggcgatttcacgtttccaattgcacatccatgagaggccagtggatgtgcctcacatgactcttaccagaacgacacgtcgcaagagaccagtgtgaagaagcagaggaaggagccagccgccatccgtccctttatggatgagactgacaaaaccctaaaactcagccactcttctccctaggtttttgttattttggaaatgacaatcatttttcttttaaaaaacatacagcacatggccaaagggtaccaagtttctgttcgacaggaggaatccgtttcagtgacctactgcacagcgtggtggcgatagttaatagtgtattacatatttcaaaatagctaaaagaggtttttatttttgtttttgtttttttgtttttttggtttttttgagacggagtctcgccctgttgcccaggcttgagtgcagtggcgcaatcttggctgactgcaacctccacctcccaggttcacaccattctcctgcctcagcctcccaagtagctgggactacaggcgcacactgccacacccagctaattttttgtattttagtagagatggggttccactgtattgcccagactggtctcaaactcctgagctcaggcaatccacccgcctcagcctcccaaagtgctgggattataggcatgagccaccgcacccggcccgccaatagagattttaaatgtcttgcgtgcagtgtatactgcttgggtgatgggtgcaccagaatctcacaaatcaccactaaaaaacttactcatggaatcaaacaccacctgttccccaataacctatggaaataaaaaacaaaaatagctaaaagagattttaaatgttcccaccgcaaaggaaaaatagcgggtgatagatattagtttaattattccacaatgcaaacatacagcaaagcatcacactgtgccccataagtgtacacatttatatatttatataaaaatatcaattgtttttatttacatctaaattatataaatataacttatttgtattttatatttatagaaaagtataaattattctaaaaatatatatatttaataaaaataaaatataaaaacaataaatatattacatacatttttgtatgtaacatgtaattggcctgttaccattacttttaaatagattgttaaatatgttttaaatttctgttttaatgtctaacaggatgacttattgactgttataatccacaaaaacaaaaactgtctggggtcctcattttttttgaaagagattctatgatcaaggaattggaggccgggggcaggggctcacccctgtaatcccagcaatttgggatgccaaggtggactatcacctgaggtcaggagtttgagaccagcctgaccaacatggagaaaccccatctcactaaaaatacaaaatgagccaggcatggtggcacatgcctgtaatcccagctactcgggaggctgaggcaggagaatcgcttgaacccgggaggcagaggttgtggtgagctgagatcacgccattgcactccagcctgggaaacaaaagcgaaacttggtctcaagaaaaagaagaagaagttggaaaactgctgtttttacttctacctgatttctaatagccactgttcactactcataaaaccaacaagaattaactttccctttacaggttaaaaaaaaaatagtttgaaaagtaggacttctataaatagctttgtaagtgggccagttggcatattttttgtaaatactcactcctgtggtacagcatttacgaatccattttgcatcccagaaagtgaaggaatattctgtggcctattatttacaatagaacttttaagaaaaattctgtggcagtattggaactggacttgactacaggtaccatcaattttctctcctttgcaaaactcattgatgtatcagagaaaatgtaatttctaaacagatcaccctgttattaataccggtgggtagagactttctttactcaatatgatcattttcaacagatttcaggccatatcaatgttcaagttttgatgccatattaggatattaaatgcactgattaaatcatctattttaaaatccaaccaacagatacaacttactgaatgggccgcatggatatagtcttaagaacacagagacagaccctcttatgggaattctcaatttgcttctaaaccccctctgtaaaggcatgaccaacatctatgattaatttgtaattatcttgtttttccatgatgaactgtaagaagacaccatttaggagtggattccagccacaatttcttccttctcataccatgtaagtcaactcatgtggaaggtgtaacccaggcatttcctttgtacgatacctaagaagaacacgctccatttggaagttctaagaaaaaactgcccttgcttccaatctgcagtggggaaattggccctcttggttattcaaacagcttagctcaaatgccctggacaaagttcaatgtttcctcaccaacagcgaaggcctaccagagagaagcaaataaaaaatgccgtttaggaagctggccaccagcagaccaaggacaacagcattcctccactggtatcgaaaattatttttaatccatacataggaaggggctcgatgagggcaagccacttaagttaatctttagagaaggccattctgtttcgatacacacccgggtacagattcccttggcagacacgtgacttcaccagaagctcgtcctctttaacaaccttctgttgttgtttaatcagtaaatgggaaaaaaaaaaaaaaaaaagattccagccctttttctaatgcacaaagagcaagtttttcaaaggccagcattttggtgagctgctgcaggaaccccggcctcttctgccagggcccacacaggcccttaaggaggtttaaggggacctttctgtaagcaaaactgcccggataaacataatcttctgcgagactccacacaattgttcagcagctgtaaaccgttcaccttgcaactgattacttacttcaaacaaacatgctctcctgccctccgaaagcctgactacagttccctttactctccttcttctatgcatttgtaattatgctaagtgggtttaaaaaaaaatactgaaggccagtttggcagaaaaagaaaagcttagctcacagaaaactcaaagctctttttctctggctagaggcgggagagagaggctcattttaaaacatccactccaggcacgcttctcaaagggtggcgctgggacccctgggattccttcagtgggtgcagagtggaagtcaaaagtcatttcacaataaggcacccaagcgcttcgcctggctgactcccagtctcccagaggcgtgcagtagtgtcttccagaggcctcctgacatgccatgaaactgtctacagaggcagaaataacagctctcttcttaggctggacatttaagacattcagggcaacgtacacccccacccccaccacactgaccctctgaacgctctgttttggaaaactgttatttttgaaacaaagtatcatttaacctaacatggaattaacattccctttattccagttcacaaataattgtttacaggtttctaggtttaaattgagaatatgggctgggcacagtggcgctctgtctgtaatcccagcagtttgggaggcccagactggaggattgctgcaggccaggggttcaagaccagcctgggcaacatggtgagatgccatctctacaaaaaatttaaaacattagccaggcgtggtggctcacgcctgtaaacccagcactttgggggacccaggtaggaggattgcttcggcccatgagtttcagaccagcctgggcaacgtagcaagaccctattgctacacaaaaaaattaaaacattagacaggtgtggtggctcacacctgtaatcccaacagtttgggaggcaaaggaaggaagatcgcttgagcccaggagttcgagaccagcctgagcaacatagcaagaccccgtctacaaaactttaaaacattagtcggatgcagtagctggtgcctgtaatgccagcactttgggaggctgaggcaggaggactgcttgagcccaggagttcgagagtagcctcggcaacagagcaagacttcatctctacttcctattacaaaaaataataataataataaattctgaacctgcaaatctaggaacagaagttatctgcatacacaaaacacagtggcggtcatcactgatgagttcagacagtgaacgagtcctgcaaagttggagatctgtgactcagagatgtttacaaaggccaaggaaacaaagttgccacttaacgggcctgccctccccaccagacctccgtggctccccagtgcccgagaagccgcctctgggccccctctggagacgtcctccggagaagggcccatcctcacttaccctggggtgggtaggggtcgaggtccctgggacgcccgctcctcccctccggggcctggcgggggcgcgcggtcactggccgaccgcaggcggcaggcagagccgcctgatgtcttgggcgcggggcgtgcgagcccccgggtccccggccatggcccggaggtgtcagggtgcgcgggggggcggctgcacgggggctgcttggttggagcccgacccgggacaggcggggaggccacacgcgcggggagggaagggtcgggccgggtcgggccgggccaggcgcgcagaagagccggcggggacggaaagcgcggggcggggaggtcccagcgcgcacgccgccccccccccacccccggccacacctcgacccccgcccagccccacttccgggagcgccaccgcctcgccaaggtcacgcggagcccccgcgcccccgcccccgagccagcccgcgcccacccgggtccccggagccctgacccctgccccgccccgctgacctggctccaggaagcccccgcggcagcgccgcagcagctgcgccaggatcaccgcggcgcctaccgcgtagacccgcagggccgcccgcgccgcagacaatggcgacatggctgccccggccgcgccgccgccgcttccgcgccgcccgcgggactct

SEQ ID NO: 2722 - DNA, 43102 bp, Homo sapiens
catagaggcggggctgcggcggctgcggtgttcctccgacttccggacatctccctgggagtcgcgcagagtggagtcaaaggcaaccagtgctcgctgcggtctctggggatcgggaccgcggcggcggcccgcgagcgggatgttccggggcttgagcagttggttgggcttgcagcagccggtggcaggcggtgggcagcccaatggagatgctccacccgagcagccgtccgagacggtggctgagtctgcggaggaggagctgcagcaagcgggagaccaggagctcctccaccaggccaaagacttcggcagtgagtctaccctggctctgggaccgggaaggggggggcgcattcctcctctgggacggccctggggcgcgggcccgactggctgggggatgagggggccgaggtgggaggcaggggaggaagatgtgtctgtcggtcagtcctctccgggtcgggagagattggtgaggatctggacgaggccagagcttcatctagcagtcaggtcctgtccctgaagttcctggtgacaagtctacaaagtttgcagacattggaatcaggtatgcagtcaagcagtgtgacccgacgtcttcaggtttgacaaggaatcttttttgttcaactcgaaaaccttcatttacaccccccagatcggggatagttggcgagcttgaattggttgaaaaaataattttttgcccctaggtcagaacgtgttgtctgaagtaaactgacagttactgaatgtcaatgtctgccccggtcaaatgctttttaggtacagagacctttttccttaaggagggagagaaaatgccaactgtctgctatacgcaagttgcagtactagatgttttatgaaagatatcccatttcatctgttaaacacccccagtgagttgggggaacaagcccagagttattgggccaaagttatactgatagtgagtggtagaagtggaatttgagcttcgatctttctcattttaaagcccgtgctctttccaagtttacagtctacaggggttgggggacaggtgataatagacgtggagtaaacacatgctgtagtaattctcatttctggagagaccatggtgggcttcagtgatcacagaaagcatctttgaggccggatatggtggctcaggcctgtaatcccagcactttgagaggctgaggtgggcggatcatgaggtcagcagttcgagaccagcctggccaacacgatgtaaccccgtctctactaaaaatacaaaaaatagccgggcgtggtggcgggcacctgtaatcccagctactcaggaggctgaggcaggagaatcgcttgaactggggaggtggaagttgcagtgagctgagatcgcaccactgcactccagcctgggtgacagagcaagactccatctcaaaaaaacaaaacaaaacaaaacaaaaaagcatctttgaggaggtgagccctaaagcagcccagcactacaagtgagagaactgcaacaaaggtagatactaagttcagcaacatttgaagaatctactaaaagatgggggtggggggatgggggtggagacagggatgtgggaggagagcagcctgagagtagataaacacatatttgagtaagaaagggccgaacagtttttctggagacagggtctcactctgtcgcccaggctggagtgcagtggcacgatgttggctcactgcaacctccacctccagggttcaagtgatcttcctaccttatcctctccagtagcttggattacaggcatgccctaccacgcccagctaatttttgtatttttagtagagatggggtttcgcgatgttgggcaggctgggccctaacgtttaaaagtttactgtgggatgaaaggacagggaaaacagacataatctcaaaccatgacagtgtataatctcagcccaaggcccccagatagaatagtcttgctctgtcgcccaggctggagtgcaatggcacgatctcggctcattgcaacctccacctcctgggttcaagcaattctcctgcctcagcctcctgagtagctgggactacaggcacacgctgccacacctggctaattttttttttttttgtatttttaatggagacagtgtttcaccatgttggtcaggctggtctcaaactcctgatctcaagtgattcacccaccttggcctcaaagtggtgggattacaggcgtgagccaccgtgcctggcccctctgaatattttctaataactgcatttttcatatggatgtgtactttggagctaatgctgccatctttctgctcaccagattctcttttgatatttacggaagctgaggttagatggaagtacccacaaacacacacacattgtgaatttaaagcttcagaataaatgagaattctttcttttctgaaatttatgtgattttagaaagtcgtaaaggttctagttcatatacaaactgtgagagacaagagagatgatcagatattttttatttctacatattgatcctaagaagtatattgtctttaagaagacccatttatgttttgaaaactggaattaaacatctgtgagcctgactcccagagtagattcatttcttaagtcttttgaaatctacataaaatatcagccgggtgcggtggctcacgcctataatcccagcagctttgggaggccaaggcaggcagatcacgaggtcaggagatcgagaccagcctgaccaacgtggtgaaaccctgtccctactaaaaatacaaaaattagctgggcgtggtggtgcgcgcctataatcccagctactcaagaggctgaggcgggagaatcgcttgaacccgggaggcggaggttgcagtgagccgagatcgcgccactgcactccagtgtaggtgacaaagtgagactgcatctcacaaaaaaaaaaaaaaaaatctcctgggagccccatttgttctgcatatatttgttgagtgcctaccttcaagactggacactaaatacttcctggttcctggtgacctatttatacattcaggcaactcaccagttagtggtggacacccaggcctgcattccactccctcactcaaaaccaaacctcctggtctcctgattcttggccctccctcctgataaatttacaacctccgattgtcactgtctccaaaggaaggaacaatttataggagaactcacttaagagctcctccctacctccctcaaggccccatgccgttaagttggttagttggtttttgttaaagtcaaccaaattaaagctttgcctctactctttctgaaaaaaataaataaataaaaagaaaatctgtacttctgagaatgttaaatatctgaatcagtcacacagtttacatcagtgggaggatggccaaagatgagctttgtgatctttagctttttctaaaccgcccctaaaactattccatgcctaggaatggggaaagggccacctcctcctcctttgaaaagtgctattagtattgcagtggacctgtgttagactgtcctccttttcttctgtagggaaagtatatttcaagttccagctgcctaacttgcaaactaagaggactcctaaagttagagtgtacagaggtgactatgtacctgctttgatgtgggagtaaaatatctaattgagttctgataacacacccaggtttacaatgcacagtcaatagcttggatcctagggcttatgaacaatactttttaaaattggggatctcgatttgaagaagaaacttagggacattgcagaaaatctgaaaggtcttttgcagaaaagaagtcgtagatgttccttatgaggatagacctgaggctgtggggtagaaatgactagagaagtgagaagaattttctgattagagttgagtaacagtaattactggctgcccttctaagtcctgtgctccctacccctggaagtggggctacctggataggaaggtccattcccacactaagatgctgaaattctaaaattgtatgaaatatagtatctttgaaaaattaaccaactactttataagaatattaatttcctaagactttgccactgtatgcttattctcttcctattcttgcggcaggccttaaactctaccttgctctgtgtttactttaacaaatttatgttttttctgacctttgaagctcttcctactttactttattcttaccattcctttcagttcttcaagcccttgtcaacttgctcaactgacctgaggcagcgtgggattggagcatgagcttgggatttagaggcagatagcctgtgtttgagttccctacactacttactgtctttattgttatatcatttgcaaattacagaaagtccagtgatcagaggcttaatgaaagaaactttatttttgtgtcagggagtccccaagaaccatccccaggtttgatgattggctaggaagacttatgggactcagcatatagttgtattcatggccgtgatgtattgcaatgaaagagtacaagaataaaatcaggaaaggaaaaaggcacatggggtggaagtccaggggtaagcaggcacagtagagtcacacaggacgtgcttaattcctctagcaaggagttgtgacaacacgtgtgagatgctgtcttccagggaagctcattagagactcagtgcccaggacttttactggggactggtcgtataggtatcctctgcctaccacatatccaaattccagaccccacaaggaaagcgggagttcagcataaaccacaatgaggcattcttagcagtttaagaaatggtgggagccctcccgaaatctaagttcccggacacccagccagtggccaaccttgaaagcaagcctttccaaggacagcagtctcaggcctgccatgttaatgcttttctgcagagtctccaagaaatgtggggatgggagggaggtcccagggtcagttccatggctcaacgatatgatcagggaaccaatctcttccacgcttcctctccttcatccatagtgagttggtttccatcctcaggctgatcacttcaggctcacaagacagcaactgcagtagaaagggaggacgaggactctccccatagctccctttttattaagaaagaaaatgtttctggatgccgacttgcaggtgtccccttaaatttcttggggtggagctgtcacatggcttttctaagcttcacgggactctcagcaagtatgtggcagagatcctgacagaggtagtgccattaccttctttggtgtggacttgtcaagattcattctctggggctggccacatgggcacgcatcaaaattggggtggttttaacaaggcagaagagatgggctactggctgggcagccagcaagatctgcccctatcacataggacaaatcatttttcctctgtgagcctcagcttccctttttttgaactgggcagattattccttctccttgtcccaggaaggttatgagaataaaacatggcataattaaaatgaaggtaaaataactactttaaatgttagctgtcggcccccaccttccagcaggtcgctaagtcgtattcagatacatttgaatttgacttccttttctttggcgctacttcgtttcagaccctcactttatggactgaagtggacattgtactcctgttacttcctgttaactcctatcttagtttcagttttttcctagacagttcataaaaactgtctttggccaggtgcggtggcttacagttgtcatcccaaaactttgggaggccaaggcgggtgggttgcttgagcccaggagtttgagaccagcctggacaacatagtgagactccatctctataaaaaataaaaatcaaaataaaaactgtcttcaacgtggtgtcagctgatctctttgcaaaattaataaatcacttcttgtctttatggacttcttccctgaaaatctcttgtcatgctctccatctcactcccaggccactctaataactctctggagacagttctccctccatgctgccacatctgcttaatgaataatcttgttcctctttttgtctttgattctctatttatttgttttgctttagagatggacgttcctggagggcaagaacttgtgctttctcagatattcagtgtgttcagtaaactccatccatggagtcattaaaatctaaggaatgcaatgattatgctaaaataccagtttttaaatgacagttctcccttggaataaaaatcattgtttgaattcaaaatatgtttctgaggaagggataaaaggaatttatttccaaaagaaccctcttcttttggaactttagatttgtttctctgactgcaaagcatggttttgttcctggaccaaactgagggtcaggctgctatttctcgtggcccaataacaagatgcaggtcaactgggaaggaagagagtttttatttctgtaagtggctccagggagaaggcctggaaattatcaccagaccaacgcaaaattagaaagttttccagagcttatataccttctaagctatacgtctacgtgttaagtgtgcactcatctaaagacataagtgattaacttcttttaatctataactaaggtctgagtcctgaagaccttcctctggagcctcagtaaatttacttaatctaactgggtccaggtgctgaggtgattacccttatcttgtctcctgctaaatcatggaggtttggggagttccttcagacccccaatcaacttgtttgtggaggcctggggagtctcttcagaccccccagtaaaacttacttaatcgtgctttaaggttcaggaaagtcctaggcaaaactcttgggcttttgttacatcccagcctttgtataaggtcactggcttttaatatttaacttaaccactcagtcagtactgaaacagttgtgatggaagcctatgttagtgagtcctggcctgccgcaatccccactgtcaatttgcgcatgatttctatcatgcttgtatatttatttatcatgagaatcgtagggagatggggcatcataatctttctggctactttttgcttagaggggctcatcattatggggcactgaatgcagcactgaagtagaagaggtcaacttgttcccggtagcactctctgtttcagaggcttagaggcagcacctgctgaaacataatagtatgtaacagcaacacatataaataggttactgctgttttcttctgaagtttaagttgtctagtcttcagttcacagggctttaagaaagcacagcttaggtttcagtgatttccaaataggaaaaatggggaaaaaggaaaaggaaaaggaaaaattgaaaacattattttgaagacctgtggccagaaaaattagaatttaatccaaactgtggaaaaaaataaaaactgaaaaacatcaggcatagaatttaacaacaggtatactatagtttttgaaacaaaatttttctctctctagtttcctatttttattagaagacaaatcatggtaggaccaatttgctttattgtacttggccagattatttgtataaagtgcagcaagaaaaatcattttcttttaaaataaaatttttttatttaatatatattttaaaaattaaaaaaaaaaaaacaggctttgatggaactttgttccatagaaggaatctgagataagactttttttttttttttttttgagacagagttttgctcttgttgcccaggctggagtgcaatggcatgatctcggctcactgcaacctccgcctcccgggttcaagtgattcttctgcctcagcctcccaagtagctgggattacaggcatgcgccaccatgtgcagctaatttcgtatttttagtagagagggggtttctccatgttggtcaggctggtctcaaactcctgacctcaggtgatccacccacctcggcctcccgaagtgctgggattacagaagtgagccaccttacctggtaagataagacctttttaaagccaagcccagccatggatttgtaccatgaaatacctatgacttgggtgaattcctctcctcttgaggtcccaagataacttggggttcctggcctgtcagaaggtgacattctttacttaccacagatcagaaaccctgtacagggactgtacacaaaatatgagggcagttttccaagggttttcttggctccctaagtcaagtttgattcattaaaggaaaacacaccattccagttaaagccttggtaaaataacaagtttttccagttgtgtcctgttataaatgaaaacagattcttattgaacttatgcaaataactatattgccataattaagaatactcacaaatagtttccaaattctggagaaaattgggtagaaacaaatatgctccacattttgttcatgggagtatactaaattgttaaaagctgtcagtagctcagaagaaaagtttccttgactctgaaaagtaaaacaaaggattagcaatattttaagcaaaaactcaaaaagatcactccagtctcctattcagttcatgcagttaattactgtcctgcttgatattaatgaacatgttagctcttcaggagtcctgaacatttttcctctgttctgatgtcacaatctccaaagttatcagaaacctgcattcaagagcacttgttagagctttatagctgattataaaatcaacttctaaagaggaccaaaacagccgggcacagtggctcatgcctgtaatcccagcactttgggaggccaaggcaggtggatcacctgaggccaggagttcaagaccagcctggccaacatggtgaaacgccatctctacaaaaatacaaacaaaattaggcatgatggcgggtacctgtaatcccagctacttgggaggctgaggcaggagaatcacttgaacccgggaggcggagtttgcagtgagccaagatcatgccgttgcaccccagcctgggcaacagagtgagactccacctcaaaaaaaaaactaaataaagaggaccaaaacaagacaacaattgttcatggatgacaaaaggttttcgggtagccataaagacacagttgaggctgggcatggtggctcacgcctgtaatcctagcactttgggaggctgaggtgtgtggattgcctgagctcaggagtttgtgaccactccaggcaacacagtgaaagcccgtctctactaaaaatacaaaaatttagccaggcatggtggtgcacacctgtaatcccagctactcaggaggctgaggcaggagaattgcttcaacccgggaggcagaggttgcagtgagccgagatcacaccactgtgctttagcctgggcaacagagcgagcagctatctcgaaaaaaaaaaaagaaaaaaaaaaagacacaattgacaaaatctgttacctctgtggcacacaataatttaacataattataattattactgataacgtacactgatatatcagaattataggagtttcacatgattttggaacacataccaataacatatttacacatatatggcccaaagaaagtcaaaccccattttatatttggcaatgcttcctgtgtggtttttggtactaaataagccaaatttcacctttacgttagtgtactattaatgttaaaccaaattcttattaaaacctcatagacatattgacacaattttaatgtttgaccataaggtaagatttttatagatcttttataaccctttataattttcgttgaagagcaggttagtgctttcaaagaaacctgttatgcttttattttattgattttatcgatttttttttttttttttagagacagagtctcactttgtcacccaggctggagtgcagtgatgtgatctcggctcactgcaacctctgcctcctaggttcaagcaattctcctgtctcagcctcccaagtagctgggactacagacgtgccaccatgcccagctaatttttgtgtttttagtagagacggggtttcacaatgttggccaggctggtcttgaactcctgaccttgtgatctgcccaccttggcctcccaaagtgcagggattacaggcatgagccactgcgcccagcctatgtgcttttattttaatactcaatttacagaaaaactggatgatactcttttaactttagccagtatgtttacacacagaatttcctttacaatcaatcttccacaacttgcttaaaccttcatctttattttatccaacttaaaacaatcctttaaccttttaatctaggcaaaaatccacattttcatgcctccttataatctttttaccaaaagcatattttactttccttgtaaatatgctttttaccaaaagcatattttacttttccatgtaaaactttcttcaggccgggcacagtggctcacacctgtaatcccagaactttgagaggccaaggtgggtggatcatgaggtcaggagttcgagaccagcctgaccaacatggtaaaaccccgtctctactaaaaatacaaaaattaactgggcgtggtggcaggtgcctataatcccagctactcgggaggctgaggcaggagaatcgcttgaaaccagaaggtggaggttgcagtgagccaagatcgcaccattgcgctccagcctgggcgaaagagcgaaactctgtctcagaaaaagaaaaaacaaacaaacaaaaatctgtttcttcagtagtgttaaatacatgttacactgttaactcttagcaacctttacttttggtgaaaaccttggtaagtttgggattttatgtactaggtgtggagcctaagatgtagacagaagtgcagataaggtctgacttattccagcatctaactccatgtgtcccaggccttatctagctgtaaagcaggcaagttgtacagctgagagtcatagtggcattttataaagcatttaagagacctaatcacctttaaattgtacaatatttgttgcataaattccgtttcataaattctttcacaacttacacagacaagctatgacataccttgactttctgacttgtcctaagcatccctctttttaaacatccagttactttactttaggacaagaatttgccatacaaggtcctttcttatataaaatctcttttctctaataccttttgcatagctagggggcttggctaatttcacatgtctccaggccttttctagaatctaatgctacaaaataaatcaaacaatgtttaagtcaaagaagcagtttatgatgcaaagcatttagcaaacctaatatttgacctgcataatttagaccaaatgcttacattttgaagatattttattttaccagtaatctttaaaactgtctttatttttataactttctttatatctctcttatttcctggtttcttttaccatgttttatatataacctttaaataagctttgagttagacaaaaattagttaccctttaaaaaggacacaatgtttagaaagaatattttcctacaatatatttttattggaaaatacccaaataatgaaatatctgttatttaatataactttagattcaaaattatgacatttgttatgagtatcccattacatttatctaattatttattttaatcatttacctagattatttatgaaaactgcagtagtcatcattgaaagttatgagaccaccattgcaaaattatagctgagacagtgaaagtgatctgccgtaactgactccatcttgcttctaacctccaagctattcttgttcattaacttagtttatagtttagctttgaaacaaagatgataaccgtcctttcccagaacaaacttcctttatgtctgtggactagactgcctaaggccacaagatcagaggttagggtattttactaaataattcaagatgtagctatcttcattaaaccaatatcagtgttttatttattaaaaattacacaagcagccgggcacagtggctcacacctgtaatcccagcactttgggaggctgaggtgggcggaacatctgaggtcaggagttctagactagcctggccaacatggtgaaaccatgtctccactaaaaatataaaaattagctgggcatggtggcagacacctgtaatcccagccactccagaggctgaggcaggaaaatcacttgaactcaggaggcggaggttgcagtgagccaagattgtgccattgcactccagcctgggcaacaagagcaaaactctgtctcaaaaaaaaaaaaattacacagcaaagttcactctgttttgggctgagttatcgttttgtagcctctatgccaaattttgataccttatagtatttggcagagataagtatgaaattgcttgatcaataaatgtaaacaaaaatatatgctggcaactccgaagacatttctaatattactttaccagtaatttttaaagctagcttatttattaaagattttacttaagtcacataaacttgaaaaagcatttgactagtctttctttttttctgttaaagtatttaagcacttctatttttctgtgagccaactaattagaactctttcgtatattttcagtagtgaaatagtttggtcatgctttaaggttcaggaaaggcctaggcaaaaaactcttgagcttttgttacattccagcctttgcataaggtcactggctttttttttttttttttttgagacggagtctcgctctgtcacccaggcgcccagctaatgttttgtatttttagtagagacggggtttcaccatgttagccaggatggtctcgatctcctgacctcgtgatctgcccgcctcggcctcccaaagtgctgggattacaggcgtgagccaccgcgcccagcccggtcactggcttttaatatttaacttaaccactcagtcagtactgaaacagttgtgatgaaggcctatattagtgagacctggcctgcaacagttttataaactagtgtggctgtctacccattttatcataccactctgtacaagtagagtagtcataactaaagagaaatgagtgatttcactcaatcttagcatttgttctgtcactccccattcatccattcaacaagtacgtactggtcactggtcatccgctggggatacagtggggtatcagacagcccaggtccctgcactcatggggctcagcatgggctttcagtctggctgagaagacattcaccaagtaatcggtagagtgttttgaagattgttgatcaggcaacagtcttcaaaacacaggatgtgcggagggaacacatctcaggacatccatcgtagtcaagggaatatttcctaaggagaagggatatttaagtggagacccacagcatatggagagttagccagataaagagagagcagacaaaaatgtttcaaaccaaggaggcctccttggaggtagtgaagaatttccatgtgatcatatgactgtagactgggaagaaggagaaagatgagaactagaccagagataagtagcaagtagcttcctgtggtatgtcctaggggtgttttgttggggttgacagataaacactaccagacacaatgggaggaagtagatttttaaatgggaagctggtgaaaggatcattcagatggagtgataatattactggctcccagacacctatacagtctgctggtttcctggaagtaataccacccacagaatgaggatggaatctgttgtgcagagctctctttgccattcttatgggaccttctccacctgcctgccccttcaacaggtgtaagtaagagaggcaagaccgccctaatgtgccagctatttctcatgagaggaggatgtcaattgcctgggagcatcccccagcaggtccagcttcaagacctgcctcaagtctctttcagcagcctggattctgtaggatgtggactttgaaatgatatttgtctacaaattagccctttttttttttttttagacggagtctcgctctgttgcccaggctagagtgtagtggcgcaatctcggctcactgcagtctctgcctcccgggttcaagcaattctgctgcctcagcctcctgagtagctgggattacaggcgcacgccaccatgcccagctaagttttttgtatttttagtagagacggggtttcaccatgttggtcagactggtctcgaactcctgatctgcccgcctcggcctcccaaagtgctgggattacaacaaatgagcccttatagtgcaatagaaccttgacacatgtcttttcacatcttccagaaagctaattctgtggttttgttttgtaaaaactggaagttttatgggttccacttttaatcttgttctacttatttgctcattattattaagaatgatttctagtccaggcttggtggctcacgcctgtaatcccagcactttgggaggccgaagtgggtggatcacctgaggtcaggagtttgagaccagcctggccaacatggtgaaatcccatctctactaaaaatataaaaattagccgggtgtggtggcgggcgcctgtaatcccagctacttgcagggctgaggcatgagaatcacttaaacctgggaggtggaggttgcagtgaactgagatctgagatcacgccactgcactccagcctgggtgacagagtgagacttcatctcaaaaaaaaaaaaaaaaagatttctgtttctactagggcttgccaagatttctatttcttatttaaaattcccccagatttatcatgggacatgttaatttgagaaaggaggggcattttttctttgaacaggagggaaggaggagaaaataaagatggcatacatgagatctagaaaggaagaaaagtataaaggagccttgttcttcctggcaaagtaggagggtagattatttactgagataaattagaaccagagacttgagcaagaaaattttgaagcagctactgggaagagtatactaagggtctttgaaagagatgaatgaggccaggcccggtggctcacgcctgtaatcccagcactttgggaggctgaggcaggcagatcattcgaggccagaagttcgagaccaatctgaccaacatggtgaaactctgtctctactaaaaataccaaaaaaattagccgggcatggtggcaggcgtctgtagtcccaggtactcgagaggctgaggcagaagaatcgcttgatcataggaggcagagcttgcagtgagctgagatcacgccactgcactccagcctgggtgacagggcgagactgtctcaaaaaaaaaaaaaaaaaaaaaaaaaacaaaaaaagagatgaatgaaaggcccagtatgattggccagtccaccaagaaagtggtgcttttcatcactgtcagtgcttctcattacttgtttcaggtccttatgaacaaggaacatgccctaatgctttagattctcataagatctctttaagggaaaaatctcaaacataataaccacagattctttttattctttacagactatttatttaactttgcatctgctgccacaaaaaagataactgaatcagttgctgaaacagcacaaacaataaagaaatccgtagaagaaggaaaaatagatggcatcattgacaaggtatattcaattatcttttggaagtagaaatgtatgaaattcattgtttcctcttgatggtttcttcttcttatgaacattttttaacctaagtagaatatcatattctgataaaaatgttaattgttgagatttttggttttttcctctctttgaataacaagtaagtatcattaaattacagtacttgatttaaatagctgtttttattttaatatattacaatcaatacattgatacttgggggttatactaaacttttcatgttggttgtttgtttgtttgtttgtttgttttgagatggagtctcattctgtcacccaggctggagtgtggtggtgtgatctcagcttactgcaacctctgcctcctgggtttatgcaactctcctgcctcaacctcccaagtagctgggattacaggcatgcgctaccacacccagctaatttttgtatttttagtatagacggggtttcaccatgttggccaagctggtctcgaactcctggcctcaagtgatccacccgccttgccctcccaaagtgctgggattacaggcatgagccaccacgcctggccaacttttcatgttgtgagtttaactttataactgtttgaggatatatttatgcctttgcatcatgcgactaaggtcctagcccattaggaacaacccttttaagactctaaggagtgagtttgttttttgcagtgggcctatggcatttcatttatgttggtagatatttgaactaaggaagtcatcaattaaaccttagatacattgctatttaatttgactatgtattttttttaacagacaattataggagattttcagaaggaacagaaaaaatttgttgaagagcaacatacaaagaagtcaggtatggtataggtttgtcttaattaacctgccaggttttattgagcacctgttatgtgctagataccacactgagggtctgagaacacaaaaatgcatatgcaatggccccatcctttgggtagcacaaagactagtgagggagacaaacccataaacttccatgatttaaaggaagggactagattgtttctgggtgagggctgccagtgctggccccactggggagctggctgtgaaaggggcaagtaagctttcagttctgactttctcttttcttttcccccaccgagatggagtcttgctctgtcacccaggctggagtgcaatggcgtgatctcagctcactgcaacctctgcctcccagattcaagcaattctcctgcctcagcctcccgagtagctgggattacaggcacgagccaccacacccagctatttttgtgtgtgtgtatttttagtagaaacggggttttaccatgttggcaggctggtctcgaactcctgacctcgtgatccgcccgccttagcctcccaaagtgctgggattataggcatgagccactgcacctggcctcagttctgactttctaccacatgcccagcacagagcacagtatgcacatgaccggcatttagcaagtggtggctccgttcctgctgtcttcaggagaaaaaatggaagagcttccgagggaggcgagtgaccgcacctgcagtgacagagggccgtaaagagtctcgggtgtttggagaacatactcaatacattactgctgacacatgcctctgaagttataaggcctcagcatgcctactcttaccattttgtagcacccaaacacaaaaccagcctcgtgtctttagatttggcaaaagtagtataactgtaatcccaacactttggcaggccaaggcgcgaggatcacttgagcctgaacttcgagaccagcctgggcaacatagtgagaccctatctctacaaaaaaataaaaagaaattagccagatgggtgtggtggtgcacacctgtagtcccagctacttgggaggttgagacaggaggatcacttgagcttgggagtttgaggctgtagtgagctataatcatgccagtgtactccagcctggactacagagtgagaccctgtctcaaaaaaaaagtagtagaaaacaattcagttcgagttgtgccacagttaatcccatggtgaatttccatcaggcattcttgcacctaggtaaactcaaaagcatgagcaactcttttagacaagtgaggtatacaagttagcatcacttagtgattatttggaagcagcaaaagtgatcctggcttggggacttgctgtaggagctgatgcctctgagatacgaactgtgagggcgtgggggtggaaggtttggaggcaacttcagttttgaagtgagttagacatcccggagataggaacatgtagaaagacaggaaagagaacacaagtgctttatctggggaaaatttccttctttttttgcatcagccacgtttcaggtcctcgataactacatatggctaatggcttccgcactggacaatgcagatatagaacatttttgtcattgcagaaagttcgtttgctcagtgtggctctgaattaaataagcaggctcctgcagcagtttattcctgtttgaagcatgaagcagaattcaatctagtgatatagattattatcaagtcacataaaaaccatgagagtagatgagctcctctatggaaagtgtgtcaagcatgaagggagatgagcagaagctccacagtgtttagggaggggaagaggggaaggaattgacatcactgagtgcctgctgagcagcaggcattttatatataacatctcatttcaagacgcagtcagggccaggcgtggtagcttcatgcctgtaatccgagcactttgggaggctgaggtaggcagatcacttgaggccaggagtttgagaccagcctggccaacatggcgaaaccccatctctactaaaaatgcaaaaattagccaggcttggtggcacacacctgtaatcccagctgtctgggtggctgaggcgcaagaattgcttgaacctgggaggtggaggttgcagtgaaccgcgattgtgccgctacactccagcctgggtgacagagcgagactctgtctcaataaataaataataaagatgcagtcagcaagggtaagtaatttgcggaaggtcactcagctggtaagtgatgaaactgaaatttgccttcaaaaccaaatacaaaaattagctgggcctagtggcatgcgcctgtaatcccagctcctcgggaggctgaggcaggagaatcacttgaacctgggaggcagaggttacagcgagccaagatcataccactgcactccagcctgggcaacagagcaagactccatctcaaaaaaagaaaataaaaacagtgcccgtttacccaagagagtggacaactaggagagagaagtagcagaagcccagagaggggagagtttccaggagagcagtcagccatgggaggcagggccaagaggtccacttacaatgaccatgagaagggcaccttggaaatgtgttccatgcatttcttcacttcataatcacagtaactctataaagtacttactgttacctccgttttccagataaggaaactggcctagagagaagagaactaagaagtgtccttggggttggagaaccaagaggttttggtcactctaaaaagaataatttcaggaactcggggtggggagcatctcctcatacaagtatcttaggagggcctcattatctgagcataaatagcaccaggagagactacccaaggtgaagagacttggaatggagactaaagtgtgtgagaaaaaatgttttgggggctttaccctaattttttctttaaaatgtgcaaatatgtttagattatcttatcattaatagaatttggattataattgccaccatttgctgacttgggataagccaaagaatgaagcgtgtgctcatctgcctatccatccctgtgtccatccacacatgcatgtaacttttctctcagtgggctcgtgatatgatatgtcttccctctgactcagagcataatagtaaagggactatttctgccaaaatattccaggacagcaaagcatttgctctccaagggcctgccttaattgcccctttggttttcaaatcactctctctctcttttttttttttttttttttgaaacggagtctgtctgttgcccaggctggagtgcagtggcaccttctcagctcactgcaacctctgccccccgggttcaagcaattctcctgtttcggcctcccgagtagctgggaccaaatcattctcttttaaagcacttgctgggtcaccagccttgtgtttccttcaggcataggtgccctaactgccaggtcctccttattgtttgctttgtggtgatgcaggcagctatcccatgtcactttactttgactttgtgaagcaccgtgtgttttgcaagatttgccttttcactttgtgttgcaagaccagtagggctagaatctagtgttaaggcagcaggagtgattcagtggcttatgaattagtccacatttttgtgacttctgcttcccatcctaatcttgccgctgtgggttgctgaatgaggctattaagggccccctgcctgtgtgtcttctgtgccgatcacgcagatctgcagccttcactctgctctctagctgctccgtgctgcttacatgggagagatcttcagacgagcttgccattgtttttgtttccactctaaacacccccacccccatccaccactgacctcctcttcctagtccaagattgggctcctaggtcaccagaaaatcttgtagttctcacctctccagagggttgtcatttgtcacctggcacggcacttacagtgctggattctaatcacctctatcttgtgagccccagaaaaacatgggctagatcttggcattcccagcatttagcttctaacggcttattgaggatttgattccagccctattgtttactgcctccaacttgtgcatttctttttttttttttttttagctcctgaaaaccctcttcttattcctaatcacctgtcttacaacatcaccttttatcatgaatcaagtacagtaactttctttttttttcctccagaaatatacttacccatttttctttcatttttttaagtaactttctaaaaatttttctatttggaaaaaattttaatttacagaagagtcgcaagaataaaaatagtacagagaacacccatataccagtacctaaattgctctagctttattctgtttgccttattcacgccctctctccagctcttgctgtgtgtgtgccctttttttccttgtgtgtacacaaatgttcagtacacatttcctaagaattagggatattctctttcataatcatagtatagttaacggcattaggaaatttcaccttgatgcaatactttactgttcatcagttaattttgttagttgacccagtaatgtcctttataacatttgtccccctcgtataggatccagttgaggataaggtattgtattctttgtcatgtctctcagccttctttaatcaggaacattccaacatcctttctttgtcttttatgatattaatatttttgaagaatacttctcttccttttttttaatagattctttctcattcaggctttatctgatatttcctcataactagactcagattgtccatttttagccagcatactacataggtgatgatgtccttctcaagataccacatctggaaggccatgatgttcatctctccctcattgttgattttgatcacctgattaaggagttgtccagtttctccactgtatcatttaagtagagttttttgttttttgttttttttctgagacagggtctcaactctgtcacccaggctgaaatgcaatggcggaatcacagctcactacagccttgactcctgggttcaggtgatcctcccgcctcagcctcccaagtagctgggactacaggcacgcacaacgtctggctaacttttgtatttttttgtagagagagggttttgtcatgtggcccaagctggtctgcaactcctgggctcaagcaatccacccacctcggcctcccaaagtgctgggattacaggtgtgagccaccatgcctggcctcaagtagagttttttttttttttaccaaatgcatatgtgcatataactcataataataagtctggttattacggttaatgttcatatttggaacttattggtaaattgctacttttagtggtcatgcagaaactttcatgctttgaaaccatagactgcagtgtaaccatcatgacctatttttttctcttttcttctttgccattaaaaactgtatagaagcagctgtgcccccatgggttgacactaacgatgaagaaacaattcaacaacaaattttggccttatcagctgtaagtatcttgtggtaccccagatagaacatactttcttctgtcatgatatatctctgttgatgtgactttagtagaatttatttttctatacagtttttaaaatattttgagatgttaggaatgtacacattaacacatgatgtgtacattaacaaaatgtacacataaaatttattttttattttttttttgagatggagtcttgctctgtcacccaggctggagtgtagtggtgcaattttggctcactgcaacctccaccacccgggttcaaatgattctcctgcctcagcctcctgaatagctgggactacaggcatgcgccaccatgcccagctaatttttgtgtggttttttttttttttttttttttttttgagacaaagtctcgctctgtcacccagcctggagcgcagtggcacgatctcggctcactgcaaccttctcctcccaggttcaagcgattctcttgcctcagcctcccaagtagctggtattacaggtgcccgccaccacgccctgctaatttttgtattttgagtagagacggggtttcaccatgttggccagactggtctcgaactcctgatctcgtgatccaccctcacctcagcctcccaaagtgctgggattataggcgtgagctaccacactcagcctaatttttgtgttttcagtagagacagggtttcaccatgttggccaggctggtctcgagctcctgacctcaagcagtccatctgccttggcctcccaaagtgctgggattacaggtgtgagccaccatgcgctgccaaaatttttaatttaatttgttttgttttgttttgtttttgttttaagagacacagtctcaattggtcatccaggatagagtacagtggcataattatggctcactgcagccttgaactgggctcaagtgatcctccggccttagccttccaagtatctgggacgataggcgtaagccaccatgcccagctaatttttaaaattgtttttagagatgggttctcactatgtttcccaggctggtctcgaactcctggcctcaagcgatcctcttgcccaacttcccaaagtgctggattatagccatgagcgactacaccctgtccgcttctattttttttttttttttttttttttgagagtctcactgcactcctgctggtcaacatagcaagactgtctcaaaataaagaaagaatataatatttccccagtctatgataaattgttatgtagtaggccaggtgcagtggctcacacctgtaatcccagcactttgggaggccaaggtgggtggatcacttgaggtcaggagttcgagaccagcctggccaacatggcgaaaccccatctctagtaaaaatacaaaaattagccaggcgtgctagcacacacctgtaatcccagctactcgggaggctgaggcaggagaattgcttgaacccagggggcagaggttgcagtgagctgagattgcaccactgcattatagcctgggcgacagagcaagactccatctcaaaacaaaaataaaattaaaaaaaaagagtgggcgcattggctcacccctgtaatcccagcactttgggaagccgaggcaggtggatcacgaggtcaggagtttgagaccagcctggccaagatagtgaaaccccatctctactaaaaatacaaaaattagccaggcgcagtggcgggtgcctataatcccagctactcgggagactgaggcaggagaattgcttgaatccaggaggtggaggttgcagtgagccgagattgcaccactgcactctagcctgggtgacaacccgtctcaaaaaaaaaaaaaaattgttatctattaatcgcattttgtggaataccctgtgtttttttctttttttatcaaaggacaagaggaatttccttcgtgaccctccggctggcgtgcaatttaatttcgactttgatcagatgtaccccgtggccctggtcatgctccaggaggatgagctgctaagcaagatgagatttgccctcgttcctaaactgtaagcagagtgttctccagcgtttcctcatggcctccattatgtgctcagtatcagcacataatgatggaaggggccaaaagggtctctatctgttcataaaagcaggccccgcagccctttggcagctcccctggtcagggcactctggaatcaaaaccaaggtctgacttggcaggaaatacagggtagaggtgaaatgtgcttttctatcccagttacaaggtagaacacatttccctacagaaaccacaaacatgctgcatcaccctgaatcacattctggtctctgaggctcatcgggatcttttttccaagctgactgcattttccattcaggctctgccctccagtggcagtgttcctgctctctttgctaaggcttttcctccaacagctcttctgggctccacaaatcccagcttgtcctgtaggctccagtgcatgcatgatgcattctggaagcctgccttggtggtgcggccaacaggggccaccttccccgctgctgcttcccttgggtgttctgtctcaagctcttccgtgccttctccagtccagtcccttgtattgaagctgtcgcatgtttggagtcagcgttccttcttattctgtcattgttccctttctcttaaccttgtcatatgggtgcagtatcttactgttccctgagtacgttagttacagttctctcaaaagactcctttttcagctgggtgcggtggccaatgcctgtaatctcaacactttgggaggctgaggtgggaggatcacgtgaggttgagttcgagaccagcctgggcaacatagcaagaccaccatctttacaaagaaaccaagaattagccgggcgtggtggtgtgcacctttagtcccagctactcaggaagctgaggcgggaggatcatgtgaggccgagttcgagaccagcctgggcaacatagcaagaccaccatctttacaaagaaatcaagaattagccgggcgtagtggtgcgcacctttagtcctagctactcaggaagctgaggcgggaggaacacctgagcctgggaggtcgacgctgcagtgagccatgatcacgccactggcattccagcctgggcaacagagtgagaccctgtctcaaataaaagacagactcctttttctatgctgtttcctccctcgggactcttttgtttgtttggggatctgtcgtttatgtggcagactctccttacctgtcccttcgcattagcagtgccatactgaaagggtacatggccgctgaatgtggggacaagccttttggcctggagaggctcagtagctgtgggaaggtagcttatccccagaggactcctcggcctcctgcctggctgcaggcaggacaatgggaagagccagttgataggcagactatcccttgacccctgtggcttgaccttgatgtcacacccccagtctcaactgtgccaccggtccctgagtgtagagcagcttggctcccctccccacatgggcagagcagggcagggcaagatgggaggcccaggggctctctgggcttccacccttgctgcagacaactcagtacagttttctctggtcaacgaagtagactactgtttgcctaggccgggtgcagttgctcatgcctgtaattccaggactttgggaggccaaggcaggcagattgtctgagaccagcctgggcaaatagtgaaaccctgtttctacttaaaaaaaaaaaatacaaaaaattagagcctggtgtggtggcacatgcctgtaatctcagctactcgggaggctgaggcaggagaattgcttgaacccggcagacagaggttgcagtgcaccaagatcgtaccatttgcactccaacctgggcgacagagtgagactctgtctccaaaaaaaaaaaaaaaagattactgtctgcccttgacatttccacttgacagctttccacttgactgcccttgacagcgtccactgtcctctcctctctcattctctttgtccttgtgtttttatgtatgtaattccttttctgttactttcctggcatcttcagagggagcacagatgaacacatgtttgttttgctatgcttacccagccacatagcggttttaacaaatatttgctagccttttggttcacacagcagcacaggttttctgtctgtgaaaacaccactctggaagtgttcttccagactcagaataacagttatatggaatctttttttctttgtagtgaaactcttccctccataattattaacatattagtggtaaatttctagagccctccccaaccctcccataagaaaagtatgttttatggcaaaaaaaaaaaaaaaaaaaaatctcattagaaatttcatctttagactttgtcttttttctttctttttttttttttgagatggaatctcactctgtcgcccaggctggagtgcaatggcgtgatctcggctcactgcaacctccgcctcctgggttcaagtgattctgctgcctcagcttcccgagtagctgggattacaagcgcccgccaccacacccagctaatttttgtatttttagtagagatggggtttcaccaggttggccaggctggtctcgaactcctgacctcaggtgatccacctgcctcagcctcccaaagtgctgggattacaggcgtgagccactgcgcccagctagactttgtctaaaatagctgtggttaaggatatttttagttaaggtgatttgttttgttttggagacggagtttcgctcttgtcacccagggtggagtccaatggcttgatctcggctcatcgtaaccacctccccacctcccaggttcaagcgattctcctgtctcagcctcccgagtagctgggattacagacgcatgccaccacgcctggctattttttgtatttttagtagagacagggtttcgccatgttggccaggctggtcttgaactcctgacctcaggtgatctgtccgccttggcctcccagagtgctgagattacaggccaccgcacccagcctagttaaggatattttttaaatgtaccatctaatctatttttttactacatatgctcacaaaatcataggaattgacttttttattttaaaaagtattattttttagagacaggatctctggaatgcagtggcacagtagcttactgtagccttgacctcctggactcaagtgattttcctgtctcggcctcccaagtagctcagaggcctgtgctgctacgcctgcctaatactgtttttaacttttttagagatagggtcttgctgtgttgcgcaggctggttttgaactcctggcctgaagcagtcttcctgcctcagcctctcaagttgctgaggttatagacgagagccacccacgctcctggtagaattgaattttgaagagtttgtatatataatgtgtatgtgtatgtgcttgtgtgtgtgtgtttcaagctcttccctcagaatttgaggctgtgcctgttctgagtaactgactctgagggaagggtacccaagctccggggtgcagatgccctttacacttgcagcctgcatcaacttgaagaccttttgaatcaccctgagccatatgcttggctcctgctgtggctctcaagaccagcaagaggccctgagtggctggagcctgaggcctgtggcctggggtgctcatagcaggcatgtagctgtccacagttttggttctttacaattgtggaccgccccctctcactgttgacagtaattttagattttttgaaactgtctgagaattggtatttggcaattagtgtttctaatttgtcacagggcaacctgccaatcaaatatttcaatatgactccagtttcctcctactaattttgttgaggattacttagaaattatagtttttatttataagtccttatctgttagaaatgcttgctgaagtggagcgcaatggctcacgcctgtaatcccatcactttcggaggccgaggcgggcggatcacctgaggtcaggagttcgagaccagcctggccaacctggtgaaaccccgtgtctactaaaaatacaaaagttagctgggtgtggtggcgggcgcctgtaatcccagctactcgggaagctgaggcagcagaatcacttgaacccaggaggcggaggttgcagtgagccaagatcgtatcattgcactccagcctaggcaacaagagcgaaactccgtctcaaaaaaaaaaagaaaagaaaaagaaatgcttgctgaagtatttacaaatgaaagaatgtgatgtctctcattcgccttaaaatattccaacccattcccaaagaaaagcatgtgtgcaggggaggggaagatagatggaacgcaactggtgaaatgctgatactcacggtaggtaggtcacaggtacatggggttcattgttctagttgcttcacttctgttttgtcgaaaatttccataacagaacaaaaacaagctgtcagacacaaatatacggtttccagacttttcctgcctgacacacagaagcacaactttgctctttgaaacactttttctgaacagaagccatcattaactaggaacactttagaaaacaaaacacttgctctggatttcaaactgcatattagtagcttaacccttccctgtggtagtctaatgctgtgaccgagatagggtcctgctggtacatcacaagcaccctctgaggccctcattctgatgacagtagggaaatcacaagtcctttcctgccttggccttggcctgtgacatttgtccagtgtttcccggagggttttcacaggatacaatgccttaagatagtgcaggaaaacaaatagataagtgtttgagagttgctgtgctcaattaatttttttcttttttttttcttttttttttttgagacagagtctcgctctgtcactcaggctggaatgtagtggtgcgatctcggctcactgcaacctccacctcccgggttctagcgattctcctgtgcctcagcctcccaagtagctgggactacaggcgcacgccaccacacctagctaatttttgtatatttagtagagacagggtttcaccatgttggccaggatggtctcaatctcttgaccttgcaatctgcctgcctcagcctcccaaagtgctgggattacaggcgtgaacctccgtgcctggccgtgaattttttttctttttaagacaaggtatctctctgttgcccaggctggaatacagtggtgtgatcatggctcactgcagcctcaacctcccaggctcaagcaattctacctcagcctccctatgaatagctgggattacaggcacatgccaccatacccagctaattttttatttcttgtagagtcagggtctcactctgttgcccaagctggtgtcaaagtcctgagctcaagtgatcctcctgcctcagcctcccaaaatgctgggattacaggtgtgagccactaccgtgcccagcctggatttctttaccaaaggacttgacttctcagaacctttagtcgtcatctgtattgtgactcttccccagagggtgacacagactatttctgcagtgtgcctctatgaccgcacctctcatatcaagagggagagactatggaaaacaaagcagtccacatgtttgtttttattaatcaagacagcaaacagtgcccatgatctaccataggtacctagaatacctaagtctcattttgggcatttcacatagctcagacttaaaagtgaattcaggccaggcgcggtggctcacacctgtaatcccagcactttgggaagctgaggcaggtggatcacttgaggtcaggagttcgagaccatcctggctaacacagtgaaactccgtctctactaaaaatacaaaaattagccgggtggtggcgtgtgcctgtaatcccagctactcgggaggctgaggcagaatcacttgaacacaggaggcggaggttacagtgagccgagattgtgccactgcactccagcctgggtgacagagggagactccatctcaaaaaaaaaaaaaaaaaaagtgatttcaaagatatttaggcagcctactacctcatgggaaggctcatttcacttttgtttggctcgagtgttatggcttaagaccctggaacttatcaggacaaacaggcccagttcttagttcccctaaatgtcttagtccctataatccctcaccatccaggtgttttgccggtaaataccctttggtttgtcagtgtcatcgttaaagtgagtcctcaggagtgaatataatgcgttgtcttaattgcagaaagcacaccatagcatatcttgtatgtttttgatgcagccgaagatttcatgagctcttttagcagtggtagcatactgtggtttgctcagctaaactcgtggtcaactataatcccttatgaattgctatgaagcccaatatccctcttgccgaactaattccaagagacgttacaacagttgtgtggccacatgagtttgggaaatgctgcttggcatgtagtaagaacttaacaagtgagaggttattattcctgtgaccatctatgatggcagacaacttgtcttattcccccagcacccagcatagcgcctgatgcacatggcaccataattccaccggtaaatgttggtggcattaataaaagtggggctgtgtctggcagcaaattccatcttgttacctgtcctcgcttgtataggtaatcgtgcattttgcctctatcacttacatgctagcttccaggcctagcttctccattcacaggtgtgacaactgtgcattctgatgcctcatctaagataagctctgtccagattcacaagcctgagtctcattattttctgctagttctcactgattttttttttttttttttgagacagagtctcactctgtcacccaggctggagtgcgatggcgccatcttggctcattgcaacatctgcctccccagttcaagcgattctcctgcattagcctcccaggtagctgcgattacaggtgtgcaccaccacgcccggctaattttgtatttttagtagagacggggtttcaccatgttgcctaggctggtctcgaactcctgacctcaggtgatccgccctccttagcctcctaaagtgctggaattacaggcatgagccaccgcacctagcactgactgatcgtattctactctttcaaagtctttttctgtcaggctttcttctcgttttccccccattctaagaaccttgcatcccttctaaaaaaatgggatagactgggcatggtggctcacgcctgtaatcccagcactttgggaggccgaggcgggcagatcacgaggtcaggagatctagaccatcctggctaacacagtgaaaccccgtctctactaaaaatacaaaaaattagccaggcacggtagcacgtgcctgtagtcccagctactcgggaggctgaggcaggagaatcgcttgaacccaggagatggaggttgcagtgagccaagatcacgctattgcacaccagcctgggtgacagagcgagactctgtctcaaaaaaaaaaaaaaaagggataaagaggcattctcccacccttttgtcatttctacttgccaaaaaaaaaacaacaaaaaaaaattagaacataaaatgagccactcttccaggcaaaaacaaacaaaaataaaatttcacacaccctgcaggtcaccaaagccattccttgggtgtgtacatgtttgtgtgcatgtatatgtgcttttttaatgctttttttcttttctttttttttttttttgatacggagtttcgctattgttgcccaggctggagtgcaatggtacaatcttggctcactgcaacctccgcctcctgggttcaagcaattctcctgcctcagcctcctgcgtagccgggactacaagcatgcactatacccagctaatttttgtatttttcatagagacggggtttcaccatgttggccaggctggtcttgaactcctgacctcaggtgatctgcccaccttggcttcccaaagtgctgggattacaggcatgagccactgcacccggccttttttttttttttttttttttttgagacaaagtcttactctcgtccaggctggagtgcagtggtgcgatcttggctcaccgcagcctccacatgctgggttcaagcgattctcctgcctcagcctcccaagtagctgggactactggcacataccaccacatcggctaatttttgtattttttgcagagatgcgatttcaccatattccccaggctggtctcaaactcctgaccttgcattcctcctgccttggcctcccaaaggcactgggactacagacgtaggccaccatgcctgacccattttgcttttatttagttttgttttttgtattcaaccctcaagatttttatttaatttctctgaagcgagcacagttatcaatggattattattattattattattattattattattattattattttgaaacacaaacttatggaaaaattggaggtacaacataaagaacttttctccaaatcacttgagacctaatgttgcatcactcccaaatgccgtagtgttttacaagcattctcctacatgaccacagtgtgcccatccaaattaggaaatgatcatttacacgttattaccatctcactctcagaccccattgaggtttttccatttgtcccaataatgtcctttttagcaaaaaagcccagttcacactcacaggttacatttggttttcatgtctcatcaatctccttatgtctgttgcatgctgtcaggtggcacatgcagccatttgtcccattactgttcatacttgggtcatttgatgcaggtggtgtttgccaggtttcttgactgtaaagttactcttttcctctttgaatgtaattactattttgctgggatgtgctttgaaactgtgaatactctattcatcagactttccatgtatttatatttgtacagactcatgcaatggtctgtaattttgatgctcaaattattaccaatttgaggccaggcatggtggcttacacctgtaatcccagcactttgggaggcctagttgggaggatcacttgagcccaggagttcaagactagcctgggcaacatggtgaaacctcatctctacaaaaaattagccaggcatagctgggcatggtggtgggcgcctgtgatcccagctactcaggaggctgaggcaggagaattgcttgaacctgggaggcggaaattgcagtgagccaagatcgcgccactgcactccaacctgggtgacaaaagtgagactccgtctcaaaaaaaaaaaaaaaaaaaattagcaaggcatagtggcatgtgcctgtagtctcagccacccgggaggctgaggcagaagcatcacctgggctggtgagatcaaggctacagtgagccatgttcacaccactgcactccggcctggatgacagagtgagactttgtctcaaaaaaaaataataataattaccaatttggccaatgggagactattcaagctgacttgtgtctttctaactcatccccatcatttcttcacacgtttccttgctttctggcacaagatagtattcttcctctgctctaaccctggaatcagccatttccccagggagctctggatccttttagtggaaagtctaaatcttggtattttgcaagatctggatgctaggtgtgctcattgccattggggtgccactgctctgcatgctctcagtggacacagccagggaatgtgtgtgtgctcatttctgtgtggaatgaaaaccatgtgttcatggtgctacctcatgacggaggtcattttcattttttccctttccatgtttgtagctctcctctctgatggtgagaaacctggtttctactatctttaatatttttacttattccctgtgcatgtggctgatctgtcatttttgctgccactcactcctctgctcaaacacccttctctccctgcttggttctcactctccgttccaggccacccccctgtgtggacacttacctcacccacttgggcaccaacacatcacaccaggtgattctaataggtagccaggtttgagaaccaccaagagttttcaggttgaactgcacttcaatctttttatcaagcatttcccaccccattgctaactcttactggttactagttattagcaagctgccaaacattctctttcataaggaacaacagccacaatgcttgcttctcactgctggaaggcatttaatcctcttgagaaacagcaagtgattggtggagtcctggctctgcttctggtttcccaggttgattatgctagtttcacaacaatgccatgttttcttctaccgagagcagtattggtatcattaagataccaagaaatgctgaggtttcattggtattctgtaacttgtattttgctgctacggggaagatagctgttaggtttatcctgttgttagctttcaattctaaagtgaatatgggctgggtgcggtggctcacgcctgtaatcccagcactttgggaggccgaggcgggcagatcatgaggtcaggagtttgagaccagccaggccaacattgtgaaaccccgtctctactaaaaatacaaaaattagctgtgcatggtggcgggcacctataatcccagcaactcgggaggctgaggcaagagaattgctggaacccaggaggcggaggttgcagtcagctgagatcacaccactgcactccaacctgggcaacagagcaagactccgtgtcaaaaaaaaaaaattgttaaagccaatatgaaccccctctgaacctcactcagctttgaaagtgctcttgcaaatcatctactccagtcccctttacaacaaataacccctgcgtgcacttgtctgtgtgcgttctcaaatgtgttcttgtctgtctgctttttattgattttcaattttgcctttttccactgttctaatttgcctttctttaaaagtgtgaaggaagaagtgttctggaggaactacttttaccgcgtctccctgattaagcagtcagcccagctcacggccctggctgcccaacagcaggccgcagggaaggaggagaagagcaatggcagagagcaagatttgccgctggcaggtatattctgggtagaagacagcactctacagaaaaagttgttcttagagactcaaatgagcttgacctcttatacgtaccagaaatgtcattgccttagggaaaaattcttttcttcccagaggaaatcttcatttttctcttactgccttctctctgacccagctcacacatgtcttccccaagctttcctttactttgcttatctcctttctcattccttgttttcgtttttgtttttttttttagacacgggtctcactatgttgcccaggctgtcctcaaactcctagactcaagcgatcctcctgcctcagcttcccaagtagctgggacttacaggcatgagccactgtgcctggcgagtttttttttcgttttatttctctctcaaacatccgtcatcttccccccctctcatttttggcccttaaccatgtgattctttatacttctgtcctctaccctgattcagtccgcctcctttttgtttgtttcaacctgatgtttctccagtgtgtgtagtctgtagagcagaacaaagctccattccactcccaagttacaaggatctatctagttctgagctaggcactgatgaacattggactcattgtgacactaacttacccctggttgtgggaatgtgttttataataagggcagctgtttgaaatctgtaataattaaaataagaaacacattttgtgtcatagtttaaattcttagtgagtacctgctgtgtatagtaggtactcattacaactggacatttatcccacaagaagcggggtgatttaattcacggaattttaaatgattaagcaaaacagcatgtcctgaggtacaggttatacagaatactaggacaggatctgacactgctgttagtgtcagggaaatggagtgaagttgctctacacaggaaaatttgtcattttgtatatcagtgttaacatgcatcccaattgtctgttattctttagcatttatgttaattttgttggaaaatgccattttgccaaatactgccttgtttaacaaaatggatttatgacagtattccataaagactgcctttttctagcactcttatcagcaggcaaacttgataaatagcttaattctcattattctaaaaaagtacagaactattcttcaatgaattttgctaacactgtagttaaaaattatttcctgctggaaattttatgtaaggatatgtattgaatatgatgacatgttaaaaatatccccaggaggctgaggcaggaggatcacttgagcccagaagttcgagtccagcctgggcaacatagtgacaccccatgtctaaaaataaataaatggataggtagatagatagataaaaatatccccaaagtaagaggttgagatggtttcaccatggctgtttcttataacttaagaaaagctgaaagcataacataaaaattcatttctgaaaattatttagtatcataatacttgtggatattttactgtgattataatatgtattcagaactgaaccaagcaattattgtctctcttattctcacttcttagaggcagtacggcccaaaacgccacccgttgtaatcaaatctcagcttaaaactcaagaggtaatccagttttacattgtacctagtagttgatatctggaaataaagtaactgtgttaactctttctgataccatttaaaactatgtatgaatatgggtttggaagaagcagcatctggtacttgaatagtcaaggaactagggctgagacttgaggacgatttactggcatatgtaattctagatgtgttcatcagggattggagagaagggttggagtgattcaaactgtgaaggagaataatagcctcaggtggtaactcatgtagttaccaagcaactgcaagttagaaggttggagagcagtgctcattgtcttacagctcgcagagaaaagaaataaaaatagcacggcattaaattgtgagacaatagcaaaccagaataacacaaatgtcgcttagcaaaccatttcaagagctcatttgttgcatttcaggatgaggaagaaatttctactagcccaggtgtttctgagtttgtcagtgatgccttcgatgcctgtaacctaaatcaggaagatctaaggaaagaaatggagcaactagtgcttgacaaaaagcaagaggagacagccgtactggaaggtaaaaaacaaaacaaatcaaagcaaagaaactattcgtctccctaattccaaagctaattgtagaaaattgttattctgaagccagtgcacaaaaatgtgttgtaaattttgcatcaaaattgattcttgtcagaggcaatggctcacgcttgtaatcctagcactttgggaggccgaggcgggcagatcacgaggtcaggagatcgagaccatcctggctaacacggtgaaaccccgtctctactaaaaatacaaaaaaaaattagccgggcctggtggtgggtgcctgtagtcccagctattcggaaggctgaggcaggagaatggcatgaacctgggaggcggagcttgcagtgagccgagatcgcgtcactgcactccagcctgggtgacagagcgagactccgcctcaaaaataaataaataaataaataataagtttttggccctggtgcagtggctcacatctacaattccagctactcgggaggaagctgagatgggacaatcacttgaacccgggaggcggatgttgcagtgagccgagatcacaccactgcactccagcctgggtgacagagcaagacttcatctcaaaataataataataataataataaatttttaaaagctggcattctccttgactgtagacatgtacatggaagattcttttcccagctgctgcatgccaaaagagcattgcttctgggaaggagcaggctgcttttaaaaaccagttttctttttgagatagggtctcactctgtcacccaggctgaagtgcaatagtgccgtcatagctcactgcagcctcaaactcctaggctcacaccatccacccacctcaggctccaatgtagctgggactataggcgtgtgccaccacaccaggctaatttttttaattttttgtagagatggggtcttgccagattgcccaggctgatcttgaactcttgggctcaagcaatcttgccacctcagtgtctctaagtgctagtattataggtatgtgccaccatgcccagcccaacagtctttttttttttttgagatggagtctcaccctgtcgcccaggctggagtgcagtggtgcagtcacggctcactgcaacctccacctcctggattcaagcgattctcctgcctcagcctcccaggtagctgggactacaggcgtgcaccaccacacctggctaatttttgtatgttttgtatcgctatgttggcaggctggtctcgaactcctggcctcaagtgatctgtctgcctcggcctcccaaagtgctgggattacaggcatgagccaacatgcctggccccaatagtcttttatatattatatatcttggctccaggactaaattgtaagatccccaagggcagttacacattgtctttctgtccccctacagtacctaatgtggaacttagcactcagtaagcaccctaataaatatttgtgaaattggtggcttcctgcacaacacagggtgtcttttcctttgaggttgctgctgtagaacgattaaagcatttcatttttgttttctctatagctaagtttaaggtttatttttaaagacaggctgggcacggtggctcatgcctgtaatcccagcactttgggaggctgaggcgggcggatcacgaggtcaggagatcgagaccatcctggctaacatggtgaaaccccgtctctactaaaaatacaaaaaaaaaaaaaaattagcctggcgtggtggtgggtgcctgtagtcccagctacttgggaggctgaggcagcagaatggcctgaacccaggaagcggagcttgcagtgacctgagatcatgccactgcactgcagcctgggcaacagagcaagactccgtctcaaaaaaaaaaaaaaaatacaaaaattagccaggcgtggtggcaggcacctgtaatcccagctacttgggaggctgaggcaggagaatcgcttgaacccaggaggcagaggttgcagtgagccgagaccacaccattgcactccagcctgggcaacagagtgagactctgtctcaaaaaaaaaaaagagacaaaaatgaatcttagctttactttttaaatagccagtttgttttctcaccattttataacattacatagcagatgcattatcctacacacacagaggtatattgagtgtctgtgtagaaagttgcaggtctaaatctcaacgcggaagaccagtgtgagagctccagtcagaacaccatgagagagtccaggctgacttcagaccccggtgtctgtctccactcttaaggagacagctctttgtatagtggttaagcatagactgtggagcctgcagatgtggttccatccttatatctgtcgctgtcaaacggtgtgatcttgggcaagttgcttaacctctcctaagtctccatttccctatctataagatgtggcaaatagtaataccttgtccatggactgttccaagggtgaaaagcgtgatacatagaaagcagttgggccagtgcccagcccagtaagtgctcaataaacattagctgcttttgctaccatcatcatcattggtagtggtaaaaattaacttgcaaccaagtattaattatcatttacccatttaaataaaaggaaatgcagaggcatagggaaagcaaaataacacccaaaatatattgatgacatctgatacctttgcttctacattaacagatttatctttctaattgtgtttatccttggtcactgttaaaatttactgagtttttctgagcacacatagtagtgaagcctgagatactaaaaattacagcagctaggactttacgtaggtaattgagatggaccgaattgtgaacaccagcattatgaattcagagagaatctttttcttctcctttgtttcttttagaggattctgcagattgggaaaaagaactgcagcaggaacttcaagaatatgaagtggtgacagaatctgaaaaacgagatgaaaactgggataaggaaatagagaaaatgcttcaagaggaaaattagctgttcctgaaatagaagaataatccttaacagtctgcaaactgacattaaattctagatgttgacaattactgaatcagaaggcatgaaagagtataattttatgaaattcaaaattattcttttttcaagttgaaacttgcctcttctactttaaaaaagtatatagaacagttacttctaataatcagaaagagatgttttatagaacatttctttaatataaagttagagatgtcttcataggcagtatggctatctttgccacagaaacataagtaaaattttagagttctgttttccatgaggtcaaaaatataatttattcctcagtcatggttttctaaatatctgtactccacattccattttaattgatatgagggtgttaaagtacctacttaatgggttgattactatcaaaatgaccaaattataccaaagaacttaagaggaagcactttcagaactattcacttgccaggtattttctaaaattccacctgaaagccaaaagataaaataaataagttgattttaatgatataagcatcacacaattttacattaagaaatactgtgcaggccatgcgtggtggctcaggcctgtaatcccagcactttgggaggccgaggtgggcagatcaccggaggtcaggagttcgagaccagccttgccaacatagtgaaaccctgtctctactaaaaatacaaaaattagccgggcatggtggcaggcacctgtaatcccagctactagggaggcttttgaacccaggaggcagaggttgcagcgagctgagatcgcgccactgcactccagcctgggtgatagagtgagattcagtctcaaaaaaaaaaaaaaaaaaaagctgtgcgaaaatatttgtttttctctggggccttttctttcttttctttttaaactataccagaaattttacatcacagtttttatacaaagtgggaccttccatactttttgtattacaataaccttcagaagcccattccccttaaagtctgttgttcttgttttaatcatcaccacatataaatgttttagctttgtcttaaactgtgagtcttcataaaattgtgttcctccgagttcaccttctaggactttattgattaatccttctctttctgctataccagcagacacatattcatagaatatgattatttttaaagaacaaggtgaggaggctgaggcaggagaattgcttgaacctgggagatggaggttgcagtgagctgagatcacgccactgcactccagcctgggtgacagagtgagagactccgtctcaaaaatgaatgaatgaatgaatgaatgaatgaacgaacgaacaaggtggtttaatgtcagaaaacttcctaagcatttgctccccaaacctttcatgtttttcaagaagcctttattacataaaggggaatagaattaaaatgtttctttataagaaaaatatacatatttgtgttcttggccccattaaaactagtcagtagtcctttggcaaagatatagtcaacaagagaactgggtatgagtccaggcattactcctgttcatagttgtggatgcatgtgtctgagccagactgtctcaactggagtctcttgggttatagcagtaaacccgtgtattccatgaaaccactgggcccatcatcaaaaggtttccacttgtggtgccacagttgcttattactgagtttgggttccaagatgactggcaacttctgaaataatctcattgaaggaaagagtttcattttttttttaaaagagtttgctggaggaaaagaagcatgttaaatgtttttaagcagctaaaagtcctagatggaagcatatcaggatgtgtcggtgcttggctcttagtgaatgcactaaaattcttattgataaatgttgaataaacacacacaaaaaagtatcagagaaagagaaaaaccctacaatggcaatagaggtgtgtgacagttattgctatcaattttacataatatctcatttaaaaacaacctaattatgcattgcctgtgaaaataaaaggataaaataagattttgtacatactgtaagaatacagttgtgctgtatttttatggattcatcaaggagtaaaatgttctgctttagtaaattatataggtaactgaagtgttattcctttaaagagcaaaataatttatcaccatgtttggtggaaaatttctaagtatttattacatgcctaggggttagccaacaagatataccaagcatgaaaacctgtaaaacttaataaaatgctaaaatatgaacatcaca

SEQ ID NO: 2723 - DNA, 43102 bp, Homo sapiens; identical to SEQ ID NO: 2722

SEQ ID NO: 2724 - DNA, 74594 bp, Homo sapiens
atcggatttttttttttaacttgggttttaattaggtacataaatagcaacatgagaatgaggagttctaaggcttgtacattatctctaggtgaagggattccaggttagtttgcttgtaggatgatttcacagaagataacagaggtctggtctagtttttcctgaagaagaaagccaatttaatacattcaatactgacttctatgccatttttctgtagaaatactgatttattctatggagtttccaatgtttacctataactaaaagaaagaaaagaaaaacataagtaactgtgccagaaaaaattttgcattatgaaaattcttcagatttaaatagagaaaccaggccaggcgcggtggcccatgcctgtaatcccagcactttgggaagccgaggcgggtggatcacctgaggtcagaagttcgagaccagcctgcccaacatggtgaaaccccgtctctactaaaaatacaaaaagattggctgggcatggtggcaagtgcctgtaatcccagctacgcaggaggctgaggcaggagaatcacttgaacctaggagacagaggctgcagtgagctgagatcatgccattgcactccagcctgggcgacaagaatgaaactccatctcaaaataaataaataaatagagaaaccatagaaaatatttacatcaccattatatgaccataagaaacatgagccagagaaaactgtaattattcccattttaaagacagttaaactaagaatcagaaaggtcgagtgtggtggctcatgcctgtaatcccagcactttaggaggccgaggcaggtggatcatctgtggtcaggagttcgagaccagcctggctaacatggtgaaatcccatctttactaaaaatacaaaaaattagccgggcatggtggcgggcgcctgtaatcccagctaatcgggaggctgaggcagtagaattgcttgaacccgggaggcagaggacgcagtgaaccaagactgagccactgcactccagcctgggcaacagagcaaaactctgtctcaaaaaaaaaaaaaaaaaaaagattttgtgttccatcaacattacatatacactacattcagatcctcaattggctgtgtatctgagtgtaattaaccaactagatggatgaataaataaaaaacaaatgcctaaatggcacagtacacatcacatctgaagattaaacaactacatttccatctatctgctggaaagcatgattacatcaccctcagtttgatgtgtaattttcctcgcatcacccccatcatacttttctggaataaaatacacatatagtcaaagacatgtcaaagacaaactgagtcttctccagattgcttttttcatattttttttttttttgagatggagtcttgctctgtcacccaagctggagtgcagtggcgtgatctcggctcactgtaacctctgcctcccaggttcaagcaattctgcctcagcctcccaagtagctgggattacaggtgcccgccaccacacccagctaattttttatatttttggtagagacagggtttcaccatgttggccaggctggtctcgaactcctgacctaaagtgatctgcttgcctcagcttcccaaagtgctgggattacagccgtgagccaccacgcctggctttttttcataatttgtaatgaatatactcagcaattagagatttttttttttttttgagacggagtttcactcttgttgcccaggctggagtacagtggcgtcctctcggttcaccgcaacctccatctcccgggttcaagcaattctcctgcctcagcctcctgagtagctgggattacaggcaggcgccaccacgcccggctaattttttgtatttttagtagagatgtggtttcaccatgttgggcaggctggtctcgaactcctgacctgaggtgattcacccgcctcagcctcccaaagtgctgggattacaggtatgagccaccgtgcccggcacaattggagatttctaaatattttagaggccagtgactattcacttgatcttttaatatacaaccaaaaattcttaaacatgtaaactactagcttattttttctatctcagtttattaatctgcttttgtcttccccaggaatttgatagatttattgcattgttaaaaactaaaaactggaaacaacctatgttggtaaggattaagtagatcatggtagtccatactaggaaatcattaagcaactagagaaggaatgcgtagctctattaagtactgacagggaaatacttacacaatatgttatgtaaaacaagttcattcattcatcagcatagattaatatagtactgtctatggcaaaaaaaaaaaatgaacctaagtctaattaagccttcggatccaactataagtttatgggaaatatagagaagaaagaaaccaagagataaacagaatgatactaaatggatacattcggccacagccagaacatgagaaattctttttttcccctcccagctcaatccttgtagaaaacaggaattctaaaggacaaataagccaggtttttcaacagataaatagcaagggacaatgagggagcggaaactattacagttctaagagacctatcagtcaaacacaacaggcagatcttgtttggatcctggttcaaacgaaccaactgtaaaaagttattcatgaaacaaccaggaaaatgtgtacattgaactggatattagatgatgttaaggaattagtgcaatttctttctttctttgagacggagtctctctctgttgcccaggctgggagtgtgcagtggcacgatcttggctcactgcaacctctacctcccgggttcaagcaattctcctgcctcagcctcctgagtagtttgaactacaggcatgagccaccatgcccggccttaatttcctttttttcttttttcttttttttttgagacagagtctcactctgtcacccaggctggagtgcagtggcgtgatctcggctcactgcaacctccgcctttcgggttcaagcgattcccctgcctcggcctcccgagtagctgggactacaggcgcacgccaccatgtctggctaatttttgtatttttagtagagacagggtttcaccatattggccaggctagtctcaaactcctaacctcatgatccgcccacctcagcttcccaaagtgctgggaccacaggcgtgagccaccacgcccagccccagcctaatttcttttttttttttttttccccaaatcaataggtcttttattgcatcatttaaatatcacaagtaggtcttaagtgtcatctggcatcttctttctgtagccaggtaactcttagatcttattcatcagcctgctgaacagttcctttttcagagacatagataccatccaaaaatttcctgatatccttgtttttaactgttgtggcttgctgaatcaaagccgctgaatttgaaacaagctcaatgtcatttccttcaaggattaattcatctttctgggcttgagatactgaacaagcaacacctggtctcatccgaaccctgcggatgtatttttcacccaaaaaatttcggatttcaacaagagacccattctcctggataacaacgttgatggggaagtgagcatacacagacctcatcttgtaacggaagcccagtgtaacacccttgatcatgttctgtacatgactacaaatagtccgaacggtagccagttcctttctgttaccccaccatttgtcaacccggagcctcttttttttctttccaagaaggctgagttctacattgatgtgattgaagtccctccgcagggttcctctggggcccttcacgataactgtgcgtcccttcagagtaatgtcgacattttctggaatgtcgacagtctgattgctgagaatagtcttcattctcgcagtagacgcagcaaagaaagcctaatttctttatgtatgataatataattacaattatatgccttcagtaagttttctgtgcagctactcagaagggtgaagtgggaggatcacctaaacccaggagttgaagtccagcctgggtaacacagcaagatcccatccccccagataaataacagtaaaaagaaagttttctgtgaacttgtaaaacaatatgtggaatatgatcccattttgtcaaaaaaccaaaaacatgcatgtatgcatgaatatattataaatgtataaataaatttatttaatttataaataaattttaaatataaataaatatatatatttgtttttgagacagggtatcactctgttgcccaggttggagtgcagtggagtgatcatggctcactgcaacctctttctcccaggctcaggagatcctcccacctcagcctccaagtaactgggactacaggtgttcgtcatcacactcagctaatttttttaattttttgtagagacagggtttcgccatattgcccaggctgttctcgaactgccagactcatataatccacctacctcagcctcccaaagtgctaggagtacaggtgtgagccactgcacccggcctatctatctatctatctatctatctatctatctatctatctatctatatttaaaagtctggaatgatataccaaactattaacaaaaattacctctggaaaaaagaataaaggggccagatgtggtggctcacacctgtaatcccagtactttgggaggctgaggcaggtggatcacctgaggtcaggagttcgagaccagcctgaccaatatgctaaaaccctgtctctactaaaaaatacaaaattagctgggcatggtggtgcatgcctgtaatcccagctacttgggaggctgaggcaggagaatgacttgaacccgggaggcctcagaggctgcagtgagcaagattgctccactgcactccagcctgggcaacaagagtgaaactctatctcaaaaaaaaaaaaaaaaaaaagaaagaaagaaaaagaaaagaataaaggataagacaagcttttttgttttgtttttgagacagagtttcactctttttgcccaggctagagtgcaatggcacgatctcggctcactgcaacctccgcctcctgggttcaagcgattctcctgcctcagcctcccaagtagctgggattacaggcaactaccaccatgcctggctttttttttttgtatttttagtagagacgggctttcaccatgttggccagggtggtctcgatctctcgacctcgtgatctgcccaccttggcctcccaaagtgctgggattacaggcgtgagccaccacacccggccaagacaagcttttaaaacagttagctaaaaacattttttacaaccaacacgaatcacttttataattaaaagctacacctcctccaataaagatctaaaaacaataaagaatgaagtcaaggttgtgtatttcagcaagctgaactctggtgcagagtatctttgaaaattgaaatggatatttacctaatttccctttattctatgtctttttcattgtccctgtacagaaatatatccattctggctgacagggatttaaaaaaagagagaaatataaccatattaaaagtcaagtctctagaggacatgtgtcactctgtggctgctcaccctccagtcatccttctaatggcacatcccatgcatatctggccccattcaccagagatactgattctggggtgccctttgccttttaccaagctccccgggtaatagtttgtatctgagaacatactgatgttgggttactgtatgaacagctatgctgtgaaagaggaactggatttgttttctgtgaccactaaggagacatatttttgcttagcagaggaaacagcttccaaaaactcagaattgtcccaggatggctgccccatagggtgagtttcccatcagtgctggtgtaaaagaaggaacatacagggtttcaggggagtctgcttgaggctgggggttgggccagataaccactctcaaattctcagtttatgtgactctttgggtctccaaaaatataaagaaagcttgaggaaaaaagacccttcaaactcagggttttcataaattttaagtaagggccatgatttacaataaatgtaacaccaattttcaaaaaattttctgattataaaatgcatactcattgcagaaaattttttaaatacagaaagttataaagaagaaaaaaatataaaaatcatcatgccactgaaagatacacactttctgtcgtatctcctggcttcatcccctctataaacatatcacactacctttttttcatttaacaataattgtgcacacgttcccatgcaattaaatactgtagaaacagaataataatattcttctttatagatataccataattaagccattttcctgtagttgaatatctaggttgcttccaaattcaattacagtcttctaattaccaggaaatcacaagtgctattatacaatttttcatatatacacaaacaatataactagtgttttgagcctctctgtaacagtcatgcattccagtgttcactgagtattagataaatacaagtgtacttactataataaagtgttgtttgaaaaaaacctaaggaataatgacacttttcaattgtttgaaatacatttgtagacaaatcccaactgtctggttctagcttgtctaaaaaacccaggtaacattagtggaacaaacacaaataagtaagtcacagcatttaagcccagaaactaaaagatggaataaaatattttcacatcaaattgaaactgttataattaattaaattaaattaattaaaaacaagtcatttcagctggcactacaatgctgaaaataatcacagaaatttcttgttttttacctgattaagatggcagagcatggagttttctacttagttccaggtgaattcttcacatttcctggcttttaaaacaaaagaaagagcttgaatgcagtttgaaaagaaatagtgcaactccttagtgtcctgagtatttggctgaacatgaacattaaaaattattatgggggacagggtcaaaccattttattgaggacttggggggttgttgaagaaaggctgaggaggacaatgagatcccacattctcgcagttaccgaccattaaatattattttactgcaaagtgatccatctgtcagtaaattgaagaagttactagggctctctgagggccctactgtagagtgacttgggcagagagagcaggaaataaagctccattaatcctcattatgcagattcagccaaacagttgattctaattaaaaaatcaatatatcttccttttatttcctgaaataaaggttttacacctatgggaaggcttcctgtaggtatttactccatgcattattcaccattatccaccataggggccaatccacaaaacatgtttactctgaaagaagttagaccacacccattctgcccagtggccctccgggaacatataattaggccatgtaatccataagaagcagtgtaggaaaagcttctagtgggaaaagttcacgtgctaaacttttaaggccttactttcttttctatacgttttttagactttaattctgaaaacacattaatagtcagagatcagatggcagtctgaaaaacaggaggctgcagctgggcgggccatgggggctaagattctgttgtatagacttggagcagtttctcctggtgcccctctttcagagttattcatggatgaaggaagaggaaaaggtgagaaagcaggagcacgtgactaaccctgtcatttcagagcatggtttctaggcaactttggggctccctggagtggctgagaactggtctataagtactgttttatacccgttgtcccaacataattaatagtgtcccctttcactctcaagagtatcctggtttgccgggcatgttggttcacgcctgtaatcccagcactttgggaggccgaggcgggaggatccattgagcctgggaattcaagaccagcttgggcaacatagaaaaagaagtttaaaaaaaaaaaaaaaaaaaaaaagagtatcctggttttgatgataaagtatatggtcaccacatccacttgatgatggagttctgggaaacaaggccatacgaactgcttggcggaccaatgatcaacatacaattctcaggtctacttgatgctctgaacaagagtgctacaggactgagaatctgtgcccttctcctcctccagagccactccccaccctgcctcctcacatgcatgcacacaagcgaacacacatacccatatgtgaacacacacccacctacaacccagaggcctttttgctgttgctcgaaattgacaaactccctactgggacaagacctttgcaaaatataccccactgaccgagaccagacaatcccaatttttgcctagctaaatgttattcatcctttacatcaaggctttctttgtaccctgtccttcaatttagcagaaccttctattccctttcatagcactcatgtacttcctgattgtgtaattatttctttcatgtttgagtctttcattaacctgtaagcttcatgagggcacaatatccctagggcctcctagcacacactattcaaatatttgttgcataaacaaatggaaagccaggggcagtggctcacacctgtaatcccagcacttcaggaggccgaggcgggtggatcacttgagcccaggagttcaagatcagcctgggcaacatgctgaaatcctgtctctaaaaaaaatacaaaaattagccaggtgggatgacacatgcctgtggtcccacctactcaggaggctgaggtgggaggatcacttaagccagggaggttgaggctgcagtaagctgtgactgcacaactgcactacagtttgggcaacagagtgagaccctgtctcaaaacaaacaaacaaatggaatggggtagaacttagagatctgatgaatgtaaaaaagcttgggtttctattttcttaacacatccatgaacacgaataacaatttctgttagcaaaattaaaacttaaaaaaaaatcaaaacattgatttctaattagtatgactgccatgtgaaggctgattgccagccaaacctttgaggtatagcagcctactgaaatgtctgggtccctcaccagactaatgaagaacaagaagagagaaaaaaaggcttataagggccagtgagataatcatgtccaacaatcgggtctggcataaaaacaaggtggttctcggcagggcgtggtggctcacgcctgtaatcccagcactttgggaggccaaggtgggtggatcacctgaggtcaggagttcgagaccagcctgaacaacagggagaaaccccgtctctactaaaaatacaaaattagcagggcatggtggcgcatgcctgtaatcccagctgctcgggaggctgaagcaggagaatcgcttgaacccaggaggcggaggttgcagtgagccaagatcacgccattgcactccagcctgggcaacaagagtgaaactccatctcaaaaacaaacaaaaacaaacaaacaaaaaaacaagttagttctctacttaaatacagtttaggtctgaattaacatactgcttgccaaatacttccaatgatattcttatatattctactatctatactcgccagtacctcaatctcaaaaaaataagatgctaaattcacaagcttttttatcttttggacaataagaaaatgagcacacaaaagcattcttctgattcaggaaaacaactttgttgctaggaaaattttcttgtttggttacatatcacttatagtataacaaaacagcacagtccaatatctcattaaaaaaatattgagcccatccaccaccctgtcacaaatcagatctctcttggcagagaactccaggatctcagacaaaacaacattctgacttcaaaaaacagttcgtgatttagcacaagccagaaatcatttttttttgcattttcagacagagaaagttttatctagaatattttgtaactcattttcatacatatctgatttcagtttttattttcttaccacgtccatgaacacaaatgacaatttctttttttttttttttttttttttgagacggagtttccctctgtcacccaggctggagtgcagtggcgcaatctcagctcacgtaacctctgcctcctgggttcaaacgattctcctgcctcagcctcctgagtagctgggattacaggcgcccactactacacccagctaattattgtatttttagtgaagacagggtttcaccatgttggccaggctggtctcaagctcccgaccacaggtgatttgcctgcctcggcctacaaagtgctgggattacaagcatgagccaccgtgcctgggcacaaatgacaatttctgctagcaaaaccaaaactttttaagaaaatcaagacactgatttctaattagtatgcctgccatgtgaaggctgattgccagccagccaaacctttgaggtacagcagcctactgaaatgtctgactccctcaccagttgaattattttcaacaattacttaacttctccaaaatgcagtttcctcacttataaatggggataataatagaacccacctcaaagactcttcctgagcaaagagtttagcgccaagggccaagctcacagcaagtaagtgctcaataaacattatctatcctatatggcaggccactttattttttggatgaagaaaataaaaggtaaggataaatgacctgttaaagaccccaacacaattctagttcacttgatgaggtaggcagaataatggcccctcaaagatgtcttctatttctggaacctgtgactgttacctcacacagcaaagggaaattaaggttgcattggaattaagtttactaatcagttgcccttaaaatagggagatgatcttggattatctgggtgggcttgattcaagcataagagtgcctgcagtctaagagggaggcagaagaagaggtcagaagggggatctgcaaacgacttgctgcaggcttcgacaatagaggaaggaagctggaaacagccctcagccagcaaaacagaccttggtcctacagcctcgaggaactgagttctgtcaacaatctaaatgagcaggaaagaaattcccccctagggcctctagaaaggaacgcaaccctgctgacaccttgatttagaattggacttctgacccacagaactaagataatcatttgcactactttcaacctgtaaatttgcagtcatttattttggcagcaatggaaaactaaaacaatgacataaggattcctgactacagggtatggttccattttctatcagtggacattatcttctcaggcagaagcgaaaatgtgcagtatcacatgagtggtggttgatgactatcatgtggctagagtccagccatttcatatgttcctcacatgagataaccttatttaatcctcaaaacagctccaggaggtactatgccagttcccacagagctggagtaacttcccaaggtttcagggctagtaagaggcagaggtggggtaggagtctggtgctcccgctcctcttagtccactggacaacgctgtatcctgcccactgataccaagagtgcattcctttctaaagaggagatgacattattcaggatttctaacttttcattttggtaaataatggtgtttttaaaaagaaagaaaaaatcatttcaaaatcatttcctaatacctgtagttcttagaattttagacagcaaaaaattacaaagcacaaactcataactttatggaaaacccatcaagctgtcatttaaaaaaaatacagtggtaagaatacttaacatgacatctgccctcttggcagatttttaagtgtacaatacggtactgttatctataggcacagtgttgtgcaaggggtctgtagaacttattctctttgcttgactaaaactttgttgattaccaactccctatctctccctcccccaatccctggcaatcgccattctattctctgcctctatgagtttgactattttaaatacctcatacaagtagaatcatgcagtaattgtccttctgtgattagcttacttcaaagatgaacattttaaaactacatgacttactttcagccaaactttgccatgtttagagagccgaggaacttctaatggaggaagaaaaagcagggcatgtttactcagggtggtggctgctgcttccctttcattttcctgctgagccagcaagggcctgaataaaactattaacagctcagctttagaagttctgctcagttttcacattggtaacaggtttatgcttctttattaatttcctgccttttaaataattagtgttggccttcagcagtcattgtacaattctgtgatagtaatttgttgcattaaaaaaaagctagtgaaaaactaaaatatgatatttactgagacatactgctgtgtttagctaattataagacaactctaagctgggtgcggtggctcacgcctgtaatcccagcactttgggaggccgaggcagggggatcacctgaggccaggagttcgagaccagcctggccaacatggcgaaaccccgtctctactaaaaatacaaaaaaaaaaattagccaggcatagtagtgaatgactgtaatcccagctacttgggaggctgaggcggaagaatcgcttgaacccagaaggcggaggttgtaatgaaccaagatggcaccattacactccagcctgggcgacagagcgagactccatctcaaaaaaaaaaaaaaaaaaaagacaactctagtcgggtgcagtggctcacgcctgtagtcccagcactttgggaggctgaggcgggtggatcacttgaggtcaggagttcaggaccagcctggccaagatggtgaaaccctgtctctactaaaaatacaaaaattagccaggcgtggtggcgcacgcctgtaatcccagctactcaggagcctgaggtaggagaattgcttgaacccaggaggtggaggttgcagtgaacgcgatcgcaccactgcaccactgcactccagcctgggctacagagcaagactccatctcaaaaaaaaaaaaaaaaaaaagacaactctaaaagagccatctgtgaccctgaggactgacacccacaactgacctcctgacacccacaactggccttcatctctgatactgagaccttgggttaggactattctgaaagggtttcggattagcaatggacaatcaataaatatttcatgcttttattaagctcctagagtcaaagagtgaaaaccataatggaaaaggtcaataaatcaactacatgaagaacttcttctgatcatcaagacaccaaaactgaaaagacaagccatattgagaaaagacatctgcaaacatctggccaaaactattaatatctaggaaaaaaataaagaacccttataaatcaataagggacaaatgacccatataaaaagtggccaaaagacatgaacaggcatttcaagaagaagccaataaacctgtgaaaagatgctcaatcagggcaatgtaaatgaaaaccacgatgggaaattctgggaacatcttcacatgctagatagtgaggtaactatcacagactacttgggtcatgtcaagaggactcagagccaacttccactagcaaaatgggacagtttgaactttaataagaccaagaattacaaagcattcaaaactatcaaatatgtttaaatctataaacccgtaatgatttttaatttatttattattttaagaaacagggtcttggccaggcgcagcggctcacacctgtaatcccagcactttgggaggccgaggcgggcggatcacgaggtcaggagatcgagatcatcctggctaacacggtgaaaccccgactctattaaaaatacaaaaaattagctgggcgtggtgacgcgtgcctgtagtcccagctactcgggaggctgaggcaggagaatggtgtgaacccgggaggcagagctagcagtgagccgagatcatgccactgcactccagcctgggcgacagtgcgagactccatctcaaaaaaaagaaaagaaaagaaaagaaacagggtctcgctctgtcacccaggctggagtggagtggtacgaacacagcgctcactgcagcctcaaactcctagactcaagtgatcctcctgtctcagcctcccaaagtgctgggattacaggtgtgagccattgtgcccagcctataattatatatatatatatatacacacacacacacatatatatccatctctatataaatatatatatatatttatttatttatattatttttttgagatggagtttcactcttgttgcccaggctggagtacaacggcgggatcttggctcactgcaacctccgcctcctgggttcaagcgattctcctgcctcagcttcccgagtagctggaactacaggcatgtgccaccacgcccaatttttttgtatttttagtagagacggggtttcaccatgttagctaggatggtctcgatctcctgacctcgtgatccgcccacttcagccccccaaagtgctgagattacaggcatgagccaccgcgtctggccctatttttttgagacaaaatctcactctgtcgcccaggctggagtgcagtgacgcgatcatggctcactgcaacctctaccgcccaggttcaggtgattctccagtctcagcctcctgagtagctgggactacaggcgcgtgccaccacacctggctaattttttatttttagtagagacggggtttcaccctgttggccaggctggtctcgaactcctgacctcaggtgatccacccgcctcggcctgccaaagtgctgggattacaggcgtgagccaccgtgcctggccattatttttaaagaaaaactaacaggtgatcttctgaggaaagggaatgaattcattattttgaaactggataaataagagaaaaaaatcaagtaattatcttgtttttcctatataaactataactgggtaactagtagataagagaaggggttctttatcaaaatatttcagctaatttgagaaaatgaaacaatagaagcaaaatatcaccattttcttttctttttttttttttttgagacagagtcttgttctgtcaaccaggctggagtgaggtggcatgatcttggctcactgcaacctctgccttgcagcttcaagcaattctcctgactgagtctcctgagtagctgggactacaggcacgtgccaccatgcgcggctgattttttttttttttttttttttgagatggagtctcactctgtcgcccaggctggagtgcagtggtaggatctcagctcactgcaagctccgcctcctgggttcacgccattctcctgcctcagcctcctgagtagctgggactacaggcgcctgccaccacgcctggctaatttttttgtatttttagtagagacagggtttcaccgtcttagccaggatggtctcaatctcctgaccatgtgtggctaatttttttgtatttttagtagagctggggtttcaccatgttggccaggcaggtttcgaactcctgatctcaagtgatctaccctcctcggcctcccaaagtgttgggattacaggtgtgagccactgcgcccggccaatatcaccatttctatcccccaaagattcaatgggtctaggcattgagcatctacagctgctaaaaccaataaaaacaaagcaaaaaccagacttatgtgcctacgtggatctagagcattgccaaaaggatcaaacaggatctggttcaagtagcccgtgcatccagctgccaatgtgcagggagtacagagaacacgttaaactatagcataaatgtgtaatcagcaaaacccaaaccgttggaaactctataggtgaaatgtgccagactgttttaacagataaactgtaaggaagtcaactccaaaagatggaaggggagcctgtagattaagagagacttaaaaaaaaaaaaaaaaaaaaaaaaaagttcgggcatggtggctcacacctgtaatctcagcactttgggaggccgaggcaggtggactgcctgaggtcaggagtttgagaccagcttgtccaatatggtgaaaccccatctctactaaaaatacaaaaattaggcgggggcggtggcgtgcgcctgcagtcccagctactcgcgaggctgaggcaggaaaattgcttgaacccagaaggcagaggttgcagtgagccaacatcacgccactgcactccagcctgggcgacagagtaacactccatctcgaaaaaaaaaaaaaaaatcaaaagttgtttaaggcaagtacattattggggcaactagggaaatttgaacatgggctatatattagataacatttgtgtaaataatgaaatgccaactttcctgagtacaataacggtattgtgatcatataaatgaatgtccacgttctttggaaatacatgctgaattagatacagatggaaaatgcaatgatatctacaattaattctcaaatggttcaggaaaataaaatatactcgtgtgtatgaacaccatgcataggtgaaaagatagattatgcaaatgcagcaaatgttagtgaatctaagtgaagggtatattcattgtactagtcctgcacctgatctgtagttttgaaattttctcaaaatgaaaattgggaaataaagtaaagccacatacacatatactccatgatgaaaaactcttttaaagccatcacactggcaaaaatggtaacaattacttggcatcatctagtaaaactgaagatatgcagaccctatgaatcaggaaccctggtctagaaaaattcttcacaaattatgaagccatgctgtgttgtaatagtaatatactgaaacccacccaaggagccaccaacatgggtattttcccataaagaaaatatgaccaggcgcagtggctcatgcctgtaatcccaacactttgggaggctgaggagggcggatcacctgaggtcaggagtttgagaccagcctgaccaacatggtgaaaccctgtctctactaaaaatacaaaaattagccagggatggtggcgcatgcctgtagtcctagctactctggaggctgaggcaggagaattgcttgaacccagcaggcggaagttgcagtgagtcatgactgcaccactacactccagcctgagcaacagagtgagactccgtctattaaaacaacaacaacaacacaaagaaaatagtctacagcagtgaagatgaatacactactgccatacataacccataaacaaaatgttaagggaacaaaacaagttgcaaaataatatgtagtaagactcatctagataaacttatatatatataatatgtatatttagacttaaatttggtatatttttataaaggcaaaaacaggcaggctcaacaatagtatttcagaatacagacatatatggttaaactggaagaaaagtttaaagaaaaacaagggaatgaaataaaattccagataatggttccctctggggagacttgggggtgaggggacccatggaagacttgaaaggcatcggtaatttccttttttttttttgagatggagtcttgttctgtcgcgcaggctggagtgcagtggcgcgatcttggctcactgtaacctccacctcccaggttcaagcaattctctgcctcagcctcccgagtagctgggattacaggcacctgccaccatgcctggctaattttttggtatttttagtagagacgggttttcaccatcttggccaggctggtcttgaactcctgacctcgtcatccacctgcctcggcctcccacagtgctgggattacaggcgtgagccaccgcgccccacggtaatttcctagttttaaaggtagataattggttggtatgtacatggtcattatagtgttggattttaaactatacatatgttatatattcttgtaacttaaaagaaagccctagactgtaccaagatgacaatatttctggacacacctatctttgcttcatagttctgacaaaaagttcattttaactgaagcagataaattcctcttaagtaaccaatgatgacagactgaaacactactttattggtagaagactcagcacaaacatttagaatcatttcgtaagagggaaaagggatgtggcagagcagcaaaatgccacagacctgtttgggatatttcagagtaatatacccccatgggaaataataccgttaagaattgtgccatcattcctaatttaaaaattttcagtgccctgttttatgtatgtatgtatgtatttagagaccgagtctcgctctttcgcccaggctggagtgcagtggcacgatctcagctcactgtaacctccgcctctcaggttcaagtgattcttgtgcctccgcctcccaagtaggtgggattacaggtgtgtgccaccatgcctggctaatttttgtgttttcagtagagacgggggtgcgccatgttgtccaggctggtctcaaacttctgggctcaagtgatccacccgtctccacatcccaaagtgctgggattacaggcgtgagccaccacacctggccagcaccctgttttaaacatagtgtccacagtttctctgactatgtacaaccaaaagccagtacatctgttacatgattagaatacaaacaattggccgggcacggtggctcaagcctgtaatcccagcactttgggaggccgaggcgggcagatcacgaggtcaggagatcaagaccaccctgcacaacatggtgaaaccccatctctactaaaaatactaaaccccgtctctattaaaaattagccaggcgtggtactatgtacctgtaatcccagctactcgtgaggctgaggcaggagaatcgcttgaacccgggaggcggaggttgcagtgagccgagatcgtgccactgcgctccagcctgggccacagagcgagactctgtctcaaaaaaaaaaaaaatatgaattagatgatacttaattgagactggtaattaaagctggacttgaaaaccaacttcctaacaagctaagaaacaaaaaagtccccttcatgaagcgtcccttaattcccttcaatgaagacaagatatcttcatccaaaaatcatacatttttgtgtgtgcctttcttctggcatttatcacattttatcttgtattttggtcatatgctttccttatctcctttactagattttgaattatttgatagtctatgaagagaatatactcagctccaaggccccagaaagattcattttccagggtagcttaaatcttagctctcattaaaaaaacaaaaacaaggccgggcgtggtggctcacgcctgtaatcccagcactttgggaggccgagatgggtggagcacctgagttcaggagttcgaggccagcctgaccaacatggtgaaaacccgtctctactaaaaatacaaaaattagctgggtgttgtggtgtgcgcctgtagtcccagctactcaggaggttgagacaggagaatggcttgaacccgggaggtggaggttgcagtaagccgagatcgtgccactgcactccagcctgggcaacagagcaagattccatctcaaaaataaataaataaaccaaaaaataaaaaacaaaaatccccctgaagcccatgaaatctaaagtggggggggtgaagcaagatcaacaaaaaacaatgccacttcattatatcaagtaattcctgaaatttaagaatattgaattttgaattaatagggccttctgctatttttcctttaaaacttgtaataaatatttaatgcagtcaacattaattttttgtatttttagtagagatgaggtttcaccgtgttagctaggatggtctcgatctcctgacctcgtgatccgcccacctcggcctcccaaaattctaggattacaggcatgagccaccgagcccgaccgttttttttttttgtttgtttgtttgtttgtttttgatacagggtttcactcccattcaccaggctggagtgcagtggggtgaacatggctcaccacaaactctacctcctgggctcatgagattctcctgcctcagcctcccaagtagatgggactacaggtgcatgccaccacacctggttattattttttttttggtagtttttgtagagacagggttttgccatattgcccaagctggtctcgaacacctaggctcaaagcgatttgcctgcctcagcctcccaaagtgctgggatttcaggcatgagccactgtgcctggccctgattttattaccttctattgagaacagacagctgtcaataaaattatccttggagagtaacaaacaggagaaagccttaagttctcaatgactctgaagaaggcaagggtataaagacagagagaaatgcaaaccaatcatgagctaattaaaaatctttaccacctcactctaaaaagatctgcatataaatttgggtagctttaatatctaatgtcttcaaatgaccagaaaatgttggcctgcttaactggtatcctaaccacagtccagctgcttctgcactgggctgaattcttagcacagtcagagaatgctgtttccaagccagaggctcccgcagccctcactttagctttggtgtgcgtgtgtgtctgcacagacaccacagtgagcactccggggagcctgggggactccctctggctttggtgtgcttcagtctgcagtcacaccacaatgaaggctcgcagttgaggcttttagtctcactttccacatttctgtctagggctgtttagagatttcttgatattttacttcctttcccatataaaatttagtgtgcatttgtttttttgcttgtttgtttttgtttttttgagatgaagtctcgctctgttgcccaggctagagtacagtggcgcaatcttggctgactgcaacctctgcctcctgggttcaagcaattctcctgcctcagcctcctgagtagccgggattacagacgtgcatcaccatgcccagctaatttttgtatttttttagtagagacagggtttcatcatgttggccaggctggtctggaactcccgacctcaggtgctccacccgcctcggcctcccaaagtgctgggattacaggcatgagccaccgcacctggccgcatttgttaaggaattttttaaaaaggaaaggaagcttccatagaaaatatcagagaaataaaacaaaaaacaatcaaaaaaacagggattgccaaaagactcttgatattggtatagaatttcctattcaagagctagtttaaataggctcgagaaggactaattcctttagaaaccaccagtataaaaattagtggggttttttttctttttttctttttttttttttttgagacagggcctcactgtgttgctcaagctggagtgcagtggcgcaatcatggctcactctatttagcccttaccttctgggctcaagcaatcctcccacctcagcctcccaaagtatgccaccatgcccagctaaattttttattttttggagagatagggtctcactatgttgcctaggctggtctcaaactcctgagctcaagtgatcctcccaccttggactcccaatgtgctgggcgtgagtcactgcacctggccaaaaaatgagtcttaagatttcactagaagattatttatgtaaataataaagagggcttataatttattctgttacttccaaatcccagttcaaaattctggattttaattctgagatagttatttatatgtatttttttaacttgtcaatgatttgaagctcagttatttatttttttttaaaaagtattttcattgaaaaatgaacttccttcaatctgtgatgtagaaggtatattaatataagaagtctaattcttccttagctggctgtgcctctgagtgcttagtagagacatgataccttattctctactcattcttccttatcagtgggaggaagggaatgttccaagcgaacataggcaacatttaatcggctatgtggccactaaaagagatgaaaggtgacaagttcttacaattacacaacttcttccctctgttgctcatgtactagacagcacagagaacgtggcctttagctggtagctagtccccaacatacgatggctcacaccctcagctgagctgagaagcctgggggataaacagaaacagcagtgctaaggaaagaacagaactcatgataagtgaaaaaccaagaggaagaggctctcaattatgtctttttcctgggagcatagtacattccctttgaattcagtttcaataagacttttaaataatacgctacacttagaggaaactaggaatacaatataatggaaaatatggtctaagactacggtggaatgcattgcattttatggtcaccacttatttggccctgctgataataaccaaatactcagaagttctactgctctaccaagaaaggtcacctgaaaaatctgagctggagacagaactagaagcaaacagaaaaagcaataaatcaacagggttatcaaatattttacaaaaccctagagaaaccacatatttaaaccaaaaggaagataatgaaaaagatgctcctcaccttttgaaagttctccttccacaaatcttctatgactatatatcctcgtaaaccccagtcatataatctctccccactgaccttaaaacaaaatagaaaagatcttaccatctgacccagcaatccctattattgggaataataatggaatataaatcattttactataaagatatatgcatgcatatgttcatcatagcactatgcataatagcaaaacatggaatcaacctaaatgcccatcaatggtagattttttttttttttttgagatggagttttcgctcttgttgcccaggctggagtggaatggcgcaatcttggctcactgcaacctctgcctcctgggttcaagcaattttcttgcctcagcctcccaagtagttgggattacaggcatgtgccaccacacccagctaattttttgtatttagtagagacagggtttcaccacattggtcaggctggtctcgaactcctggcctcaggtgatccacctacctcggccttccaaagtgctgggattacaggcgtgggccaacatgcccagccaatggtagacttgataaagaaaatgtggtacttatacaccacagaatactatgcagccaaaaagaatgagctcatgtcctttgcagggacagggatggagctgggggccattatcttaagtgaactaacataggaacagaaaaccaaataccacatgttcttacttgtaattgggaactaaaccttgacaacacatggacacaaagaagggaacagagaccgaggcctacttgagggtggagggtgagaagagggcgaggatcaaaaaactacccatcaggtactaggcttattacccgggtaacaaaataatctgtacaccaaaccctcatgacacacgatttacaataacaaacctgcacatgtacacctaacgctaaaagttaaaaaagaaagaaatttaaaaaaaaaaaaaaaagactcctactctggggacagccacatatgcttctcaacgagcaaccaagttcaccctctccactctagctatttactgcttaaaccataacaggctgaaataatgtttaattatttttatatctagggctggaagatgttactcactgttcctgacctggggctggagcagggacagaagcattaactatctgcctccaggactgttacaaacaatgttgagcaaatgctggaaagtactggtatttgtcatcaaagccatcaagctccccaagctggggccactggactctcacatacaactgtagcccaatcaaggaatctggattcaatactgtcatgaacaaccaaggaagctcagtctcaggtcagtctggctcagagtccaatttgggtgactgcactgctgtctgctcctggaactgagtttccatgtgatgtggtagttccagcagctaaagtccctgtgtccacaatctgcccaggacctcaaaacctagagcctgtcttgttcttaccagttcctgagggacaccatctctagagtcccactcactccagatatcacccttttcaggctacctactggtctccatcagtggttctcaaacaccataggcattaataacaaaccaccggagggcttgctaaaacacagactgctggcccttactcccagagcttctgattcagtcagtctggggtggggcctgagagtttgcatttctaacaagttctcaggtgatgctgctgcttctggtctggtaacacattttaagaatcggtggtacagctttatccatgttgcctgccaccgtgatagacctgcttgccagggtaccataagactgaggcttcaaggataagaaaggagcagccaactgaaagccccgaaaagggcactccaagcagaggggattacagtccccaaagtccccagcaaggaaagcaagggcaccagtactagggaggagtggaagtcagagtagtctgggtctacaataccaacgagagcaggttgtgaccggacatgcataaactgagtgacccataattatcagctttggaatttgagtctctagacttccatgtaagtatacaaaaaatgtatattaaatttttgctgatgaacattcaaacaatcacgcaaattcgtgttcaaattctgtgaacactggcattactggaagaagggccagaactgaggcatatagtggagaaaatcatttaaattttctgtattcatctatatgtacaaacaaattttagtctggtgttataagaactgcaaaataaaataaaattaagcatcagattcatacacacacaaacaagaatgagggacatcatggattacagagtttctcttacctgggcaaacacgatggcttgttgtggataatagagggaggcagctaatcccatgaaaccaggcggatacactagcttctttatttttgaacctgataaataaaaggttgtacacgccatcagatgattcattatcctcaccatcacaatttaccttatccatttaatacggaacaaggccaggcacagtggctcacgcctataatccaaaagctctgggaggccgaggcgggaggatcacttgaggccaggagtttgacaccagcctgggcaacatagtcagatcctgtctctacaaagattaaaataaaaaaattagccaggcgtggtagtgtgtgcctatagtcctagctacttgggaggctgaggtgggaggattccttgatcccaggagttcgaggttacaatgagctatgatcacacctctaaactccagcctgggtgacagagcaagaccgtgtctcttaagaaacccaaacaacaaaaccaaaataaccccaccactgaataagatttctttggtcctaaactgaaagaatgtgccaaataaagtcatgtgcaccaaaacgcttttgcactgctttattgagataaaattcatattcacccatttaaagtacagttcaatggcttttagtatattgacagaggtgtgtaaccatcattacaattaactttagagctttttcataatcactaaaagaaacccattagcagtcattcctcaactcccccgtaccgtccagccctaggcaaccattgatctactttctatctctatgtgtttgcctactctggatatttcttttttttttttttgagacagagttttgctcttgtcacccaggctggagtgcaatggcgcaatcttggctcactgcaacctctgcctctcgggttcaggcaattctcttgcctcagcctctcgagtagctggggttacaggcacacgccaccatgcccggctaattttgtatttttagtaggcatggggtttcgccatgctggccaggctggtctcgaactcctgacctcaggtgatccacccgccacggcctcccaaagtgctgggattacaggtgtaagccgctgcgcccggccctctgggtatttcatataaatggaatcatgcagtaaatatacggtcctttgtgactggcttctttcactcagcaccaagtgttttcaaaagaacacctttttttccctaagagagcagaaaaaaagattattttaaaaataaacaaatgagtattttggtttctagggtttatgttcttttatagcaatctggcttcctatataaatactaaacacaagcgttcttcttctcccctttctgcaaccccgttaaaaaaacagtaagaaaaaacattaataaacccacaatgaagagaaaatgtgtggaagggccactggcagaaaggaagtgtcaatcaattttcagaaaatggagagtgaacggaaataagaggacacactgccttgaaatcttgaaatcttgaggaggagtgcagcctcagagggagcagatctgtcccaggcagccccagggagattccagatccagagatggcaggtaccatggggagtggagatggcaaccagggagcaagacaagggcacaggacaaacgcaagtccgatgcatggaccagcatggcctttccttcccctatgccatcccagtacaaaactacccctggccaggaagtcacaccagttcaaaatgttaaaaaacccagtaaaccagggttactgggtgtggtggctcacacctgtaatcctagcacttggggaggtcgaggcataaggattgcttgaggccaggaattgagaccagctggagtaacatagcgagactccatctccatttcttttttttctgttgagagagggcctcactcggtctcccaggctggagtgcagtggcacaatcatggctcactgcagcctcgacctcccaggttcaaactatcttcctgcctcagcccctcaagtaggtgggacaagaggtgcaagccatcatgcctggctaattttttttttttctgtagtttttgtagacacggggtttcctcatgttgcccaggttggtcttgaactcctgagctcaagcaatccacctgcctcagcctcccaaagtgctgggatcacaggcatgagccagtacgcccagccccccatctctattcctttaaaaaaaaaaaaaaaatgagcctgatgcagtggctcacacctgtaatcccagcactttgggaggctgaggtgggaggactgattgagcccaggagtttgagaccagcctgggcaacttagggagaccacatctctacaaaaaattaaaaaattagtaaggtgtggtggcatgtgcctgtggtcctagctactcaggaggctgaggctggaggattgcttgagcccaggagttcaaggctactgtgagctgtgtctatgccactgcactccagcctgggtgataatttggatgttgttctctctgaatctcatgttaaattgtaatccccaatgttggaggtggggcctggtgggacgtgacctgatcatgaaggtggatttctcacagatggtttaacaccattcccttggtgctgtccttgtgcaacagtgagttctcttgagatctggttgtttaaaaatgtgtgacacctcccccacctctttctcttgctcgcactcttgccatgtgagacaccagctccccctttgccttccaccatgattgcaagcagcccaaggcctcaccagaagccgaggagatgctggtgccatgcttcctgtacagcctgcagaactgtgagccaactaaacctcttttctttataaattacccagtgttaggttatagcaatgcaagaatggcctaacacattgggtgataaagcaagatcctgtctcaaaaaaaaaaaaaaaaaaaaaagagttaaaacagtgggggcagggtatcactaaagaaacaccatggatttcctgctgagaaccaagagagctggaaggggtgagtatgtcagtgcctgagagaaaagccctcctcacactggccctgggtgcacccttgtatatggtcacttcctgcccagctcccctgaggtagaacctgcccgtcagtgggccccatgtacagacagggagttcttttttttttttttttttttttcccgagacggagtcttgctctgttgctcaggttggagtgcagtggcgtgatctcagctcactgcaacctctgcctcctgggttcaagtgattctctagcctcagcctcctgagtagctaggattacagacaccctccaccacacccggctattttttgtatttttagtagagatggggttttcccatgttggccaggctggtcttgaactcctgacctcaggtgatccgcctgcctcagcctcccaaagtgctgggattacaggtgaaagagttcttattagcatttcagctgcctcactttgaaacatgactggataaccaagaatcaccagtcatttgtggaaagcctgaaacataaaggagaaagaccaagacaagcacaaaggaaacagaagaacttcaaaacaaaactaaacctattactaagtatcatcaaataaattttaaaagccactacattaaaagaaaaaaataattctatgaaaaaaagaacattcaaagaacaggaaggagctcttggaaatgaccaaagcaaaaaaaattcaaaaggaacaaaataaaataatcaagaaaatataagagacacatagggtccttttaaataactcaattgctaattaatgcgttgaggaaggaaaaagaatgagagtaaattttcaaagatacacaagataggctgggcgcagtggctcatgcctataatcctagcgctttgggaggctgaagaaggaagactgcttgagctcgggagtttgagaccagcctgggcaacatggtgacacccggtctccacaaaaaaaaaaattagtcaggtgtggtggtgcatgcctatagtcgcagctactcaggaggctgagatgggaggattgcttgagcctgaggaggtcaagactgcagtgagccctgatcatgccactgcactacaacctgggtgacagagtgagatcatctctcagaaagaaaagagaagagaagagaagagaaagggacgggacgagaagggaaggaagaaggagggaagggaagggagaaggagggaggggagggagggatgcaggggatggaaggggagggaggagggaaggggagggagaaggagggaaggggagagagggaggggagggcagggaagggagaaggagggagggagggaggaaaagaagatattttccttcagctggatgctgcaagccgccatattgtttgggcaagaatgaaaacactatatccaaggctgggcatggtggctcatgcctgtaatcccagcactttgggaggctgaggcgggtggatcactggaggtcaggagttcaagaccagcctggccaacatggtgaaaccccatctctactaaaaccacaaaaattagccaggcgtggtggtgcacgcctgtaatcccagctaactgggaggttgaggcgtgagaatcacttgaacccagaggtggaggaggttgcagtgagcggagattgtgacactgcactccagcctgggtgacagagtgagactccgtctcaaaaaaaaagaaaagacttctatctagtcacagcaccaaagaaattcagaacactaaagattcacagaagatcttcaaagcttccaggaagaaaaaaaaaatgtatcacctgttcagaagcagcaaatatccagaatggctactgactctcacatctacaacgccagatgctagaatacatggctttgaaagttttgatggcaaacaaaattcagtgcccaaccaaactgtcacatggtatgagggcagaaagtgattttcagacatggaaggtcttgggaagtttacctccaacatacgcttttttgaaagtgacttaagcatgtagttcaacagcacggcagagtaaaccaaggagaagatgacatggaacccaggaaaagggggcttaaacccaagaaagtgtgaagaagaccagtcccaaaacaagaactgtgttgaagtctcaggccagattgtaggaggatatagagctgtggagcaagggaaatggacagaagagacagcaggacacagagcctggagaaacctgagaatgaggttaaaaaaaccagtagaggatgaaactagagaatacacatggccttgactccactgagaggcatagtgttttttgctgtgggacccatatagatgctagcagaatgtgtgtgttattgatttttttttttttttttgagatggagttttgctcttgctgcccaggctggagtgcaatggtgcaatctcggctcactgcaatctccacctcttgggttcaagtgattctcctgcctcagcctcccaagaatctgggattacaggtatgcgccaccatgcccaaataattttgtatttttagtagagacagggtttcactatgttggtcagtctggtctcgaactcctgacctcaggtgatccacccacctcagcctcccaaagtgctgggattacaggtgttagccaccatacccggctgatttgtttgtttgtttgtttgttttgagatggggtctcgctctgttgctcaggctggagtgcagtggtgcgatctcggcttgctgcaacctctgcctcccgggttcaagtgattctcctgctttcgcctcccaagtagctgggattacaggcacccgccaccacgcctggctaatgtttgtatttttagtagagacgggtttcaccatgttggctaggctagtcttgaactcctgacctcaggtgatacatccgccttgaacttctgaagtgctgggattacaggtgtgagccactgtaccccgacagaatgtgtacattaatccttaaacggttctaatcacataagtactgtttattggctttaaaactttaaacagagaaatccccaacgatggaactgggactgctgaagagaatacaaatgttatcaacctagactattaatgatttactgtttctctcctgatcctgttgcatgaattgaaagggtataattatcctagaagagaaaagcctgtgatatccctgcatatggcccctcccctgcccccatccacttgaagcagctcacccaagtgaggaccagggaaagagcagccaacctgccacccagtcatttctcactcctccagggagagccgagaagtggcagctctcgggcctccagctcctgctggttcacacaatgagccagagacccaagaacttcaggaaggaggtgtaatcatactcccctgcccccacctccatgccctatctcccaagaggccagtggtacaggttgtcactatcagcactgccaggggcggggggaaccactggtggccaatgctggggagagccaccagaaggcaacaatagtgtcaacaaccacgtgtcatcttggagtggtctggctgggcccacttcctctgaatggacatccattcacctctctgagagcctcttgtcaccaccacagttgtggcaatcctcaacaactgaagcagactaccttagcagatacgctcaagaaaccccaccaggccaggcacagtggctcacaactatgatcccagcactttgggaggctgaggtgggaggatcacttgaggtcaggagttcgagacaagcctggtcaacatggtgaaacctcgtgtctactaaaaatacaaaaatgagctgggcatggtggtgcacgcctgtagtcccagctactcgggaggctgaggcaggagaatcacccgaacccaggaggcagggttgcagtgaggctgagatggcgccactgcactccagtctcggcaacagagcaagactgtctcaaaaaaaaaaaaaagaaactcctatcaggagggaccttctgcacccacccaccctgctgctgccctcaaaggggcccattcacctggaggggcctgcaaaccattctggctacccacagacatccctatcaccccactcatcttgcttggtgaacccctctgatgctgctcacctcaggtctttctatacccaacgctcaggagaaaagacctgctattgcacatgtgtgtgtgcgtgcctgtgtgaatatttgtgaaaaagaattaaggtgtcaaattattttaatactaccaagctctccccaggaaaaggaagaaaagagacagaacgaacaaacaaaatcagaggactaggacccactgtagcagatgtcctcatgctgctgctctggccaggagagcaccatctccaatcctccttaggatggtcatcctagtggatgttccagggacaagctctcggcactgtaggaacgtacccacagcacagaaaaagtgctttctttggacctggaagattttcccacatgctctaaccaggagagggagggggaagctcctctcactcacttctacattcctatctccctaacgatagctgaaatcccaacaccctggccttgggatgttcatcaatctcaaacgctatctaaataagaccgaatgctcttctgaacagctttgcaagaaatgaggtgaaagaagtttagggaaaaatgttggttcataagttgattacaaaaataagctggaaatttaattctgacatattctgcatgagatgggaggagggcacaaagactgtgacatgagttgcttccacaggtgagctggtagtgccaccagggcagtgtctaccctccagattcaaaaataacagccattagctgggtgcggcagctcatgcctataatcccagcactttgggggacaccaagggaggtggatggcttgagttcaggagttcaagagttcaagagttcaggagttcagcctgagcaacatagcgaaactccgtctctactaaaaatacaaaaattacctgggcatggtggcaggcgcctgtaatcccagctacttgaaaggctaaggtgagaggatcacttgagcccaggaggtccaggctgcaatgagctatgatcacaccacttcactccagcctgggtgacagagtgagaccctgtctcaaaaaagaaatcaattaaaaaaaaaataaggccaggtgtagtggctcacacctgtaatcccagcactttgggacaccgaggcaggccgatcacttgaggtcaggagctggagaccagcctggctaacatggcgaaaccccatctctactaaaaatacaaaaattagttgggcgtggtggtgcacatctataatcccagctatttgggaggctgaggcaggagaatcacttgaacccaggaggcggagggtgcagtgagccgagattgtgccactgcactccagcctgggcgacagagtgagactctatctcaaattaagctaaacgaaacgaaacgaaacgaaacgaaacgaaacgaaactaaactaaactaaagtaaaagctattgcatgtagagggaagattttttaaattggaggaataggactgatacagtttgaatgattgtcccctttaaatctcatgttgaaatgtgaacccccacgctgggaggtgtttgggtcatgggggtggatccctcatgaatggcttggtgccctccctgtgggaatgagtgatttctcactctattagttaacatgagggctggttgtttaaaagagcctggcatctctctagctccctctctcaccatgtgatgcgcctgctccccctttgccttccaccacgattggaagctttctgaaaccctcaacagaaatagatgctgatgccacgcttcttgtacagcttgcagaaccataagccaaataaacctcttttttttttcttttgagacggagtctcgcactgtcgcccaggctgaagtgcagtggctcgaactcagctcactgcaagccccgtctcccaggttcacaccgttctcctgcctcagcctcccgagtagctgggactacagacacctgccaccacacccggctaattttttgcatttttagtagagacggggtttcaccgtgttagccaggatggtctcgatctcctgaccttgtgatccacctgcctcggcctcccaaagtgctgggattacaggcgtgagccactgcgcctggcatctcttttctttataattacccagcctcagatattcctttatagcaatgcaaaacaaactaatacagggaccagagtagtctctatggttctcttttacaggggtctgattacaggattcataaactttcttcattaggaatgatggtaatgtcagaattttatatcataaacatttagtttccaactagcaaaacttcaagtagttgataacaaattcatctcatcatagcaaagtattttattagcctttatttcctatagatattttataatctagcagtatagtaatatttttaagttggcatttgttagtatttaaagcatttttaaagtttttgtcatcactgactgaaggcatgacaaatcaagaaggtaataaaatctctattaaatcactgctctatctactgtgattaatatagcttgatcttaatagtgaaacgtttagaaacagttgatttctcaggtgtgaaagactttaaaattttgctctttctgtaccaaagaacaacagagatttgatcaagtaaatgtgcctataaaggataacttcttttttttaccaagagtatacaatttctatttatgtttaaaatcaaatatgataaccatatccattatacattaagaaagccgtatttaggaaccaactcattattctgaaacctggtaaatgaagggaaagaatgaaacatatattctatctctgctttatgagctgactgttaaagccataaaattgcacctacctctagccaaaaggagtccaataaggccagcaaaaccaataacaccaagtctcggaaaaaatccaggaggtgcattttggagatagtcatagctgtctacaatagaattagaccaggaagcagttccataaatttctcattaaaaaacaaaacaaaagtcttatacagtatataatatgtatatatagtatcaagtgcttttcaaaccacatattctctgcatcctgctactatacttctcttcaacatactctttttatgtgacatataaacaagatttactattcacatagcaagtgtccaattttcttttctttctttttttttttttttgagatgaagttttgctcttgtcgcccaggctggtgtgcaatggcgtgatctcggctcactgcaacctctgcctcccaggttcaagcaattctcctgcctcagcctcccaagtagctgggattacaagcgcccgccaccacgcccagctaacttttgtatttttagtagagatggggtttcaccatgttggccaggctggtctcgaactcctgacctcaggtgatctacccgccttagcctcccaaagtgctgggattacaggtgtgagccactgcgcccggctgcaagtgtccaattttcaagtacctttggtccaacaacctactgacaatgaagtaaatgttaaattactttcatattcctgaaagcaacagatctgaatcagcaatttgcacagggaggaatacaaatacagggatcctttgctattcaaactcttgttatggaaacacaaaaacagaatagatttggataaatctttggatagatctattgctatctgaagctttgctgcttgctctctgaaactcaggaaccaaaaacaagctgtgagtggtggctcattcctataaactcagcactttccaaggctaaggcagaagaatcatttgagcccaggagttcaaggctgcggtgagctaggattgagccactgcactccagcctgacagcctgacagcctgagccacagagcaagacacagcctcttaaaaagaaaaaaaaaaaaaaaaaaaaaaaaaggaaggccaggtgcggtggctcactcctgtaatcccagcactttgggaggccgaggagggcggatcacgaggtcaggagttcgagaccagcctgaccaacatggtaaaaccccatctctactaaaaatacaaaaaaattagctgggcgtggtggcacgctcctgtaatcccagctactcaggaggctgaggcaggagaatcatttgaacccgagaggtggaggttgcagtgagccaagatcgcgccactgcactccagcatgggtgacagagcgagactccttctcaaaaaaaaaaaaaagaaagaaatcaaatacattagactcagaaaaataagcatcctttgccatctgaactcattactcgaacagaagaacagaataaatttggataataaaggaaacttgtaatttcactcagaaaatagccactgttgatcgctgttgatggtgatagaataaaaataaatacaacatgtgacctattcatcatgactgaacatgccttctgacttcattcacataatgcctcgtctcctctccactgagccaatcccacctcataaaagccaagttgagtcctacttccacacaaaagcctttcctaagctcatcagttcacacctctctccctcctctaaagtcccatcatatttattctctgtaccatcacttggtacctaatcctatagtaccctgtgtttaattattcaggtgtatatctggtgtctccccaaggagaatgtaagctccttaatgatagattgcttacacttctgtgttatcttccctcagtggtaataatggatgttcattcaatagatatttattaagaatgatggctgggtgtagtggttcacgcctgtaatcccagcactttgggaggccaaggtgggaggattgcttgagtccaggagttcaagaacagcctgggcaacatggcgaaaccctgtctctacaaaaaattaaaaaaaaaaattagccaggtgtggtgatgcatgtctgtggtcccagctacttgggaggctgaggtgggaggattgcttgagtccaggaagtcaagactgcaatgagctatgatcatgccactacactccagcctaggtgactgaatgagaccctgtctccaaacaaaaacaaaaacaggccaggcgcagtggttcacgcctgtaatcccagcactttgggaggccgatgcaggcagatcacaaggtcaggaattcgagaccagcttgaccaacatggtgaaaccccgtctctactaaaaatacaaaaattagccaggcgtggtggcgtgtgcctgtaatcccagctactcaggaggctgaggcaggagaatcgcttgaacctgggaggcagaggttgcagtgagccgagatcacaccattgcactccagcctgggcaacagagcgagactctgtctcaaaaaacaaaaaaacaaaaaaacaaaaatcacactgccaggagttgataaatactggatgtattccatcctggctaacatggtgaaaccccaactctactaaaaataccaaaaaaaaaaaaaaaattagccaggtgtggtggcaggcgcctgtagtcccagctactcgggaggctgaggcaggagaatggcgtaaacccaggaggcggagcttgtagtgagccgagaccgcgccactgcactccagcctgtgcgacagagcaagactccgtctcaaaaaaaaaaaaaaaaaaatactggatgaattaacaaatgaattttagctaggtcatgacttacacaaagccctcatgtctccttctcaatctcatcttcagcactccctatctacttagggttcctcaaacatccaataccaagtcacacctctaagcctgatcatgctgggcccagtgtgcaatgcctgcttccagcagtcccacccccacattttggagtggctaacactgctccttcaagattcacttcagaagtccttccctgactgctcccacctcctcgatttcaattaaactaatctccttcctctgtaccttcaataatggtctgtgattatctctgtatttgcactagtactgaataatatattacacgcatctcagtggttgtgaccactgtcttaaccaatctcaattttcgaggcctggcagaatggtgacttaaaaaatatatacagaactgaactaataaactggaaaactcagcaattctgtcccctaagtaataccagatacacgccagttttccttttcctgggttctttgggaaatgtgatcattttaaatactactataggacttgtattatgtttgcattaattactgtctggcctgttacttattttgcctttagcctagtttttactttccatcctctagtctgggtcatttgaggcaattttttacttccctttatttttgcctactagcccagtgttgctcaattctagatgtgtacacagagcagttgacagagggacacccagatggctctggtgagctgggccaaagtgggtaaatcacaaagaaaggggaaagaagatatgttttaagactgtacggagtctgggcaaaaaagtgagaccctgcctctacaaaaagtggaaaaaatgtgatggcacatgcctgtaatcctagctactcgggaggctgagctggaaggattgcttgagcccaggaggttgaggctgcagtgagctatgatcacgccactggattccagcctggatgacagagaaagatcctgtctcagaaaaatttaaacaagagacctctcagccacacatggacagataaaagactatatcaggagttctctagtttcctcggataaaaatgaagataataaggtatctgtcagcttgttatgagaatttatatatatatatatatatatataaaatttttgtgggtacatagtaggtgtatatatttacggggtaaatgaggtattttggttcaggcatacaatgcataataatcacatcagggtaaatgaagtatcctttacctcaagcatttatcatttttctttgtgttacaagcatcccaattatactctttcagtttatttacaatacctaaaagagtatagcttttttagttatttaaaatgtacaataagctaggcgcggtggctcacacctgtaatcccagcactttggggggctgaggtgggtggatcgcctgaggtcaggagttctacaccagcctgaccaatatggtgaaacccgtctctactaaaaatacaaaaaataggctgggtgtggtggcgtgtgcctgcagtcctagctactcgggaggctgagacaggagaattgcttgaacctgggaggcagaggttgcagtgagccaagatagcaccactgcactccagcctgggcaacagagtgagaatctgtctcaaaaaaataaaaaataaataaaataataaaaaataaaatgtataataaagtattattgactgcagtcaccctactgtgctatcaaatactaggtcttattcattctaactatatttttgtactcattaaccatcctcactccacccccaataaattggtatttgtaaagcacttagaatagtacctgacatataagtcttaaataagtgtttatgaaattaataaaattaagatgttacttattaacatgccttaataatttaaagaaccagtagggggccaggtacggtggctcacgcctgtaatcccaatattttgggccgaggcgggcagatcacttgaggtcaggagtttgagaccagcccggctaacaaggtgaaaccctgtctctactaaaaatacaaaaactaggtggatgtggtggcacacgcttgtaatcctagctactcgggaagctaaggtgggagaatcgcttgaacctgagagacaaaggtatcagtgagctgagactatgccactgcactctagcctgggtgacagagtgatattttgtctcaaaaaaaaaaaaacaaaaaaccagtaggcagctattgttatgtttgtcttcaaacgataaatttatctgacagtctcagaaatatcaggacatcaatacaccatggtgatcttaccaaagaaactgtacttatgtttattttgttctatcatggaaacaaacccttgtaaaaacaagattttgtttgcgagatgcctaataaggggaatgaaatatgatcggtatctttattaatttaccagtttctgattaagattagtcagaacatggactgtgaatccagtttgtgagtgtatgtgataagtggcccacaactgaaaaataatcaaggaaaataaaaccaaatgaaaaaaaagtaagaacactatcaattatgcagtaagaccttttataggagtaccaactcagctccttcctgcttcaaaacttctagagcatctattaattgcaatgcaaatgagctattccgattcagaaaatctattgatgaattagtatggtgtattacgctgcacctagaaatgagatttcttttttttaaagcagtgtatctgtacttgctagcccaagaatcctaacgatcttgaagagacttacctgactatttggggacactagttgcctgaaatctgatgaaaacaacagctcctcttcccagaaaaatccacatagctctaaaattctgcatataattttaaggaatacacagatttcttggagctcattcatggaactccgattaaagagttcaatgttaatgaagtagctgattatgcctaatttaaaatcaacttacctaacccccattgaaccaaactttgcatcttgggcttagtttgggagtacgtttcctaaaaaggtaaaaagaaactgaatgaaactattcacaggatctgctgattagaaagttaacagaataaatatacttgtttttactgaataaattatcatgttattaacgctttttgaacaaagggatacactgtctgtctgggtctttttgtttgtttttcctattataatcttcccttcactgcaaattactcagcagaatggcttactactgccacaggaagcagattccaaacagagtggtttcaacaatccagccatttcactcttccattaaaatggaaaaaatagactaaaaatcaatccccttgatatttaagtggcaagcttttctccatgagattaaacctgtctttcatattaactacttcctgatctgccattaattagagcctacatctggaaactgcccatttgaagcaagaatgaccagctttaatgagacaaaggctatagcccaaagcaaatgaggtgtcaacattctcttaaaaacaataaaaaggctttgtggccaggcatgatggctcactcctgtaatcccagcactttgggaggccgagtggggcagatcacctgaggtcaggagttggagaccagcctgaccaacatggtgaaaccctgtctctactaaaaatacaaaaattagccgggcgtggtggcacgcgcctgtagtcccagctactcgggaggctgaggcaggagaatcacttcaatccaggaggcggaggttgcagtgagccgagatggcgccactgcactccagcctgggcgtgtctcaaaaaaaaaaaaggctttgtacatgaatatcacatgatcctaaaggaaacgagggacccgctagaaggtacccaccttcaagaagtctacagtgaagacaagaagagatacatgggtatcagaaggtatcaaaactagttgccatttgggaaaggattttttttttatttttatttttattaattaatttttttttttttgagatagagtttcgcttttgtcgcccaggctggagtgcagtggcgcgacctcggctcactgcaacctccgcctcctggattcaagtgattactcctgcctcagcctcccgagtagctgggattacaggtgcccgccaccacgcccaactaatttttgtatttttggtagggacagggtttcgctatgttggccaggctggtctcaaactcctgacctcaggtgatccacctgccttggcctcccaaactgctgggattacaggcgtgagctactgcgcccggcctggaaaaggatttgttttgtgtaattcagttcaagtcagaacaagctatcctcattcttttaaatgacctgaaataataaatgccgaattagccagaagatctaaagaactgagtatcgcttcattaaaatccattatttcacgcctgtaatcccaacactttgggaggctaagacaggagtatctcgtgaggtcaggaatttgagaaccagcttgggcaacacagcagagaccccatctctacaaaaaaataaaaatattaggctgggcacggtggctcacggctgtaatcccagcactttgggaggccaaggcaggtggatcacgaagtcaggagatcgagaccatcctggctaacacagtgaaacctggtctctactagaaatacaaaaaaattagccgggcgtggtggcaggcacctgtagtctcagctactcgggaggctgaggcaggagaatggcgtgaacccagaggcggtgcttgcggtgagccgagatcgcgccactgcactccagcctgggggacagagcgagactccgtctcaaaaaaataaaaaaaataaaaataaaaataaaaatattagttgggcatggtggtatgtgtatgatgtccgagctacttgggaggctgaggtgggcagatctcttgagcccaggagttcgagatcagcccgggcaacatggtgaaaccttgtctctaccaaaaaaaaaaaaaaaaaagaaaaaacttcagatcaatatctagaatgattgccgacttcttttgctagcttaatatttttactattaaaaaaaattaaggccgggcacagtgggtcatgcctgtaatcccagcaccttgggaggccgaggtggacggatcacaaggtcaagagatcaagaccatcctggccaacatggtgaaaccccgtctctactaaaaatacaaaaattatctgggcttggtagcacacgcctgtagtcccagccactcaggaagctgaggcaggagaatcacctgaacccgggaggcggaggttgcagtgagctgagactgcaccactgcactccagcctggcaacagagcgagactccgtctcaaaaaaagaaaaacaaagaacaaaaaaacaaaattaaattggttcttcaagaaaagggctagaaattgctggtctgaaaaaggaaccaggaattagaaatatttctactcataaaggctttgttctacccaggaaaacaaaaccattataattacaaaaactattataattacaagcaagtttttatatttagtagtagtggaaataaacatatagataactaatccatcatccagagaggtattttgctgcactgagtatcacgcatggaagaaaaggtaaaaaacaaaaagcaaccttaggctaaaaggtacaaagtacttttattgccaaaaaaaccaaacaaacaaacaaaaaaaacagacagactacaagtaacagtagtcatgcctacatgatacaaaaatatacacacaaatttgctgactttatcttaactaccagaagtttaaaaatcttctagaacaagagaataaagtctaatcattttacaacatgttatgtttaaagtctttaggtattacttaactcaataatatggttatgatacttaagtataatggcctaattcttattgttgatagagtccatgctttactattttctttctaaattggtgaacaaaagttcaacagcagcataggcaacggaaattaaaaatttttaaacaagctctggatcaaaattgaatttaggccaggcatggtggctcacgcctgtaatcccagcactttgggaggccaaggtggacagatcacttgaggtcaggagttcgacatcagcctggccaacatggcgaaactctgcctctacgataaatacaaaaatgagccaggcatggtagctcgtgcctgtaatcccagctacttgggaggctgaggcgggagaactgcttgaacccgggaggtggaggttgcagtgagctgagagcacgctactgcactccagcctgggcgacagagcaagactccctctcaaaaaaaaaaaaaaacaaaaagactaaatttataaatctcaagcaaggtaaatctagacaatttcccacatatctacatctattagtttttattaatttcaattttcaaaatcaagatcaagtacaacaaacatatgtatcaaagcctacaaaagcattctatagattgtaaacgttggttactgatgttaaaaatcacagaaatacttttcatttacgtaatgacaaatgcctgacctaaaacccaggcagggacagaaaccaatctgtatatgtagttctttggtcactagaacaaatagttcagtaatccagtatggaattctaccctattttagtatagcattcaaaatgccatatcccctcctggtttaagtggcactgatttgtatagtggggggagaaaaacttcgcaatttttatgtaagtgtttacgttgcatctttttcctttgtttagagttccagcccacaagcctcccctggtagacaacaatgttttcataactgcaagcaacaaggtagttcctagcccctctgctctctagttaaggcgttacgcactgcccagggagagggaaattctctctgtagctgtggcaacagctgtcaccaggaagctagggcatctctgcaacccctcctcagatggcactgaagaacatctgtaagtcaggcacttttaacttggggccttgtatttcaacattttttgtgggtacgtagtaggtatatacatttatggggcacatgagatgtgttgacacaggcatgcaatgtgaaataagcacaatatggagaatgcggaatctatccgctcaagcatttatccttagtgttaaaaacaatccaattacactctttaagttattttaaaatgtacaattaaattattgttgactacagtcatcctgttgtgctatcaaataggttttattcattcttgctacttgctattttttttttttgcacccattagccatccccacctttcccccagacccccactacccttcccagcctctgtcaaccatctcagggccctttatcatgcctttttccaaaaacatgcagccaatacagactttcctctatggactctaaacagaaatgcgttcactccattttcagaacagttgtacctgacaccaggttgtgtatggctcgcaatagtgtcggagctgtgagatgctttcttcaagctggctccttgcctcctccacatacttcgattgaccctcaggaactgagtagagtgaaagctgcgcacattaaaacaaaacaaagatttaaaagatgtactgtctacaggatacatttatcaaatttgtaagtatttaatataatatttctagtaattcatgaattacagtgactctgtggtcgggtgtggtggttcacgcttgtaatcccagcactttgagaagccagggcaggcggatcacttaaggtcaggagttcgagaccagcctagccaacatggcgaaacccagtctctactaaaaatacaaaacttagccaggtgtcgcggtaggcgcctgtaatcccagctacttgggaggctgaggcgggagaatctcttgaacctgggaggtggaggtagcagtaagccaagattgtgccagtgcactcaagcctaggcaagagtgagactccatctcaaaaataataataataatacttcatgaattccagtgactctaagggttacaagcaacctgaactttatctcaaactatctctgcaccttatttccataatcaacgaggccaaggccaaaagggcagggctatgaggtgtcctactttctccccacccactgactacaaacaaagcagctcctctttatccattttatatactggtatttggtattccaccttagattgagcttggaaaaaagattttattactctaaagggtgggtgaaggggttaaaaaagcttgagagtaaccaaagggcatgtcattcagttcaaatgattggtctgatgttaatcaaagcaggacagcaggtttattctccacccagagaacttcttacagccactgctggctgccttctttaccctcaaaaatgccactgtgccaaggcctgagaagcgagtaaagggcaaaagataagctaattagctttatgtaaacaccaatctagtaaccctacccaggactgaaggtagatccttacctcactttattcaaaggcaacagaaactgaatatccaaaataattagtgggaagtacagaccaaaaaggaatgtaaacagtagagagaagatttcttgttttttttttttttaaatttagtatttattaagtacatacttatgagcggctcctctagccaagaaacagaaaggatccagatctctaatttcttagagaggaaaaaatgtgaatatattcttggctcgataagaatcaagataagccaagaatcaggcagaccacttagaaaagtgagttgtgcttataacctgttgggacacagtggattccccagtaaacatttataaagtattccttaattgtgcccttacctaagtatcattaaagtttatctgttgaaaaagccatagtttaatatttcccacaaattaaacaaactataaggaaatatattttctctgtttaaatgtcttctggctgggcgtggtggctcacgcttgtaatcccagcactttgggaggccgaggcaggtggatcacctgaggtcgggagttcgagactagcctggccaacatggtgaaaccttgtctctactaaaaatacaaaattagccaggcgtggtggcacatgcctataatcccagctacttgggaggctgaggcaggagaatggcttgaaccaggaggaggaggttgcaatgagccgagatcgcaccattgcactccagcctgggcaacaagagcgaaactccgtctcaaaataaataaataaataaataaataaataaataaataaatgtattttaaacagtcacatcttcctgatatacaatttgtaaaaaattatcctacagtaactaaatcagacactcaaaatatatcgcaacatgaacaacatgttacctcatcaaccttcacggaatttttgggaggtgagtccttttttggtgctgcatagactttgaaggtgagcaagctcaggctggctggccccacggacctctgaattacctgaaatgcagaagcaatcttaaacctctctatgttacagaccgaatgtgcagaacatgagcatattcataacctcagccactccccaccctgaaaggcttactgtgctttattttatttttatttatttttatgttttcaagatggagtcttgctctgttacccaggctgcggtgtagtggcgtgatctcagctcactgcaacctccaacgcccaggttcaagcgattcttctacctcagcctcccaagtagctgggattacaggcgtctgccaccacacccggctaatttttgtatttttagtagagatggggatttgccatgttggccaggctggtctcgaactcccgacttcaggtaattcgcccgcctcggcctcccaaagtgctgagattacaggtgtgagccagtgcacctggcctacaaaatatatttttttaaaaaatcagccaggcatggtggtgtgtgcctgtagtcccagctactcaggagactgaggtgggagaactcttgagtttgaggcttcagtgagccatgatcatgccactacactccagcctgggcaatagagtgagactctgtttcacacacacaaaataatcgctccactaaaaaaaaaaaaaaaaaaaaaaaaaaaaaaagatgggctgagaggaggagagttatggtttattaatttaattgtgaatataaaaaatgtgctggacgcagtggctcacgcctgtaatcccagcactttggaaggcagaggcgggtgggtggatcaccaggtcaggcattcgagaccagcctggccaacatagtgaaatcccgtctctactaaaattacaaaaaaaaaaaaaaaattagctgggcgtggtggcgggcacctgtaatcccagctacacagaaggctgaagcaggagaatcacctgcacctgggaggtggaggttgcagtgaaccaagattgtgccaccgcactccagcctgggtgacagtgcgagactccacctcaaaaaaaaaaaaaaaaaaaaaaaaaaaaattcagacccctcctgcgaaggccgtggcagttttctaggagggacgttgatctccttaggttgtatcctggtgctgctggttctgcctaataattgtgatgggcacaaaccacatgaactaatgtcagcactagctggctaatctgtatcgtggaagcaaaagaaatctgtagcaaaactgcattgaaattaagacctcaagatgcacacttaatacttcaagatgtatcaattgtttttaaaccagttaaagtaacaaccacccttttttttcttaatggctttcagctctttatttgcttctgaaatatgggaatttgcagccatacgtttcaacagatatttttgttatattttagctggcattacgttttgtattacagaatagcctcatctttcacattacaggcactgcaaatctcagtaatatgatttccaagatgctaaatcatgcctaaatagttagagagaaatcaatcactcatttattttccacctctcctccatccatttccttttgtctcatttgagcaggaaataaacaattattgagcatgccttgtgtgttaggcacagccatagaaataggaatatggagtaagacatatcctcaccctgaaagggcttccattctggtaggaagaacttgatagatgtaaataaatggacaaacttttttttttttttttacacagggtctcacactgttgcctaggttggagtgcagcagcaggatttctgctgcactgcaaccttcccatcccaggttcaagcactcctcctgtcttgtctcccaaatagctgggactacaggcatgcaccaccatgtccagctcatttttgtaatttttgtagagacagggttttgccatgttgcccaggctggtctcaaactcctggattcaaacgatccacccaccgcggcctcccaaagtgctgggattataggtgtgaaccactgcacttggcctgggacagattaaaaaataaaataagggaggctgaggcacaagaatcgcttgaacccaggaggtggagattgcagtgagccaagatactgccactgcactccagcctgggcaacagagcgagaccctgtctcaaaaagtaaataaataaaagaaaagtgatacgggaggggcaggcagggaaatgctgggtagagaagggcgtggtccctggctagggctccacccctgggcctgtgcccaccaacctaggtgaggacaggcatttctgtttttgtgcccaaatatcgtatttcccaagaccaccctggcccaccacactcccatcttgtgcctataaaaaccccgagaccctagcgggcaggcacacaagcggctggacgtcaagagaagcagaggcaaggaacaacataccagcagaagaacacagtgacagactccggcaggccaccaacagcagaacggcaggacaacgcggagtttggctgagggcggtcagaggagagcctggctgctaagcggcctgactccaggggaaaaccaccttcccactccataccccttctggctccgtttccatctgctgagtgctacttccaccattcaataaaaccttgcactcatcctccaagcccacgtgtgatccggtttttctggtatactcaggcaagaaccctaggatacagaaagccctctgtccttgcaataaggcagagggtctaactgagctgatgaacacaagctgcctactgacagcaaaactaaaagagcacacgtaacacacgcccactggggctgcagaagctgtaaacatccacccctagacgctgccatggggttggagcccacactccccacgacctgcccatctgcctgctttccctaggggttttgagcagtggggcacctaagaagtgggccacactcccatcacatgccctgtaagagggacaagggaaattccccttgtttcaaaagcatgaattctcccggctcttaggcagttctacagaaagacaaaacaagtataggacattatagacagaggaatcagcatgtgtgaagccacgaagctgggaaacagcatgggagaagtgtagggagttcgagttttgtgggagggagcagagtgacagagagatgagtcagagaagttggttgtagccagatcataatgggactcgtgtggctcacataaaagtcctaggtaataaataccaaaagatctcaaataaggatggaatatagaatcgagtttgccatttagaaagacgattatttctcagtgtggcgctttaagtcattaaagggccagctgaccagttatggtgctgctaaaacaatgaaggaaagaaataagggcccaaggaaagattgcacaggagaggagaaagaggagaaagtagaattgagatagtttaataggcaaaattagcaggacttagtgaccaaagggaaaggaagagtgacgatgaccttggtttaatttttattttcatttattttaatttttaaactgacaagaatcgtgtatatttattgtgtacaacatgctgttttgaaatatgtgtacattgtggaatggctaaattgagctaattaacatatgcactacctcacaaattaatttttgtggaatctaaaaaggttgaactaatggaagtagagagcacaatggtggctaccagggcaagggctggggggagttggggagatattggtcaaaagtacaaagtttcagttaggaggagtagttcaagagatctgttgtacaacataatgactagagttaacaacaatgtattggattttcgaaaatcaggaaaagagtagattttaagtgaccttggggtttccgatgggtttttctagttgggtggtgacacagcattcctgagagaggaagtagaaaaagaggggcaagtctgagggaaaaatgatgagttggttttggacatgttccagagaccgacagacagctagaggtctagtcatctatctatgtatcttttattttacttgaaaagctaaagtaggcaaacttagaaactgttgtcttttggaaattaagaaaaagttgacctgaaattttaagtccataagaacatgttttttgggtctggacttcctcagcacttcaggggtgtatttatttctcataaagcacagtaaggccgggtgcggtggctcacgtctgtaatcccagcactttgggaggccgaggtgggtggatcacctgaggtcgggagttcgacaccagcctggccaacatgatgaaatccagtctctacaaaaaacacaaaaattagccaggcgtggtggcagacgcctgtaatcccagctactcgggaggctgaggcaggagaattgcttgaaactgggaggcaggggttgcagtgagccgagatcgtgccactgcactccagcctcggcaaatatatatattatatatatatataaatatataactatatctatacataactatatatatatagcagagacagggtctcatcatgttactcaagctggtctcgaactcctgagctcaagcaatcctcccgccttggcctcccaaagtgctgggattacaggtgtgagccaacacactcagcctatctttgattttaaatctcaactcatttcctttaacattttattggattcttaattattaatttctactttaccttcccctcttatcttacttgtttttctagttttaatattattctaggcctgcctccctttactgcctaaactgttttcttcttcttcctcttctcctattagttttcctccctaagcctaccctgatacccattccacagcaagaactgtggccacaagggtggtagcaccaaagaaagctggctcctgcagcggccttttcagcttccagcaggctctcaacagacaagcaaacaaaacaaagaaaaagcaaacctcaccccaggagacctgggagacctacaaatgaacactccccaggaccataattcttagtttgcagagaacacatgatttactcgaggatttctcaaactcagcactactgacatttgggttgggtccttctttgtggggctgtcctgtgcactgcaggaagtttggcagcatccctagcctctacccactagatgccagtagcacctcctcccagtcacgacagtcaaaaacatctccagacactgccaaatgtctcctggggagcaactctcccactgagaacctctgatttacttgagtaagtattactttctgacatctctcaccatctagacttgaagaaaatctgtatgttttaaaacccatggcctcaaacatagtgagaaaccagaacaatcactactaggccggggaggtgggagttggaaggaagtggacttactgagaagtggcacaagtgaactttctggggtgaaacaatcttgattggggtatgggttattcaaggtatatacatttgtcaaagctcaaattgtacaactaagactgtacaacttaaaaatctatgtatttcactctatgtaaattagactttttaaaaaatccatcagctctagcacacctaatccatgccaagctcattcctaaggagccagccacacacctgaccatggtaaggaactggtatagatctgtgtgatggaaacccatgggaggagccttggtaaaaggtccccaggtagacatggctgaagctgatgcactcaacatcttggctgattcatcttcctttttagcttcaaagggggctcctcctggtgcgagatgaccccaccctgcctcagcatgctcaccacctttccctcttaacagtaaaaaggaagctggccagaccagatgtcatcacaaatggccatcttcgacactgtgtgcctgccaggtggttatcataatttgttagggctcatattgagtattcaggccaacctattcaaaatcaggatttaagaagggaaaggctaagatgggtagaatcaccccaggacagtgtaagggcacaaagaggagatgaaccttcttcaatcttttgtctccccaaggaagaacaatccagttctttgaagaaacacaatcaactttcagggtctgggacataataaaaaaaaatctctagccttatcaactttcctcctgttcgcactctggatgggttgctttgtgagacatgaacacaaaggtattctctctccatgaggagtcctgacccattatgatataatcggactgaatatacctcccaagaagtgaaatctcccccatactttttctttttccctttttttttttttttttttttttgcgacagagtctccctctgtcgccaggctggagtgcagtggcatgatcttggctcactgcaacctccgcctcctgggttcaagccattctcctgcctcagcctcccaagtagctgggactacaggtgtgcgccaccacatgcggctaatttttgtatttttagcagagacggggtttcaccatgttggccaggatggtcttgatctcttcaccttgtgatccgtccgcctcggcctcctaaagtgctgggattacaggcatgagccactgtgcccggcctcccccaaactttttctgatgcagggctgtaatctctagactgcatgtacccacgccctgagcactccctttcccaagtgatagtccttgagaagccttgttgccaggtacactccctggtcagggcagatgagttggctcagaaaatgagtacatatgcacctgccaagaactgattagatatggtctactttgcattatatgagttaggcttgctcaatcaaagtcaagcaagctctgttaagagctgaatctccaattagtgctaagttacaggctagatcaaaggtggcatttctttagatccagcccctcgggagtatacccttcagttactaaatgcctttcttggcattcagctagttgggggtctcaaagtaaggactctaatgtgttggcttctctgaggttttgaatacagctgtaagacccatagtcacagagaaaacgaaaatttggcttaaaggtaaactggtggcccttagctttgcaaacctcagagggagtgtcattgagttttctcactcttgtggctaactcttctttctttctggtctgatcctactccccagcaaagtatcaaggtacactctatcttggaccttagactctctatgtctcaaaacttttgtttcgcacagcccgcaaggggcttgtcaatggaaacagagcaaccagtattggtgttgggttagatgaggccctaacaagaagtgtaaaggggtaggctgtcatcatcttaaagacatttggttcttactctgtctccactgaagcttgcgaaggactgatgttggcaaaacaaatctggtcaggcaagcaaggttatatataacaattagaagaggtcaaccagggttttatttcaaaaacaaatatttactgcacacccacatcatgtcagacatggtactaaacagataaaacacataagcagacaaggtccctgctcttatagagcttccaggaagcttatgaatttaatcaaagactcaggccacaatttaaaaaataaattaacattcaaaaaaagattcagggcccagcacagtggctcacgcctataatcccaccactttgggaggccgaggcaggtggatcacaaggtcaggagttcaagaccagcctggccaacacactgaaactccatctctactaaaatacaaaaattagccaggcatggtggcatgtgcctgtagtcccagctactcgggaggctgaggcaagagaatcgtttgaacctggaaggtggaggttgcagtgagccaaaattatacctctgcactccagcttgggcaacagagtgagatttcatctcaaaaaaaaaaaaaaaaaaaaaagattcaggcataagattgagtttattaggaggctgaagtgggaggatcacttgaggccagaagtttaagaccagcctgggcaacataacaagactccatctctacaaaaaaaaaaaaaaaaattagccaggtgtttggggcatgcctatggtctcagctacttgggaggctgaggtgggaggattacttgagcccaggaggtcaaggatgcagtgagctataatcgcgtcactgcattccagcctgagtgactgagcaagactctgcctcaaaaaataaaataaaataaaaagattgagtttatcagtcagctccctcagctttaaaggtagattcttagacacagtttaccaagacatgaatctggtaaggtcgtaaacaaacaaatcataatgggtgtccagaaggctaaactgttcttgctttgcaaataaaagtacactgactgcccagaattccatagctctgggatcatgttgtgattatgttccagtaaaactgccttaaagacaaataaaaaccttaagctaaataagtcaccctcagaattattcagactctcatgaatggtggggctcaaatacctaacaacttgctttctttttcaactttatagagaatctagtgaatactctctcccatttaaaaaaagggtgactcttttctcccacaattacagaactattatcttattagacttccatttataatatatgccagcttcatgatagaaggcttttgcaggcctgtgtacacaagaggtttcagaatcacctggggagttgttttttttttttttttttttttttaagacagagcctcgctctgtcgcccaggctggagtgcagtggtgcgatcttggctcactgcaagctccgcctcctgggttcatgccattctcctgcctcagcctcctggtagctgggactacaggcaccagccaccacgcctggctaattttttgtatttttagtagagacggggtttcactgtgttagccaggatggtctcaatcttctgacctcgtgatccgcccacctcggcctcccaaagtgctgggattacaggcgtcagccaccgcgcctggcccacctggggaattttttaaaagcatagattctaacagcttcccccagagtgtctgactctgaatctaagaggggcccaagaatctattcccaagataagcaaagttttgaaaaccaccattccacaaacatatgcttagagaacagttattcaacttaagtttgtataagcactcaaacatacttttaaaaacatttgaaagtataaaatgaaaactgtcctaaatataaaaagaaacagagtgactggccacccactagagaaattatgacatttatttacattcaagaaaatctctcccgtcttaaacaaaacacaacaaataccctccacccctaattccctctctaacaactaccttacccttctaccaacttccattgacaaatttattttaaaagtagactatggttagaaggcagaatagtggatacccttagcaagctgggtagtgactagaagggccacgagaagagcttctagagtgctagtatgtttagtttgtaaaaattcacttatgccccgtttactttcctatatgtatgttatacaaatggtctcagacttacaaatggttcaaccttacatggtgcagaagcgatacgcattctgtagaaaccgcactttgagtacccatataaccattctgcttttcactttcagtgcagtattcaataatgtacatgaaacattcaatagtttattataaaataggctttgtgttagatgattctgcccaactgtgggctactggaagtgttctgagtacatttaagggagggtaggctaaattatgatgtttggtaggttaggtgtgttaatttttgacttaatgatattttcaacttatgataggtttatcagaatgcaaccccaccacaagctgaggagcatccgcatttaagcacaaagtcaaaaaggcagattctgtttgctttctcaattttatctcctcctccctttactactaaatgcacctaaaacctttcttcccaagaccaccaatagcctcccagttgctaaaccccactggacatctggcatcttggttgcaccctgaaactggtgactactctacatcttcaacccctttctttggcttacaggattctaccctatccccattctagaggctttctaggtactctctcctccccttttgggccttctcttcctctgcatagctcttcaaggttgatgagtcatggagtagtctttaactctctcctcttctcactccagggcaatttcattaaaatctaattctttcttttttttttctttcagacagagtctcgctctgtcacccagactggagtccagtggcctgatctcggctcactacaatctccgcctcccgggttcaagggattctcatgctttagcctcccaagtagctgggattacaggcgcccgccaccacgctcagctaatttttgtgtttttagtagagacagggtttcgccatgttggccaggctggtctcaaactcctgggctcaagggatccacctgcctcagcctcccaaagtgctgggattataggcgtgagccaccacacctggccaaaatctaagtctttaactcccactcatatgctactgatgctcaaatcagtatccctagcctgggcctctccctaagcctcaggcttgtgtgtttcctgtgtttctaactccctgagggacatgttaccaggcttttcaactgctacttcaaacaggctatatccaaaggtgaccttttttttggagtgatggaatatattatttctattttccatgtaaataatttaaactctctctatgtaagtatatatacacttacagtatcttacccttctaccaagtttatatatatgtatataaactatatgtatatatatacttatagacttatacatactatatatacttaaaaatatagtttatatagtttaagtatatataatactttatgtatttctatatatagtttacatttatatatttaaaatgtatgacattatgctttcaactatctttctccaaaactgtttttatgagattctctaccttatttaatgatcctacaagccacacaaaggacaacataaaagcaactctttaatgataaagaatgaaaataaatttttttttttttgagacagagttttgctctttcacccaggctggagtgaagtggcgcaatctcggctcaagacaacctccgtgcccctggggttcaaacgattctcctgcctcagcctctcaagtagctgggattacaggcagccaccaccacacccagctaattattttttttttttttgagacggagtctcgcactgtcgcccagcctggagtgcagtggcgcgatctccactcactgcaacctccgccgtctctcggattcaagcgattctcctgcctcagcctcccaagtagctggcattacaggcgcccgctaccatgcccagctactttttggaattttagtagagacagggtttcaccatgttggctaggctggtggtctcaaactccttacctcaggtgatccacctgccttggcctctcatactgctggaattggccaaggtgggcagttcacgaggtcaggaaatcgagaccatcctagaaacacagtgaaaccccatctctactaaaaatacaaaaaattagcagggcatggtggcgggcgcctgtagtcccagctactcaggaggcagaggcaggagaatggcgtgaacctgggaggtggagcttgcagtgagccaagatcgcgccactgcactccaacctgggcgacagagcgggactccgtcacaaaaaaaaaaaaaaagtgctgggattacaagcgtgagccaccgcgcctggcctcagtcaaccttttctgcaataatttccattctgacagcatttttcactcgaaacaaaactattttaatctgattctaattatttaggaggtaaaaatctgaaatgggttttttacaaaaaaaaaaaacaaactatgaacactgacaatacttttgagattattcttattctaagtaaccaacacaaaaaaaagaactatgtgaaagaactcagaatacaacaaaatgatgaagacaataaaaaaattttgtcaaaatcaggctacactgttgtcctcagtaacgtgttgtaaattgaatgaaaaatcaagagaaaggccgggcgcggtggctcacgcctgtaatcccagcactttgggaggccgaagcgggcagatcacgaggtcaggagatcgagaccatcttggctaacatggtgaaaccccatctctactaaaaatacaaaaaaaaaaaaaacaaaacattagccaggcgtggtggtgggaacctgtagtcccagatactcaggaggctgaggcaggagaaaacctgggaggcggagcttgcagtgagccgacatcacgccactgcactccagtctgggcgacagggcaaggctccgtctgaaaaataaataaataaataaataaaaataaaaatcaagagaaatgagtccacaattcttgaaacgtcaaaagaatacagaatactctcctccataaggagcattcaggacagtatctacattttatacagcaatcttttatttttatattttttattttttgagacagagtttcactcttgccacccaggctggagtgcagtgccacaatctcggctcactgcaatctccgtctcctgggttcaagtgattctccagcctcagcctcctgagtagctggaataataggtgcctgccaccacgcccagctaattttttttgtattttcagtagagatggggtttctccatgttggccaggctggtctcgaactcctgatctcaggtgatctgcctgcctcggccttccaaagtgctgggattataggcatgagccaccatgcccggccagcaatcctttctaacatgtagggccacacaccaaacagaacagaggctttctctggaaagggggctggggggaggtggacaatagcaacctgaccaactgtactattttgactttttacaaggaaaagtatttcagtattacttacaacattttttttaaatagatgttttcttttcaaagcagttaccttgataaatcatatatggagtcggaatttactacaactatttatataaatttcataagtgaaatttattttttaaaatttattttattattattattttttgagacagagtctcgccctgtcacccaggctggagtgcagtggtgtgatctcggctcactggaacctccgcctcccgggtttaagcgattctcctacctcagcctcccaagtagctgggattacaggcccacaccaccacgcctggctaatttttgtatttttagtagagacggggttttgccacgttggccaggctggtctcaaactcctgacctcaggcctcccaaagtgctgggattacagacatgagccaccacacccaaccaaaatttacttttaatatgtaatcatatggcttccatttctaaatgccttcagatcacattttaagcctaaaagaaaatcagtctcggccaggcgccgtggctcacgcctgtaatccagcactttggaaagccaagttggttagatcacctgaggtcaggagttcaagagcagcctggctaacatggtgaaactctgtttctactaaaaatagaaaaaattagccaggcatggtggagtgcgcctgtaatcccagctactcaggaagctgaggcaagagaattgcttgaaccctggaggcggaggttgcagtgagccgagatcatgccactgcactccagcttaggcaacaagagtgaaactccgcttaaaaaaaaaaagtaaagaaaatcagtctcgatatattttaaataagagtggtaaagaatagagaatgggccggattcggtggctcgagcctgtaatcccagcactttgggaggccgaggcgggcagatcacttgaggtcaggggttcgagacaagcctggccaacatagtgtgaaaccctgtctctactaaaaatacaataattagctggtgggcacctgtagccccagctactcaggaggctgaggcaggagaatcgctcgaacccaggaggcaaaaggctgcagtgggccgagatcgcaccactgcattccagcctgggtgacagagtgagactccgcctcaaaaaaaaaaaaagattcattatctccacacacacacacacaaagatgagaaaatggcatctgtacgcctatgtttattgcagcactatttacaatagcaaagacttggaagcaacccaaatgcccatcagtgatagactggataaagaaaatgtggcacatatacaccatggaatgctatgcagccataaaatagaatgagttctttatagggacatggatgaagctagaaaccatcattctcagcaaactaacacaggaatagaaaaccaaacatcacatgttctcactcataagtgggattgaacaatgataacacatggaagggaacatcacacactggggcctatcaggggatggagggcaaggggagggagaccattaggacaaacacctaatgcatgcggggcttaaaacctagatgacaggttgataggtgcagcaaaccaacatggcatgtgtacctatgtaacaaaccttcatgttccgcacatgtatcccaggacttagagtaaaatagaaaaaaaaattacaatattagtcttcattaaaacaatctctactggaaccttttctacatctcctaattaaacgtagtgtccaacataaacttttctttctgttgtggtggtggtggcggtaaagaatcaagctttatgtaaacttggtcaataataagattatctcattctactaaaaaaaaaagaagaagaagaaaagaaaatggcattttttttaaaaaaaaaaaagaggaaggggacttgtagtatgattccaccgagttttttgaaaatgtcataccaagggtatatttgaatatgtccagaacggagtctaaaaagatgttagggccgggcgcagtggctcatgcctgtaatcccagcactttgggaggctgaggtgggcagaccacgaggtcagtggttcgagaccagcatgaccaacacggtgaaaccctgtctctactaaaaacacaaaaattagccggacgtggtggtgcacgcctgtaatcccagctactcaggaggctgaggcaggagaattgcttgaacccgggagatggaggttgcggtgaacgaagatggcgccactgcactccagcctgggcaacagagtaagactccgtctcaaaaaaaaaaaatatgatgttaacagtggttgtctataggtggtgatattaaaggtaattcttatctctatttcctgaagtttttacaaaaaaaccattgatttgttttgtaacatgcaaagaacaaaaatggctagctcctgaggatattataaaggtttgccacaaagtttgaagataattccaaatgaggaagagtaaaaatgttttgatcagtgatagaatttttggaataaatataatgacagtataattaaatctatcctctcaaaacgactgttttgatgcattcatttgaatgtaaaatttgggagcactcatactttaacaataacaataaaacccacaatcatttcgatctgtttcacagcaaaggaggatataaagccaagaatttatctccctttgtcactcaggctggagtgcagtggtacaatcatagctcactgtggccttgaactcctgggctcacctaatccttctgcttcagcctcccaagtacctaggactatgggtgtgacggagcacactcagctatttttttttttttttttggtagagatggagtctcactatgtttcccaggctggtctcaaactcctggtctcaagcaatcctcctgccttggcctcccaaagcgctgggattacaggtgtgaaccaccatgcccagtaaagtttagacttcaaacaacattaaaaaaactcttcctaatacaacaaacatagaactattttatgagaaatttttaattctttagttctgtactacagtaattggtatttcctagctctttctcatccactgtaaacagactacaatctaaagagataagcagagaaaaaaatgaggctgttttcaagactaatattatctttttctcacagaaaaccaagttctgtttcatctttggagggtagaattcaccacaaaattaggtcagcaaagcaaacaaaatgtctcatctgcaattgtttcattttctactctttaaagatagcgattagattttataaaattcatgtagaaaaataataaacttgtgcgataaacaggaagaaaaccttagggccaaagagtgagataattgttcatttaggcaggttttgagtcatccagttgggctatactggttttaaagacttggaacacagataatatgtaatttatcaagtccagaatttattttgaacttcctcatccagacagaaatttactgctacttaagactcctatatatatgtgtttttttctctattagaatggcatcctgggacccactcaatcttttctgaattaaggaaatatagggaggaaaaaatcgttgggaaacatttacttcaagtttagcttttcaaatgcatctgtgtttccaagcaactaataaaatgtacatcatttaataggagagctagtctgtcaaagtaaaatctatctgggcagggcatgctggctcatgcctgtaatcccagcactttgggaggccgaggtgggcggatcctttgagcccaggagttcaagaccagcctgggcaacaggctaaaggtgaaaccccctctctacaaaaaatacaaaaaattatctgggaatggtggcacgtgcccatagtcccagctacccaggagggtgaggcaggaggatcgcttgagcctgggaggtggaggttgcagtgagctaagattgtgccactgcactccagcctgggagacagagcatgattctgtctcaaaaaaaaaaaaaaaaatctatctagacacaggtttctatctagacacatggctctgtctcaaaaaaaaaaaatctacctagacatgggtttcatatctctttttttgttgttgttttttttgacatagggtctcattctgtcactcaggctggaatgcagtggcacaatcacagctcaatgcagcctcaacctcctgggctcaagtgatcctcccatctcagcctctcaagtagctgggactacaggcaggcaccaccatacctggctaatttttgcattttttgtagagacgggcggggtttcgccatgttgcccaggttggtctcaaactcctggactcaaggaattctcctgcctcagcctcccaaagtgctgggattacaggtgtgagccaccacgtcgggcctagacccgggtttcatatcttaacagaccaccatgtgcacagagaactctaaactcactaatgaaaactgcctttgacttcatctcagttattcatgtgcgtttttcttctttaaggaaaactgtaagccttttttggaaaaaaaaaatcatgtacaagactcaattcggttgataaccatctgacctcataatgaaaatctgtgcaaaaataaggaacaaaaacaagtaaagtaaatgtttggactatacccagcaactttaacaggactcccaaatggtgtgactccacaaacaggctcagttctatctgccaagtgaggtaaaccatcaacagacaatgtaggaaacttcttggagcccgtataatcactttttgcttacttactcactcaccagtctaacccatgtcacatgaatcagcatctctaataggagaggagactcattttcagcaagcacaaacaaaaacaggctagttcacaaggactgaagtttgtggaatgggggaaaagaaaaaaagaacctttattagttagtttcatatattccattttaaaagactgttcagaagaaggaatagacttcttttcaggaatatctgaaaaaagaaactactgggaattcctccacactaaggcaatgaacatgcacttgtggatctatctctagctcccacagagggggctcctcatcctcatggaaccaaacaaagaagtccttaagcgggagccagtgtgggctttgaataaaacacgctgcattgcttcaaacagccagaaataggaagacaaaggataactgcacttaaagtgcctttaaaacaatattcacttaaaattcaactatactatccataatgcataaagctgtatcaggaaaatatagcttaacaatcaaagtcataggctttcagcatactgaaaactctacgacccttgccctacattcctgcttctccaagttttagtgaacactgaaaataagtttaaaaacctaccacattaagaaattggcactgattaaattttctaacaaaactggcatgaggctatgcaaaaattaggaaaaactcagcaaaagtgaaaaataaataacttccaaattctaaaatataactttagactaggatttttttgtccctgaaaatatataaagtttcatgctgtatgaactaactgtaaaattccacttaagcattattggggaaaatcaactgatacactctttcaattcctttattttaaagatctcttagtactttcttgtcatattaaaaataagtctaaactttttgaaacagatatctttgctattgagatttattacacacctaataacatgcatttatatatctaattttaaatgtacaatacaaacaaatatgcaagttcgtttcctagcctctaagaagttccagtctagcctagaaaggacatgggtgtggaacacatatacatatagattataaattaaacctttacgtcataaaagtctacaaatatcaacaggcctcatggggtaatcaattcatttatcataaatgtctggtacatcatctacttttctcctccactgtgcctctaatctctccgttcttttaatgtatcgttttacttcttctttctcctcttccagtgttagttacaactgtgaggctatctgcatttcagaagtagatagaagaatgctacagtgtcctgagcagaattcatttccaaatgagaagtgaaataacccaagttaattcacgttttacagttgttaagtccagagtgctaacctgcaagcatagattacttcagtggacaaatgtgatacaagaggaacagaaaacaccttacattgatatagtgctttgtagttcacggttcttttcgcatattatctcaattgaatctcccaacaatcctgtgagatacagagggacatactactatccccacaggatcatgatcagaggacgctgagagattaagaaatctcaactggcccggcatggtgactcatgcctgtaatcccagcactttgggaggccaaggagggcagatcacttaaggtcaggagctcaagaccagtctggccaacatggtgaaaccccatctctaataaaaatacaaaaactaggccaggcgtgctggtgcatgcctgtagtcccagctacttgggaggctaagggaggagaccggcttgaacccaggaggcggagggtgcggagagccaagactgcgccagtgcactccagcctgggtgacagggcaagactccggctcaaaaaaaaaaaaaaaaaaaaagaaatctcaacaaggtcgctcagccagaaacacaactagaacctgaggctgaaaagattgcatccagagctacagagcagttttttcttcgtctctgtgatccactgtctaacttcttcgaaaggtaagaaaggaaaaagaaacaaccaattgattctgcacataaaaaatgtatttatgtgagtaaaaatgtagttactataattcctcaagaagaattcccttgaagatgcttaaactgttagggaaaaaaaaccttcattatctttccaaatatgtggcttttaaaataatgctcaagtataaaagttacattactcttccaatttacagatgattttccttttccatttagcattgtaattctccgcgcagttctagtaacatactagtaacatggtaagaaaattaatttcaggaagacaggcaatgtaagtattacactaagccacaaagaatgtgtgaggtaataacacctcatagtcatggacatgttcactcaggctccttggtgtggtgagctctgagtacaggtcatgttatttgcccttgaggaaggaagtgacacagaccagttttcactaggccaccttcttgccctggaggcttcagttagcagctgatgatttcccaatttccagcccacgtctgtggcaggaaaagtccataccctggggttctacatcaactgatttcccccttccaatgcccagatatttcagcaagcccaacctgttcaaaaccaaaccatcacctccccctcaaaccaaattcaaccttcttccactttcccacctcaatgaatagttcccacctcaatgaatagatcccacagtcaaaagtcaaaagcctgggcagaaaccttaatttatccttctccctcatctaccacatccaactgactaccaagttttgaaataaaaaatacttttggagagccccaagaccgtgcaccaccgtaacacaggtagttacaagatgccatcttacaagatgccaactaaaagtaacagctcacatttcttcagcccttactttgggccaagcactgttctaagctttgcgtaggaatgaatttaatccacacaataatttgaggttggtaagcatctcatccttgttttacaaatgaggaagcagctacagaaaactttagtatctctcacaaggaacacagtgaagcccaaggtcttaacactgttctgaacactctcacacttctgtgtccttgcatgtgcttttcttctctgtttggaaggccctttcaaccttgtctgcctagctccaaagatcagcataggcatgttcttctctataaagccttctgatgccccctgctgttgctcttccctctaagtcagtagatctcaaggctggctgcttgctccaaaaactagatgcctaatcctacccctagagattcttgatgtcattggtataggttctagactgggcatcgggacttttaaaagctccccaggtggctctaacatgcagtcaaggttgagacccactgcatcgttaacggacctttaatgtctgtgctggtaagtgcattgtgagcttctgaaatgaaagtttcataatcaccttggggggctttttcaaaactagcagttcctggacgccaactaaaaagtcagtcagaaccatgcgcaggggcttggaaactgtctccttgaataattctgatttgtggccagatttgggacctctctcctagataagaactgggtcttttcacttgtacccaccagggtccagcatgatgcccagcccatagttggactaggataaaatctgtgtaatgaaggaaatctaataacgtgaatctgggtatatgtatccaatattcaaacttcctgcagcagcacaaggaaaagctgcttcctacaatggaatgcaaatactgggcagcttttcaaatgtgttttttaatccaccaatgccccctagtgacctgaagatgaataactatatcaaaacatcgcagtatatattttaagtacaatgtgtacttaatatgcacataactagtcagacacactgcacttttactaccattgtacttttactaccaacacctatactattaactcctttgccctccagttctagttaacccaagctgttaactcccaaaccccgatcaatcctaccgtttactccatccccactctgcacaaacatacaggagtgctctcagcagagccctcaaagggtctggcctatctttttgttccttggtcagtgcctctcccaaatcccaccatgttcataagaccatccatctcgaaaacacaagaaccattcatctaccgattggcttcaattcttgctagtcaaaggggaccaacgaaaactatagaactagttaaaaaatggagaatctggccgggtgcggcggctcacgtctgtaatcccagcactttgggaggctgaggcgggtggatcacaaggtcaggagtttgagaccagcctggccagcatggtgaagccccgtctctactaaagatacaaaaaattagctgggcatggtggcgcgcacctgtcaatcccagctactcaggaggctgaggcagaggaattgcttgagcccgggaggcggaggttgcagtgagcagaaactgcgccactgtactcaagcctgcgtgatagagcgagactccatctagaaaaaaaaaaaaaaatggagcatttgaggccgcatcccagacctactgaattggaatccattttaacaagagtcacatgcccattaaagtttgacaagcactggttctcaactactagacctaacatcaccattttatgacaaatattttctgacactcttctggtatcctgaaataaaattcatcactaagttacatgcataagtccaaaaagtaaatcagtatactctgatggtagcataaaggtgaataaaaaggaaagatttatgtgaattatatttcagtatgtaaatgttcaacacaactaaagacataaagaacaaccccattttcagttataatttttgcaaagttaaaaacgaaaaaagaaaaaaagaacaaccccacaagtttccaaaacataccattctgttgagtcgtaccattctatggagaaccactggtctacaatctctcgcacctttcttttccttccatctctcgggtgggaatatctctcccttgcacagctgaggtattctctctagaatcttgactgaacatatccttctagttaccaaattctctctccttcccttgatagtcaagcttatcaaccatcatagtgtccacttacttggccctcagtcaccaacccaggttaatctacccttcacttccatcagtaaacctaaagtataaggatcatgaaagctttccaaagtgcccaaatcagtgaacacgactcatgatatgtaactaactcatatctcatctagcttatatctccgtcatggacattgttggttgcatatccagtctctattctccctcttccttcctaaaagaactccattgtgttcatgaatgcattcctctcccctgtgattaagtgacgccaccctgggttgatcctgtttagtctaagccaatcagatcatggcattcctctgacaactgttacagggtcagacaactgacctaagttggtccaatcagactgaaggaccaagtgtgggagttttttctctctcctcctcctcttgctctagagaatgagaaagtgtgtatgttactagtagtcatcttgcaaccctaaaggaaaccaacctgactgtggaaacccaagaagagatgggtccttgatgacactggttttttttttttttttttttttgggacggagtctcgctgtctcccaggctggagttcagtggtgcgatctcagctcactgcaacctccgcctcccgggttcttgccattctcctgcctcagcctcccgagtagctgagactacaggcacccgccaacacacccggctaattttttgtatttttagtagagacagggtttcaccatgttagccaggatggtctcgatctcctgacctcgtgatccgcccgcctcggcctcccgaagtgctgggattacaggcgtgagccaccgtgcctggcctgacactgttgaccaactgaatcagagcctggaatccattcttcctctggactttgtgagagaattttccttactatttaagcagttgggttttcccagctgaaagcatcctaacatagccatttctccttgaaacttttctccctcgattttctaaacatcactcttttctgctcctacttctgcttctcaagtctggcctccccctttcctctgcctactcctacattttggtgtcctccaaggtttgttgtgatcttttctacccaaagtacatgttcacctgaaataatctcagttcagtcgggcgcggtgggtcacacctgtaatcccagcactttgggaggccaaggcgggcgaatcacgaggtcaggagttcgagaccagcctggccaacacatggtgaaactccgtctttattaaaaatacaaaaaaattagccaggcgtggtggcgggcgcctgtaatcctagctactcagaggctgaggcaggagaatcacttgaacccaggaggcggaggctgcagtgagccaagatcgcaccactgcactccagcccggacaacagggccagactctgtctgaaaaaaataataatgataacaataataataataataataatctcagctcactatgtctttcccttgacacatcaaaactgagcttccagcacttcccccaatggaataccactgatgttccccaccccttttacctgaagaactcctacctgtctcaaaactaaatttaagtgtcccgtctgtgaagccttctctgaagtccccaggggttccttacctttttttctgccgtggacctctttggccgtcagtgagtcctatagactccttctcaaaataatgcttctaattgcatacaaaaaagtcccaactatattgaaataatcttattttttaaactcaaatatctgatataagcagtatgtgcttctttactagcccactaaacaaaaagatctagcagtgagtcttataactaccatagttctgaagtagtaatgagcataagtgatattttgacatctgcaacaactgtaatgtaatatgaaaatgtctgtgacttgtgctggtactgtgacttctactggtaacaggtactgctaatactactgtgatttgttacagtaggaacttgtaaaatgaatggcccccagcgaagtgcaccaactcatatctatgaccttgtgtggttccccaccatatcaactctggacttggctacgtgacttgttttgacatcagcaaacatgatgctgtgtttgtgccttgggacttgccctcttggaagtcagtaaccaagtgaggaagtccaacctaggcacatggaggggcaccaagcccccagacatgggagtgaagccaactttcagtcaagtcaccagcagaactgcccagccaacccagattttgagaaacaattcttgttttaaggcactggtttgcagtgatttgttacccaacaatagataactgagacattacccatatgcgtaactaaaggaagtgctcaattccaattggagattgctaaaaatagttatgttttttccccatcaaagttcagggatcctctgaaatctatgtgcagatcctttgaggagctgagggccccaggttaggaacccctggttaagccaagtggatcctgctctcctttttactactttactacactgttggtacacatatagttaaactggccacagcatatctttccttgttgtaaccctgaaatggagctgagctcctagcacataacaggtgtttaacacacaaatttatcaaatgaatgttgattataggatctgtcttcctgactaaactgtgagctgcctgaaaacagagtaagagcaaatactaggccttttccaagtgctttacacataccaacttactccttataacaaccctatgaggtagatgttattaccccaacttcaccaaaggaagataggcacagtgacttgcccaaggtcacacagctagaaagtggcaatgccaggactagaaggcagaatgcatgttctgattttacagcctttattaacgtacccaaagcacattgcagagctcaataaaacttttaaatgaatagtacaattctgagatttcattagcactattttatgggtactatgcttcttgaagactcaattttgtagattaatttctggtagcctgtgattttttatgacaaaatacatataatttactttttaaaaagtagaataatggctttatgctaaagtgcagattttcgaaattaagtcttcatcgtaaaagtcgatttttttccaaaggacacgagttcacaaaacgcagggaagggggtccactggcccgtattaaataatgttccctgaggagtggagcaaagctccagcttccctcgtcacccagccatcccaccccagcctcccccataccctgcacagcttctcctaaaatgaccctcccccatccacacatcaggttctgaaacctgaccctgccaggcaactaaagccgcgaaccccacagtgccctgagctggcctcaccctacccacgatcccaagagggtactagccgaggggatgggtactttgggggaaggcactttaaattttcaaagtgtttaattcacgaaagcacaacccaaagggccgcccccacccacccgggggtctcccgcctccgcccggcagccgctcatccccagtagaccagtgaatgaaccgcggggccgggacgcagccggcccagtggcgggaaaagcctcggggtgagccaggcctggctgcagagaggccccaagagagcgcggggagggctcgggcggccgggagggggcggtgacagctgtgactcgactccacgctctcaccttgaacatgtcgctggcagcggaggctccggcagggtcaccccggcctcggccacgcccactatagagaggtgactacggaggcccggtagggccttgatttctccaaccgcaagcaggcagcggtgcgggtgacggccgtactgcaaactcggtgcggcgaaggtttagttcaatcacccggttctagaagccgcgtcgctgagccgcagcgcgtcgcgcccgggcagcgggtgaacgcaaaccc

SEQ ID NO: 2725 - DNA, 74594 bp, Homo sapiens; identical to SEQ ID NO: 2724

SEQ ID NO: 2726 - DNA, 1293028 bp, Homo sapiens; identical to SEQ ID NO: 1858

SEQ ID NO: 2727 - DNA, 2009201 bp, Homo sapiens; identical to SEQ ID NO: 1859

SEQ ID NO: 2728 - DNA, 1293028 bp, Homo sapiens; identical to SEQ ID NO: 1858

SEQ ID NO: 2729 - DNA, 2220383 bp, Homo sapiens; identical to SEQ ID NO: 1861

SEQ ID NO: 2730 - DNA, 1900974 bp, Homo sapiens; identical to SEQ ID NO: 1862

SEQ ID NO: 2731 - DNA, 1036243 bp, Homo sapiens
tgtaacataactgcgtgctttattgagatacacagtaaagcagtactataatacaatagtaaggcatatatttggtgaagtctgatatgttgtgaaaatgcagtaaaactgaagtttaaaaaaataattcgtaaatgttacagtgttggtgttaaaacacaatatattatgatactcaagtaagaactcagtacctgaaaacaatgacaaaacatgccatgtgatgtttatgcttcagttacattatgatttacagtttaatacttggtggttataaagaacacaacacgaaataatgtccaaattaattatgcttaaaatgcagcaataaagctctcaatttttgttcaaatattatgacagactcactccagagctaatgtgtctaaaagaaaaacaaaaagattaaaacaaaattatttatgcactctatttacctctgattttagaatgaaacttacttacttaaacttcttagtaggatgtaaagtaaccccttgttttaaatctgagttttaaaaatccttgggtaaagaaaaggtccagcgtcacataaaggaaaaaaatgcaagacaaaaaccaaatcttcatgtaatttggtaatttgttaccttagagctttgggttttcttttgaaaattatgaaggaaaaagaaagaattataaaggaaaaagaaaataacgcaatggacaagtggtgaagctgtgaactcaggtgtgcacaattatcaggaacaccccaaaaccaaagtgaggtagaaatagcatgagaagccgtgtttgatgttaattaattaattattaataatggacaaaacccactctccaaaagctaattacacttgatgtcagcccactctccaaaagctaattacacttgatgtcagaggtaacagatttgcaaaattataggtcacacggtggtatctattgaatgaatgatttaaaaatcaaaaagaaataaaatggcatgaaagagtaaagctttttcctaccagtccttagcttttcctcttgagcttttctcctcttttttgagcaatttttgtttgtttgtttatatatttaacctgtctaatccaccaagaagggtttttttgtaacatttgaatcaatttgccttctttcttacttacttacaaacctgtgtggaactactcgcagagaaatgcaaaggatggaaacacagttcatgggcttctgggttgatacctgtcagtatcacaaatgtgatggggctactgttttacaccttttcccaaagtttatttattttaaattatgtcttgtggcatttaaaaactcatcccacatgggacaataaatctaaaaaagcaacaaaaaccaaaccacccagttccttttgactgtgagaagagggcataataatttagttgtaattacagagaactttatgtattatgaacaatcatccaatccttcacttaaagagtggcctactccttcacagggatgggctgggaatccatagccctccagccctatcatcgtcctgctactgcttgggagttaaaaaataccttctgatgttcacaaggtcagaataccttctgattgatttccactgaagcatcattaaatctaaatcgtggcattgctagcagcaggaagctgaatgtatcaatcaatcaatcaatcaaccaaccaaccgattactcactctgatataataagtcctgtgtattcattcacatgttccctttaaaaaaatccaatactttactttactttcgttgtcagtggaaagttgtttaaaatgagaaacatctggagctgtagacaatgttttagtgtggtgtagtttcctcctggcttccggctccgggaaaaatccattctagaccaagcaggtaagcctggatgactgactagaagtaatttctttctattaggatgtgacatgaacatttaaaaaatggaaaaagtcagtctatagaaattcgtatctctttatctatataactatagtatttatatacttatagacatatagatatatgaaatgaaaactcaagcctgccccactcagctgacagttctcaaatgagcagtgtgtagtagtcatttggtgtggtggtagaggaagtcttatctttaatatgcaaaaaaagaaaaagccatgaatttcatatggatatcacgccaaaaggatgcaaaacaatgcgctgcctcaaagttttgtgtgtgtgtgtgtatgtgtgtgtgtgtgtgtttgttttgtttttaggggtttttataaacaacttttttttataaagcacactttagtttacaatctttctttataactgttataaatttttaaacaacccaaaatgcgttccatataaagaaatggcaagttatttagctatcaagattttacatgtagttttcttataacttttttgtacaattgcatagacgtgtaaaacctgccattgttaacaaaacaataacagacttagaaactactgaaatctacagtataataccactacccttcacaaaaatatagatttatttcttgtaaactcttactgtctaatcctctttgttgtatgaatattataaaaaccatgcgggaatcaggagttgtaaaacatttattctgctccttcttcatctgtcatgactgatactaaggactccatcgctctgcccaaatcatctgccatgtggaaaagacttcctacattgtgtcctggaaaacaaagagaaagaaagacagactttacaaaaggtgcagatagatagcatcactctgtttctttgccatttgggaaatcattccccatttctgggtgaagacaacacagaagctgcatcgagggtgtacacaacaaggtttgatttttcaccagtttccaggaagaagcaaagccttattaatgaagccattacacgttgtttgttagtatcagcttaatgttggatcaggctactggtgtttacatggaaaaatgtcaagctacattcaggttcccaatgtaaatatatatcaaaagaattccatagataagcacaagatttctatcagaacaggaatattccatgatgggatacatcttttccaccttggctatgagtgattgattgattacttactctctacttgtattaacgaacattttttttactatcaatcaaaccaccatcaccaccttcacaactaccactaccatcaccagcacccaaccatcgtcaccattatcactgccaccatcaccgccacaccaacttttcatttcaaagctgtttcaggctgttggcttgcttctgaggctatggtggaggtggctattttctctctgcttttacttgggttgaaaaataataataataaactcttgaattgaccttttggtgcactattaacatttgaattaggaaacctcagaataaaaattgctttacattccaaattactctagaccctaattataaggtgacccacatgtattgtatgcatttgggtattttgtgaatccatcttagagctcctcctaaatgagggttaactatcacaatagccttttactaataatgcagcacgacctagcacgaatctcccagcacggagaaaaagaacagcacaatgtccctgggtacttcgtagcaaaattcagatttagagtaagataatctgagacttactttatggcttgccttttcgtctatgtcccatagttttacatggctaattttaattattgcacattggtaaatccttccactattcaagtattgtctttggaactgaaatgctttactaggctattactaccttgccatgtatcaactttacagattcccataataattgttaaaaataccaataaaaattaaagatatcccaataaaaattaaagctatagactagggagagtattttgttttaatatttatttcaagagatatagcttctctacaaaatgaagcggattcacgggcaggcacttaaacagtgatggcaccagatcaactgaagacttacttattaaaagtttaatgtcattcaggcatttctattaaggtgaccaagtttgtatatctatctttttgtgctttattagtgcaaagaatttcatggagtattaattatattttagaaaatcactttggattttggctgagactgcaagtataaaaattttttaacaaagcatatgcaactattcataaagtgggccaatagtttggcagccctcagtgaagaactgaaatcatttttggctttctgtgccataaaaaccacaggaagacgacacagtggggcctttgctgctccttagagctcagagtacaaatatataactgctgctatcaagttggagggcttcccctgtatctatttttggctgtccagcaaccctgggaaatctgcataattattcatgcataaattgaagatagatggactaactgccaatttttaattactagcgatctttacggttaacaaaatcagtaaaaacaaagtccaggacctttacaacatggtgcctgaatgtaattcgaagtatttctcatggcccacatgtgactatagtatgtagtccacctagtagctagaaaacatattacaaaacatcaacgaaaaggggagaaaactcattttttttcctgtcagcttatcgataatcacaaagtgtctttctttttaggctgtgtgctaggggatgtagatggcagttcaaaatataataaaacaaataaatgcatttatggattatatagccaagtggtgcttctcttccttgaaatggtgttcagttactaactggaaggaaaattcttgagtctctcaagaagcataagttctaggggtatctgctatttaaagatttgccagggaaaacaggttcattattcttaatgtgccatgcacactccgacaaaaagttgggtggcctttaaccggtttacactgctgcattttcacaaatgaccttgtggccatctttgtgctataaaaataaagaacttttagagtcacctcatcatctatattatgcctttggttacttcactaaatacctgctttaccagaataaataattctaatttctttccatggagtttttcattagatccagaaaaaagaagtcaatctctttttacaaactactgccctaaagaatcatactttaatccgttggaggggtaagactgcactgtgacatgactatagaaagtagatttgtatcctagttctattatccatgtgtgtaaggcagagcattcgggaggtcattaatgttacctgacagatttttctaaagtcaaaattacaatctcatactatgaagtatgagaggtactgaaaagcagccaggattcaggcatttgcaatcaccttcaggcacaaggtgacagaaaactatgtctatagaaagtattgatttaatccattcttaaggattattgaacacaaaggcactatgccttgaacattagggcagttgtatgtttttcaagttggcgctaactgcaacacatttagtctcacacgtcaccactgcctgagggaattgttttccacagcgattggaattgagactttctggcaaagatccaagacctcaatagcaatctggtgctctattttttaaaaatacaattcccaaataaattgttagcattcagttgtccaaaggaaagccggaatactacagggaaatttgcttatcttttcttctctataatttaatctctgaaaaaaatctgctttacgtacatttgggatattttcatagcattaaaaaaggtcattattgttttgattctttggcttctggaaacttgtctgaacaccatacacctcaggtagtcaagtctgcaaatgcctatataacttcaattacatgtgctagccttttctgaaattcatttgtgagtgaaacatgtttaaggtggtcaaaattatggtgcatttttctacaaaaagttaaaatgaataaattttaaggggcacttaccataagaatgaacccaagaagtctcacatacgaagtacatgaaccaggcaaaccgtcaggggcattcaatgcttcaccaagtcaggtttcctcaatttctcctcccagcctaccattccctccctggccccactgcccaaagccttggaaggaggcactggcacagacacactgaagaatcattaaattgattagacttgtatggcatgatgttggcagagttttcattacgactcctgtgtttaaatgaatcagtggtctctccagtccatcctgttgctaaggaatccagaatcttctcatttaagaaggactctccacccatccagcctgtctcccagaacactgtcatcccatgggagagctttccttctctcctccttcagattaaattcttggtaaagacaaccttgattttacttgggctgtcagttaacactttgtcatccaacagtcacttaattaggtaattcgatattcagacaatattcctggtggaataggagtaagaagcatctttcaccgtaaaacctgaaaccacattcagtgataagactgcaccctatccctttcaacccataaataggcattttaaaaacctctcaaaactccaatatttaattttttaatcgaattggttattgttctgtgtggcttcaaataccaaataaaaaagatcatcttctgaagggtacgttgagatgatgtaagcctttcaaatgagagttaagagtgtgggtctggagccagactgcctggatccaaatccttggctctgtcacctgggacacactgcttactctctcattgactcagtctccttatctgtaaaacggggttaataagagtacctacctcacaggtttgtcatgaagatgacatgatgaaaaagatggcaagtgctgagaacaatgcttggcacacagtaagtgctcaaaaaatgttcgctaaaatgggagagaaagagcgtaggaaccaagaaaaaaggaaacaaaagcaaaatgaagtcatcccagaagaataaaaactaagggcgctggcagaaaatgctaaggtcctggaagtggaagaaagctttatgactcatcagttatgttcaaggctaaatttattttgaagattttgttagtgttgcaaatggcaacagatgatgaacggcaggattccaacctagggactacaaaggattgccattttaaagagattcttgctcccaaccccagtcttgtcgtcatggtgatgacaacggcaatgaacatttgaggaatgttcctcatgagctgcaagtggagaggtgactaccatccttacatgatgacacaatgtgtaatacacacatgcgcgtgcacacacacaattcttacacaaacgccaaacataaaaagcaggatgagacagacagaagccatggccgtgagcctgaatctcactaacctctctcattggctttccaggggtatttcttcctttaataatagagagaggaagaggcagagatatcagaaagggaaaaaaaacatgcataaatatacaatttcataccaatttgcttcttttaccaaacaaatgttgagatgaccatttattctctgctggaaaaaaaaaaaaaaaaaaaaacagaaacaaaaaacccaaaagacacatctagtcaaataacctttacatacacttaagatcagtgtaaacagataacatgatccagaagacgtcatttgtaaaatccatagagttcacgcattaaactggatgaaaactggcacagaatagaaatctgacaaattgggcattgttttcaaggacaactcaaacttaatgttaaaaaaagtctcagaatctcttcactcttgacaatcagcacattgaaacataaacagtagttgactctgtgtgcccaaagtctgcacatcaaatgcaaggtagaacccgacatagaggctggactccatcctcttgggagaatttgttctatctgatagaagctgagcatttccatgatgaaattggaggcatttgagaaaacagaaagaacagatgaggggaagaggtaagtcccagtaatgggcaagccacagagccagatccaggaatgagctttccacttcctccccaattcagcaaatatcaggagccttacgaggcaatggctaaagacccactggccttgattcatagattcctacatctgtatgcatttatttgtatttcaaaagtagactctgatgagaaagtgttctatgataagtcataattggacagaaaagtagggacttctgtccatacatgtcaatagcctgtcttgggcatgcaatttcctttaaaatcttggttttcaaactgttttaactatagcaatgggacatctcctaaaacaatcttatatggaattccaatattttgagcagttcaaagcagagctgtgagagatcctgtacagcatctccctttcccctccacccatcattctcagtggctccaagaagactaaaaactccctgaaacaatttgagaactactagtctggaatgaagaggtatggagctacgacaccaatagaaacctttcaaaactcactcaaggttagggttcaaaacttctagtatacatttaaggatagtttctaagtttttcttccctctctccttctctttcttccctccctttctccttctctcccttcctctcttccttctgaatttcctacatgactcagcgatttcttaggagtatcagattttcagcttgaccacgtaagggccaggtatttaagatgctcctcaagccagggaaaagagggagaaaaatgggtactagctcctcagctgtgggtgtcactagtgggagatccataccaaatgatgttcccatcatttggggaggagaacatcattctttccttgatggctgaaatcccagtatgaatcactcaccccttctttttgattcctttagcaaggtttttttaaaaaagtatctttatgtttcataatactgtctggtggcagaattaattcccttcccctgtaagactataagcctcttgaggacggggtccacatgttgctcatccacctctctatgcccaatgccctgtaccgtatatacacacttttggtatttgataaatactggctgaagtgaattggtaaagtagtagttgggtcatgaccaagaggagtccttctgtgttataagtaacttgcccttcactggcacactttagtttggatgccaaaggtgggtaacttgtttcggcatgtaactttggtctagttttgaaaacttgagatctttaggaaggacagtgttgttagaaagccatgtgatttagaatgtaattatggttatgtacttcagaatgtaacgatgattctttgaatgcttaatgatacatatctttagtaattctacactaagccatattcagaactcagttatcaattgattatttcttaatatgtagcagcaaatgacttgtgttatgttccagatccttcttcagaaaccatattttatgaaaatggacctcccagagccaagctaactctaatctcttctaaaatcctccctcatcacttgggtccccacgtactcattaacacattacaaaaggaaggtcctttttttcactttagaaaaagttaaaaacaaatgatattttctactgtaaaaggactagttctacgctgacaaaacagaggctacttgattacaacatttttaaaagttcttgaccgataaataaagtttcagatatgtttcattttctaaacatttatttttttttggaaatgagtttctgtagaccttcagttacagtgtccatctggcaatgtgatgtgttgtcaggaaatgaatcaagacaaaagggaagtgtgctggggcagtcctgagtctaaataaagggcttggtcaggtcccgagaagtctaatttcctcgggcactataaaattgacattattgattgtaattcattattttagagttggaattgcaggacagtactgtttctgggtgcttttagcctcttttatattaattcactgactatttaaaatacttaaggaagaataagtccctttttaggatttctgttattttataagtcaaaaaaattcaaatggccacacttgcaggctctttggtgaatatgaatataaatctataaatcaattcaatttcagctcaataatcttgttcagctgaaagttgatcagcacagaagcctgtgactctatacatgtaatgagtcagaatggacaacgaaataatagcgtaaagcagggattggcaaattttccccataaagggccagatagtaaatatttcaggctttgcaagcccacggtctctggaccagctattcagcactgctgcaactactctgccctggtaatgagaaagcaactataggcaacatgtaaatgaatgggtatggctgtgttccaataaagctttataaaaacaggtattgggccagatttggcatttgggctgtatgtagtttgctagtcctggattaaagggataaccgctcaaatcctttgtgggagcatacaggaaacagaatggtgcctgaaaaagggcacaccatatttctatctgcctttgttctttatgttgctcttccataaaagaaccacagaataagattttaattttaaaagacggtaggttttacaaagctgttgggttggtaatttaggggtatttgatagaatgtacgcgggcttatttgagaggggatggtatgaaaaaaagaggatggcatgggctggtggagataatgtggcacaggtcagtaggcaagagattgtacaggtagcagaaatagtagcactgctaactgctttctggattgttttactgcattaagagcttatcttggctcctattattcattcatctatataaagtggtaccacattttagagagcctaataccatactactgactaggagagcgtttctttcatcaatgcacatacatataaaaatatctttgttagtctgctaaatgatcagagacttatggacaaatcacttaatggggttattttttaaattacgtttgtttattgtacccatgtagttttcctatagaatggcagagctttagagagtaccttatagtaaagtagataatgacttattacactataattcaatttctacacatatacttacaaaggaagagattagagatagacagattagatagaaattggctaatattcagtgttcaaatatacactgagccactcaaatctcccaagtgtttgtgaacaactaagtatatctagagaccaaccagaaagatataatcacaaagctgaatgtttacacattcatatcttgaatatgctcctgcttatattgcctattatgcaggatagtgttggccatcggtttatcactaaatggagaagcatgccactcatttattaattttgataacagtttagcaaagccattaagataagattagaagcctaacttaacctgctgaatggccataaataaggcacttgacttttcttggcttccaggtactctttgtgaaaataaaagataaagaaaggttagctgacaccttcaggaccaactctgtggcaaggggcaacagaaaagttgtaaatttgaggtacataatagcttacctatctatatactttatgtttatgaagagcataagttttttaaaaacggcttttcctctgtgggcaattatctagcagggttaagtaaaccacgcggtggtatttaatagcacatttccactaaatgtcagacctctggctctcacatctgttttgagttactcaaacagctgtccaaaacagctgtagcaatcatgaactttgttttttgtaacacaacaatgagaacatggatggtagtgttagaataaaactataaaggtctctgagacattagcaacgtcttggcagaaacttccacggcaaaaatctcaaaatttaaatttttttgaaagataattcaaccaggcaagaaaaactgagatcacatagattagtatttttaaaccactggttcagaaaatccatttagtgggttgcaaccagcattttgtttttaaataaataaaatagaaaaacagcatgcactgtatgtagtatggaaggcatcacttgatgaaacttttgtttctgatctttgtatgcatatgacactgtaaatgtgtgtgtgtacatatggtgggtgtatatatacatgtgtgtacataaacacatgtacaatttattttatatctttaccccagtttgtgatgtaaaatgttcctctgatatggataaccatcaaaacagagtcagaaatcactgtcctggatgtcaaaagtgttaaaatgacctttcaaggctcttccatttgaaagactttgtaatcccaagatgttaagattctcaagaatttctgcttaatatcagctgaacacatctaccaactggtaagatgttcccgccaaacttgacggtatatgtgtgtgtacacacacatatgccatttttcaaaattaaaaaacaaaagtgcttttagttggaaagaaagcatccaaaaaccacttttttgagtgcatcaataattagcctaatttttacaataatgaaactttttatccacttgaatttggggagaaaaaggcctgtaagaaagcctgagttagctgaaagtagcaaaacgtgaggaaatgccaagatcatggtattacagaatgataggccagattttccaataccttagctactctcttgtgttttttgtgtatttaattgttttgttttttaagaatgtgaatttattttctcaggccacaagggtaccactgagtaagccggaacttaagttaatggaattggtatcggacaaggcttccttctcccacatttgagaacttaaatcagcccttaaggcctgaaattcttccgtaagcactaatttagtaaacactatccaggtggcctgaattgagtttcccaagtttccatacaagtaagtaaatcaacatcagagatactgactgctaaataccatatcagaggaggtatatttcttgtcttccaggaagcttctacacccatgtggtatctagctttaaggactctaaaagcgggacacagggagatggtgcaaaggatttcaccttacagctaattagggtggaccagaaactcaggtacaaaaaggagtctaggaagtcaaggctgcctatgaagaagcagagtcatgagccttgctgtagcttcttctctactaacctcttgtttagatgtggaagaaatgcccagggtgccaacagggcagccagcaactttccagagcaggtaagcaagctgccagttcaaggggccaggatcatacagtaatcaatgattgtactgtgatttgaatttctttggagttctgtatctgcaattgaccataagtaccttgaaggcaaggaatttgtcatttcttctttccatccctactacctccactggtacgtagtaggtgctagtaaaagcaagcaggacaaagtaatgaggagacacgtgaaagcacctgattctgtcaagcctgtgtatgatcttctcattatgaattatgacatctagaagaaggagatacctaagatagtcagaatggggatgcgggtggcggtgggggatgtggaggtgggtggaagacagataagatttttatctgttaaaatcatcacttcagtggcgctcagcagtgaaaagatggctggtgcagacatttaaaattagcttcccctgacggttccttagcaacgctctaccagaacattattgcttttaatgtgcactgcacaacgtttacttgcacatcaaatagctaggaaatggccattgttaactgacactgaacaaaaagataggaaaaacacactactcaatacaccctcctcattgcccttatggagaggaacaaacagcccagatttcctgctgcccgtccctcccaggctacccattagaggtgccaatcactggccacaaagccttgtgttttctcccttttgtttctctaggcttttcttctatttgatcacaggtgactgccaccatcctttttattcgttgaaggaaggcgagagagtgactttgttttatgtgagggcaataaaccaaataaatgcccccagaaacgaacagtagcagcaaaacatcatcttggatgaagcaagacatctgaagctcatgcaagccagtgggaaaattctgcagggtaaaatgctgtttttgtatgggggtaaaatacgcaaggccaaagtgatgaagaaaaagaaaaatattaatgtctttctttgctaagcctgtatttcctctatcgaagtaaaaaataaccaactactctatgaagatttaattgtccctatatttaaatgatggagtaagatacaatttttaaatataaagggcatcagatggcaagtcagaatctctaccactaccaatcagtaggcattgttctaggccttgctgtagcacgtagtagccatatgtccctggcaaaggcactatcagggcattaatttcctcatctgtaaaagtcacataataattgctcttcagtaaagggcacctcataattaactcttcagactaatgtgtgaagcaagtaaaatacttgacaaatagagggtggtattcttatttttggaaacatgttgccctcacgggtatttgaattcagagtactctaaaccacaaattcacacttaaaaatcaaatcttttcaccatggacccaaattgccattctgatactgcgtgttggcttccatatggaaaatacacacaccagttgggtagggaagcgagtggcctgatcccagcaaatctgagtcccttctaggtattggagcttacctcttgaactagggaaggagttgttgagttgctccatcacctcctctaaccctgtgcttgtgtcctggggaggactgagaagatcttcctcaccttaataaaagcaaaaacaaataatggaaaattacatttatagaaaacagatattaaagggccatgattacatttttaacaccattataaattcatttcacttgctcataaataacaaagaaaaccctcaagcttaataatgaggaagtaattctttaaagggaagaagaaatccatacagtagtttatctatatcattacccttggagaaaaaaaaactgtatatctttttttttttttttttttgagatggagtcttgctctgtcacccaggctggagtgcagtggcacgatcttggctcactgcaacctccgcctcccaggttcaaacgattcttctgcctcagcctcccgagtagctgggactacaggcatgcgccaacacgtccagctaatttttgtatttttagtagagacagggtttcaccatattggccaggctggtctcgaactcctgacctcatgatctgcccacctcagcctcccaaagtgctgggattacaggcgtgagccaacacgcccagcctactgcgtatctttttaaaagttgactagttacttgaaatgtgccccgcacatagaaatgataaatacatgagataatgaatactctaaataccctgacttgatcattaacacattctgtgtatgcaacaaaatatcaaatgcactccataaatatgtacaaatattatactacagtaaaaaacaggctgggtgcggtcgctcatgcctgtaatcccagccctttgggaagccgaggtgggaggattgtttgctgccaggaatttgagagcagcttgggcaacatagtgagaccctgtctctatttaaaaacaaaaaaacaaaaaaacaaaaaataaatttaaaagttaaaaagaataaaagaaaaagtcaattgaaaaaggtaaaactgacaagctctcttttgtgccccattcacaaatgtgaaactttgttctatgtaataaaataagtattactgcacacttgcagtgctgtctcctcaacacaaaagagtaagaattgaacactttgcagtcacttcatgaaggtaagaagggagttgagacactgaggtctttttttcactctttgttttgacatttaaccaaaaatacaaacgaaactcaagtacctttaaactccaatgtaatagaaataaaaatagtatatatcctatataggtaatgaaatatgaatattctaaaaactgtagatatggcatatattggagagttatggtcctttcctctgttacttgggactactttatcataattatgttttgggttttataaagaagacattacaaacattttgactgtttatgtgaggagagaatgatgatctggaagcaaagaaacctatggatggatgatattcactgggaatggaaatctccttgtagattttgtgaatctgtgtctgtattgtttgttcatgtgttaaagaaatacacttcaaacagcatttgcaagttaaagggaaatttcttaggtgcaaacaaaattaaactttaaaggtcctttgaaactaacttttcataatatacaatcttccaatagtgaaaataacttctattcaagctctgtttgttttgcacattgtcacttccatctaaaacaagaccttgctttagcaagtcaaccataatgaacttaattagggacaacctcaggtttacatctgacttggaactgcttcggaagccagtgactaaatgacttaaatatgcttctcattccctttggtctatgccacttggattttcatgtttgattagaatcctgcatttattcctttttttttttttaacagcagaagctaaaagaatcattgccaatgctaaccattaagacaaaatcatattctaggtggatgtgaggcttcatatttttattagaatggagggataagaacgtaaggtagataaaaagcctcagactacatgagtctcctggtaacataccacaggaaacctctttgcaatattaagtacaggaaatgggtgctgaagaattaaggtcacaaagcagaaaaggaatagttacaaactctctctctcctctttctctctctcttcctcccccctcacacacatgcactatttgcttaagtttatgcctttagaaaaagaagtgaaattcactatttttagtttcatttttcttgcggttttaaactaccattatctggtgaagatgaaatgaatgaaatactaccaagaggatcaagatcctgacaactgcagggctgattacatctctctgtttcattactgatgcaaatttttgcggaactgggaaacatgaggcatttttaatggcagtaagtccacttcagtgacagtatgcctcactgaataaatcagaaccaagagaacatcatgaacgacgctcatgaacatcgatgttaatatttctgacagtttaattacatcatattggagctctaggaactcaattgtactgtgttaaaattcaggtacagttcaatgaagtgactggcattcctgttcctgaattatttcaaagatcaaattataaagtataaacctaatgatgtcagccaagtttatttttccagataaactctctgtgagtctttaatatgagtgtccaagtataatacaaatgtaaaattggcttctttgctttaatggaaaacttttaaggcagtgataattgtatccattcagacatttttttgagtgcctattacattctaggtagtataaaaacaagtagagtataatcttgttttcttcttttctccatattttcatgatttctcaagatggttttaatgcattgctttttttctctttttctttttttttgagatggagtcttgctctgtcacccaggctggagtgcagtggtggaatctcggctagctgcaacctctgccttccgggttcaagtgattctcctgcctcagcctcctgagtagctgggactacaggcgcgtgccaccacgcctggctaattttttatattttttagtagagacagggtttcaccgtgttagccagaatagtctcaatctcctgacctcgtgatccacctgcctcggcctcccaaagtgctgggattacaggcgtgagccaccacgcccaggctcatctctttttaagaatcgaaatcagacatcacatatgtgcatgagtagaagtgaatcaactcattgaaaaatgcttaatgcctaatattttctgtgtcagaatatattgtaaaagttaaaacagctaaatgaaacctgaagttaaagtaataccattgtaatatttgatactaacccagatttttaaaatgccttttaaaaaccacaaaagtttaaaaacagtaagattcatttatttattcaaatatttattaaaatccaactatatatgccaggcactgttcaaatggttgaacagtgcctggcatattgttcactgaagatatagcaataagcaaacaaaccccacccacacactctctctgtgaaactcgcattcataaggaggcacacaggcttaacaagtaaataagtaaactatataggtatcttgagtggtgatgaacactctgaggagagggctagcaagggacaatgagagtcatcagaaagtggagtcttggaagtcctcattgatgagatgcagttgagcaaaagctttaagaactggagggtatgagttgcacaagtatttgagggaaaagtgctccagacagaaggattggcaaatgcaaagactctgagaggagagtgtgactggcttcctcaagcacagcaagaagtctaatgtagataaagcagagtgaacaagagctgggaaaacagtacttccctggcctggggattcggatttggccacataacctgctttggaaaatggaatgtaagcgggcatgacaaaagtagaggcttagaatgtctttgactggttggggttgcccgcttgtgtttatgtgcacaagaagcatatggcccaggtagcttgctagcccaagaaggatgagagacatgttgaacagacctgaacccaaaccacaacttggtgtcaagtccagctgattgccagcaaaagttcagccaaacaacagatgcgtgaatgagaaatatgcaacttgagaattttgtggttatttgttatgcagcaacagctgactgatacactattatgggcatgaaacaagccagatataatatttatggcttgtctaatcatacactatgtagctacaacataataggtgtattaatccattttcacactgctatagagatactacctgagactgggtaatttataaaggaaagaggtttaattgactcacagttccagatgcgtgaggaggcctcaggaggcctcatgattataagtttagaatcatggtggaaggcaaaggggaagcaaggcacctcttacatggcagcaggagagagagagagagagagagagagagagagagagagagagagagagagagagagagagagagaagggggaagtgccacacactttaaaaaccatcagctctcctgagaactcactcactatcacgagaacagcatgggggaaaacttcttcatgatccagtcacctcccatcaggtccctcccctgacacgtggggattacaatttgagatgagatttaggtgggaacacagagccaaaccatattaataggcaacctcaaaatatttctgactctaacaataatacctgtcatcacaagcccctcatcaccaaaaacaaaaacaccttttcacttttttcacttattcaacaagaaaatactgagttccagttgcacactagagacctgcacagcccttatccctacttcacagattcattgcctgctcaaatagcatattgctagtctttgggggattttaaacttagttgatggcaatgctttaacacttaaacttgactctactccaaggtgatttccacaaacatgcataaataatagatgtcagtgtggatgtggtgaaaacagaacacttttacactgctggtgggaatgtaaactaggacaaccactatggaaaacactatggaggctccttaaagaactaaaatgtagaactaccatttgatccagcagtcccactactggatatctacccaaaggaaaggaagtcattatgtgaaaaatatacttgcataccaagattatagcagcgcaattcataattgcagaaatacggaactagcttaaatgcccatcaaccaacgagtggataaagaaaatgcagtatgtacgtggtgtttatatacacacacacacacacacacacacacacacacacgccatggaatattagtcatgaaaggaatgaaataatggcattcacagcaacctggatggagttggagaccattactctaagtaaagtaactcaggaatagacaaccaaacattgtactttctcacttataagtgggagctaagctatgcggatgcaaaggcatgagaatgataccatggactctggggacttggggggaagggtgggaggggggtgaaggataaaagactacacgttgggtacagtgtacactgctcaggtgatggatgcacccaaatgtcagaaatcaccaccgaagaacttattcatgtaaccaaacaccacctgggttccctgaaaactactgaaataataaaaagagaaaaataatgttttttggattattagctatttggtcttcctggcttgtctgattgtggtccaaataaatcactgaaacattttttaaaataaggaaagacatagtcaaagttaaatagtaccgtgatatagcaaaatatgatagtctcctttaatcactgctgaagtgaagaaaaaagaagtgggatgactcaatttaatccgagaaaaaagaaaaggaatgctttgccatggcaagatattcttcagtcttctgaaatataacgatggtttcagatccctttcttgaagggaagatatcccatctgactcacttccctttgattcaaacgctgataatggttctatctgcttaaaaagtgattttagccagaacctacgcagcctatgcagaatagacacaagaattactcctgtgtttttgtctgaatctaaacaaattattttctcttttttttaaaaaggagctgtgtacaagaaattattttttctcataaagggggctgtgtatgaacaaatacgcccaccaacatttttctttggattttaaccagtttccgacttgatgtgttattatcttagtacttgtgtatttcctgcctttctccagtattttttagaagaaaaagcacactgatgtatccaatacccaacatttggctacaattaatttttttccatatgatataggaccgatgctttcaatttcacacataaattctgtgtgtaacacctttaacatattatggtgtacaatgttgttgctgattattagctgatcagttgtgaatggtggtgaaagatactgaaactagtagctaaatttcctaaacgtgtgggctgttccatgtgtacacaagaatgtattatgcttgatttctaaaatattaactcaacaagcactttactgattgtttgttgcacagagtatcctcatacagtaacgacaatgagcaagacttacatcctgtccttaaggagcttaagttctagggagttgtaggcagaagaaagaagtactagtaactggctgaaaacatggctgggtgtggtggctcatgcctttaatcccagcactttgggaggctgaggcgggtggattgcttgaggttgggagttcaagaacagcctggccaacatggtgaaaccctgtctctactaaaaatacaagaaaaagtagccaggcatggtggcgagcctgtaatcccagctactcaggagggtgaggcaggagaatcgcttgaacccaggaggtggaggttgcaatgagctgagatcgcaccactgcactccagcctgggcaataaagcgagactccgtctcacacaaaagaaacaacaacaacaacaacaacaacaacaacaacaaaaccagaatgatataatgcatgattaagttccaaaagaaaactcactgagtgaaaagaaaggatgctatatttcaggttaagaacataatgtactcaaggccaaagagcacatttattctgttgtcaaacagaaggcataaaatgcttaaagaggggaataatatgatataatttgaatggtagaagaggaactgaagtttctggaagatagcttagaaagggagagagaccaaaggcagaggaaccaattaggaaagtattcatattgtctgttcaggtaacacatgatgagggctaaatttgggcagaagtagctgaattgaagaattttgctctttttcataagtagcaaaacacactgaccttggtgactggattgatggtggtggaacatagctaaggaaggcaggtaaaggaagaaggggtagaaaatgactttgtatagattgggaaattggaagagatgctccaaaggttgatcatgatttcagattaggctatatttttatttataattttatccagaagatgctcaggtgggaggtctgggctggaaatcttgacttaagagttgtcagcatagcagaagccaaagtatggaaggagcgcccagggagagtgaagaacggtgaaggggatggagaatcttgaggaaaaccttgatgtgatgtactgaggataccttacctatatggtaatctggcataaaacatttaacccgaacccaatcacttggatacaagcagacaaattcaaattgggggacattctacaaaacatctagcccgacctcttctaatatatcaatgtcatgaaagatttaaagaggctgggaaagtgcttcagattaaaggagactacagggacatcactgatcctgaatgtaaaatatcgctatgaagaatattaattggcagaattggaggtatttgaatttaaattctacattatataacagtattgttctttttgagcatgataattgtgcttatgcaagaatatctttcattttagaaggcacgtgttcaagtgtttaggggtgaagtgttatgtatgaaacctaaccattgagtggatcagtgaaaaaaaaatccacaaactatatacacgcatgaatatgattaaatatgcacataaaatataaacatatacagtatataaaaatatgttaacatacagatatacatgttaatctaaatatatgcaatccatttaacaacacatgaatgtaaaagtacataaataaatagctataaagcaaatgtggcaaactgttgaattaattgcagttttgccataagtttgaaattgttctaaataaaaagctagggagccattatgtcataaacctcaaatgtacatgataaattttttaaaaagcaaaggaacagtttaatttttaaatcaataaaatataaaatgcttcaaaaaacagtaatctggtggaaagttaggagtcatcagagataaggagttgtctggacatcacagatttgtatatggagcccatgagagccaataggggataaacattgttaattgctattttgttctgtatttgcttcctccaatagaatgtacgtttcattagcacattgtctcagtaagaactgtacagaatacaaatggtacatagagactcagtgataagtatttcatggcttgaggaaatatgttgactctttagacacatcacctaatatgacttgtctcatgtttcacttaaaagaaaatcagtcatcggggttgcatatttaaagaatgcagctctatccagaatgtggttcagcagatcccagccttgtatctcaaaccttcaaagcccaagtatatacactgcatttatttaaacacctgtgtgcatccttcaagaagacggtaaggcttttttcctttttaaatgaagttagcttatgcagttcgatatggtttggttctgtgtccccatccaaatctcatgttgaattgtaatccccatgtgctgcgggaggggtccggtgggaggtgactggatcatggcggcggtttcccccatgctgttctcatgatagtgagttcgcataagatctgatggtttaaaagtgtggcagttctcccctcgctttctctctcctgccgctatgtagcacatgccttgcttccccttcaccttcccccatgattgtaagtttcctgaggcctccccagccttgtggaactgagtcaataaacctctttcttcataaattacccagtctcaggtagttctttatagcagtgtgaaaacagattaatacacagttcaagaaaaagtacccttgaattcagtcttttctttcagaggacaaatttaacacagcttatccattttatgccagcaagttatctcttagcttagccattggaatatagcacttttgtcctggtattcagttctaccatgatctttttagctccacagatcatcaggaccacatcctaatgtgcactttaatttgagtgctttaacgagtatgctgcctattcgccattgtcaacgacctaaataattattaatgcttctaagcacccagggctctgaatctgaccactaaaatatgtaacttagtttcatatgctttacttacttaaaaaagggggaaaatcctgaagtagaaaaaaataagaggtactaaagctcagttgttttcagaatttacagactttgcaaatgcatacagttgtttttcatgtagtgtgttgtcatttacaatcccaacagtttattagctatattcagatctcaggtggagggagataatctgacacagagattgccttaaatcatggaggtgtagtaaattcaggaaaataacctcaaacatatccttttccttctcaaaaaaatcaaaacctggctttcctacaagatttggcttctccagaggaggatgtgcctcttcccactgctccaggttcttgaacttcatcacatttatttcaactaccctgtctctttcctcagaaatgttcatctcctcagagccctcgtccatcttcttcaacatcttttccatcctgatctaccactgtcgtcaggatctggacctcacccctctgctgataagctcagcaacgttggtctcatcaactccatgaactgtactccctacccctcagtgatctccaagtaaaatcttcagcagctcgctgggaggcaccatgttagatgtagaaattgcttgaaagtattttacttccatgatatccaacttttgaattttcccgactgtgatctccaaatttttcgccataaaactcacccacacccctgacttttcctttctgtcctatccattttggttaaggcactttgcctccctttattctaccctcatggaagagctcaagtatgaaatgaattcctgaacacatcatcatatcaggcaatagagctgtaagtgtatggaatcaaggagtcacaggtcttttctattctgtgaggtaagatttgagaggaccaagtatataaccagtttaggtcccagggaaaagtaaggagagaggatggagctgactcctactgggcctttacagagaaagagaaatgaggaagggggaccaagtatttgtggccttcataaaaccctctattgtctagccagacacagcaggaaaaaccaatgagcagctggctaggaacccctgtcctagccattcattaccactgtaaaatgccctactcttgttttgacctttgatcatttatgcctcatcagctccacctttcttagaacctagtcctaggcagagaacattgctaagaatgagaacagaacatgtggaccatttcctcaacaaattcatccaacttttgcctaaggcttccttcttacttggtaatgtttcaaaattgtcttcactttccttaatcctcattcattttaagattacctagtctttcatttcattgaaacagaagttttccaccttcccttctcttggcctaaaatggtttctcaaaattacccaatgcatttatagtgacccaatggactgtgatttattttaatttccattgagctctctttagcatttcacctttttgtcacatcttccttgaacctccctacttatccatcctttactatcccattacccaaatggaggtcttttccaaggcactggatcgaagcacctgtgttatagattttatagatttctcatctcacacccttcagcaatcaattctatgaaactcattctcaaatctctccagtttgcccacttacttcaagtatagatctgtatcttaatttcttttgggacatgacttagaagacctgtcaatttctcaaacacattatgtccacaatcagaagtttcactatcttcttccaaccaaatcctctcccttcattcctcttcttacaatttgcactcagtccccagaccctgggaactctattttttttttttttttttgagacacagtcttgctctgtcgcccaggctggagtgcaatggtgccatcttggctcactgcaacctccgcctcctgggctcaagcgattctcctgcctcatcctcccgagtagctgggactataggcgcccaccaccatgcctggctaatttttctatttttagtagagacagggtttcaccatattggccgggctggtcttcaactcctaaccttgtgatccgcccacctcaccctcccaaagtgctgggattacaggcgtgagcctccacgcccagccccctggcaagtctatttttatagaatagtctcacagtcctctcctcccacatctctcaagtgcaggccctcagaactcaccaatcttggccttggcaattgcctcctaactggtcttctcacctatacaagttttctgtgggccagatagagctgccagaatacacctttttagaattttctttttagacttttttcgcctggtatatgattttcagtggctccctgataccaagatgagtcaaacacttacggccaaatattcatgtccctgtaatacgactctacctttcttcagacaacaaaatctgagagtagctaggacacttacccatggagtccgaagtttgactgccaaccactcggagcagcataggctgactgctgtcggacctctgtagagaggtagaaggagaggacaccgttgtgccattcactttggcctctgcctggggctaagtcatccaaaagaaaacagaattacttttcataataaacatacaaatgtataaatttcaaaatatgatacacactcaggactcataaattttgacccttcctactttagaagccctcccaaagattgtttaatttgggatatttcactgttgatataatccatagaaactgtctttgtatctgaattgtgctcccttataaatttgagaaaaaaatcagagctacactggaatgagactatacatcattacattaaataactggaagatttagaaggtcatgtgtgaatgatgagactatgtgagatctcaaaactgtaatggaagattcatatctttgtgaagtattaagtaacaagatagagagaacataattgaaaaatttaaaattcccagaaagccagaactatgtccaggtaggtcctcttacaatgcagtatcttgctaggttttcgatggaggcttaaagaactatgtgttagggattaggagaaaaaaaacacaaaggtataccagaaaatataactaattgtaaatgaaatagttccatttcaagaagtgaaatattcacttttagagaactagtggaaacctttaggcgtttttttccccaagatgtatttcaaattggtcaagaaaaaaccattttggtaggaaacaatattggacaaatacaaaaaagacacactagtttttctatctcctctacttctatcctttgatactatcactttgcaggcacataccaagcacttaagaattgatgcttgttgcacctataaaaagtgctctctgaggtttagttttgtttaagagggaaaaatgaatgtttgtaaaaatcccatctctctcctcacttgctccagcagctgccttagcctgtgtaactgtgactccagctgtttattgtggtcttccaggatttgcatcctggcttccaggcggcctttgtgttgacgcagtagcttggcctcagcaatgagctcagcatcccggggactctggggagaggtgggcatcatttcaggaggggacggcagtggggacaggcctttatgttcgtgctgctgctttagacggtcatattctgcttgcagattcctattggcatcaaaaaagtaaaaaagaaaaaaaaagaaagaaaaagaaaaagaagaaaaaaagtaatttgaatatcatcaccaaattttatataccatggtagatagatgcatctgactgccaccgaagaacagcaagcaaaagaggcactaatgaatggttttaatgatgacaatcttaccagtgctaaaagaacaaaacaaaatttgaagcttttgcctggtgtgtgaagggagccatgcttttcaattttttatgttacactaaaagcctcgcgactggtatgttcagataagtaagcagcaaaggatttaatcactttgtaaatatttctttataatgtcatgagattaaaaattttatacctctatcaacactttggtttgctctaaacattagcaaatattttcaacagaaatgtataagaatggagtaagtatacccatgttcctatcacctccccttgataagtttatcatttgccatattttcttcaaaagttttttgaagaaagaaaagttaacagccaaagcagaagctccctcacatgcccgcctcaacaccataccattctctcctccccgctgccctcaaggagataatgccacactgaatttcatgcccagtgttaccatgaatgtatcaacaaatactaggttgagcttaaaaaagatgctgatgtttgcctgtatttttctttcacctacaaaaacacccattttatgtgattcaatctaataacattattttgcatgtttttaaactttaaatttaagaacttcacatttaagaatatacataccattctaagagttgctttttgccttcaacaccattttggagatttctccaggtcgatacataatagtttgctattttaactgccataaggtattattattctgttgcttgaatatgccaacattttcctgtccatggacatttaggttgtttccaacttttcactattataaacaatgatacaatgaaattcttttttatacctatctccttggatacctgttgaagagattctttacagaatatagtttgatgtggaattgttggatcttagcaacatcttcaacattgctacatgtcaccgaatcgctctgggtgacaaatcggtgcttttaccaatttactctcgcttcagtagtgaatgaggttttccatttggcccacctcctcaccaaatacttggtgttatcagacattcaagttttagttaacctgatgggtgcattttaatttgcacatacatcccggattactggcaaggttagacttcttccatgttaactggcttttcatgcttcctttacccattttcctgctggattgtctttttctttttaaacctttggatatgttctagatgctaatccattgttagttatgtgcatggcaaatatgatcttctacccttatcttagtgtagcttatctttaactttgcttatggcatcctatggtataaaagatgtaaattttaacatatccctgtatgttctctgctttttatgttttgttcacgaaaatcttttcttacacctacattttaaagtttaaaatttggtttttcacatttaggacttgaatttacccagaatctatttttgtgcttgccgtgaacatgcgatctaattttacttttcccccatggataaactatgaagccagcctcattcattgtatggtccatctatttcccactgatctctaacgatgcttccgcaaaacatcaagtgtccataaatatacaggtgtgcttctgagctctgtattctagtctgtggttctatctgcatatccctggtagatcccacactccagctttaaatcaattgatgtctgataggccttctcagcccactttgtttttcctcaaaattgtcttgactattctgacccctttgatcttctccatgattttagtgtttggttttctgattttatgaaaatgcttgttgaaattttgagtttgaattacattgaattcataggttaaactgggaagaactaagttcataataattgagtcttcacatccaagaatgcagtgaagctccttacttactatggtctcattttatgtccattaataatgttttacttgttactcttttttttcctcttgctttacaggttgaataagtcattgattttttatttttaatgaacacatttagggttatacatttcctccttggtaccactttaattatataccaaaagtttttatatacatcacctgattcaattcagtgccttatgttttgtaattcttactgtgatttcttttaacttaacccatagtcatttaggagcacagtggttatatttccattttcacttcttagtgcatttctaatttaattgcgtttcaatcagagaacccctgtatgatactgatcctttgaaatttagcaatacttctttttgtgacctagttcacagtcactttctaaaaatgttcattgagtacttgaaataatgtgtatttttccattggaaagatggagtctctaaatacatagtgtgctgattttgttgttaaaattgtccatatctttattaatttttgattatttgtagctatcaatttttgttagatgagtgttgagatataattatggatttgttagtttctccttttaattctatcataattcactttatatatttctagacctatatagttagatgcacagaagatcctcgttgttcttgcactgtttctaggtagtatactttttcttcctaataatgttgattgccataaattttattccatttaaaggtttctatggttattccactgtcttttggttatatttggttaatttccaaataaatataaacagtattagcacatgtgaaggtcccaaatgctttaggatttactgagaatacaattccaattgaggacatttctgatatttgatatccagtgactgattagaactcttgacatctttcttctacttgtgataaataccaaaataagatgacagatttctgttgttcacagatgatatttcatcaggtgagagaaattcctatccacaaatgtgggagatctatatcaatgagaaaagagatgaaatgtaagtagtgagtagccaagaagagttttcccattgtccagtttgagaaagcaagatcatctcatcaccaggtctgctaaatattttctgttgtcccatactcggaatgaacattccacaggggacggcatgtcttccaaaatgctcagtttcaaaaggctagatctccacatggaagcagaaagaaaacccaatctactctggtttttttctttgttttgttttgcttcatttttttcattctacctagtacctaacattacaaggtttccaggaatttatttaaagtcacacagaaaatcaatgtatgatctttttcatctacagaaatagaatctcctatctgtactgattgaaatcctattgctatcagccttcaagggtagttgtttgtatagtttatttcatagcaatctgctttgacaaagcagtgatgagaagagattcatcgaagtaagtacaccttcagtcagattctgcacacgggtcttctgggtgtgcaccgatgtatgtaactgtccacattaattaaatctaatttctgagaacttaactggcaatcagttcaatgtttctgtgaacttgaagcagtatccaatgttcacaaggtctcattccataggaattactttctatttttccctcttcattaaaagaaaacttcaacaaaatgttctaactggcaacactttttatgtagaatcctattcaaatttttctttctaccagattggggcagccatggtgttccttttgaaaacagtttttagacatggacctcaagatggtacaacaagccattactgtcttcccacctatttttcacaaaggtgctgacaggagactgccttttctagagagatcttccttggtatcttgatcctgtgggtttagttgtccacagggctcttcttttatgatttatttataaggacccttgttcaagaggcatggtttggtatatacaacacattacatttctgttttggtggtttccagtgaaaacagaaaaggctcattttaatcagccaaagctgagctgtaaagaatatcaattgctcaatgcaggcctttctttccttcccagatgtttgaaatttctcttgggagcacatttccttcaagactcacatccttcttcaattctggaagattctcagctatgacagcttcaaatattacttctctaccatttcctccattttcttctgaaacctctcaaatacactcctaaacaaacctctaaattctagtaaggtatattgtagagcctgtggtcaattctccatttctcctaattgctcatttatatttcttatctttttctgtgagtgttgtacacagtaacattctcagcatcatcttctaattcccttgccttctctgacaggacaaagtctagaatttatcctgtatattgagtttagtaacttcaatgactagtttttttggcaaagatatctttgttttcagacctagttacatttcatccatctctgtttcttagtttcttgttattttagcgagtggtaccccttatttatgcctttaagcatctttttttttttttttgagatggaggctggggtgcagtggcacgatctccgctcactgcaaccaccacctcctgggttcaagcgactctcctgcctcagcctcctgagtagctgggattacaggtgcctgccaccatgcccagctaatttttgtatttttagtagaggcagggtttcaccatgttgggcaggctgttcttgaactcctgacctcaggtgatccacccatctcagcctcccagagtgctgggattacaggcgtgagccactgcacctggtctgagcatcttaaatgtaagtaaaaatctttgttgtactagtgtattattttgctttcttctagaattaattcatctttttttttttttgagatagggtctcactctgttgcccaggatggagtgcagtggcacaattatggctcaatgcagcctcatcctcctgggctcaagcgatcctcctatctcagcctcctgagtagttgggactacaggcatgtaccaccactcctggctaatatattttaaattattttttgtaaagatggcacctcactacattgccctggctagtctcaaacacctgggcacaagcagtcctcccaccttggcctcccaaagtgataggattacaggtgtgagccactgttcccagcctaattcactttttgatgtttaacttgggtggggggtgctatcccatttcttcatgtattttggatcgtgatttggagacaaattttgcaagggatgttttgcatgtgcatacatatgcatgtgtatgttttctattattctcatgtgtgtgtactttaatattttcctctctttttaaactcattatctctctctcaggtggttttatggcttctcccagccatacccaggggcttagagtttagagccacatctgttggtagtttgcagctcctacactgagtgatacagagatatcactcatttcattgccaggcagtaggtagattggttcaggtcctggtttcaaggctgtgatgctctctttcccaactgcgaatctttgcctcttccctcggctctatgcattagggccatagctgcatataagctgtagacccttgcagcaaactgtttcttttcatgttgcttttaagtgtaagtgtgtatgtgtctctctctaggtgtgtttttgtggggctctgatttcaaatagtaatcctggctttgggccactaccttgtaaggagaattttaatccctgttactacagcacgagctgaaagcccactaatttagccccacttacttttttttttttctttcacatttctggttcacagagatgttcatcttgctttaaagcccagctatgtctttttcatttttcactccatatattatctaccactggataaatggtaggagcagagaaagatgccttcaagcaagagctaatgttatcttaatcagaagcctaccaggacacattgattttgtagatgtatagtcaaggttccctcagtattaattcaagccttaattcatcaggccaggattaaatgagtcgaacaagtgcttttcttctaaacaaacatatgacatacagaaacctcttattaagctcaatagcaaacttgattttgagggactagtttttcctcctgaagctctgagataggacaagctgtcatgataaggattctaaaagccagaaatggttaaaagaggtatcttggcctgcaaccaaatgaaataaggttttttgatttgagtctgaattctcttttaaggtatttctaaatgttcatgagaattatcaagaagaactgatgctggagggtttgaactagagatgatttttactaaatgttttctaataaatgcagtcatagtcacagagctgtgttagggcatatttttgttaggggttgggaaattgagccatttagcccttatcaattacgcatttgaattttcttatatttaaaaacatctatgccaatactttttgaggtataccataatgttagttttgatgcagtattaacgtaggggagatcattctcataaatgatcaaggttccctcagagttactgttccaaggtaagttattctaatgttttttttttatttttttattttttattttttgagacggaatctcgctctgtcgcccatgctggagtgcagtggtgcgatctcagctcactgcaagctctgcctcctgggttcacattctcctgcctcagcctccagagtcactgggactacaggtgcccgccaccacgcccggctttttttttttgtatttttagtagagacagggtttcaccgtgttagccaggatggtctccatctcctgacctcgtgatccgcctgcctcggcctcccaaagtgctgggattacaggtgtgagccaacatgcccagcctctaatgtttaacaagtacacaatgcactcgttttaacagctgtcaattattaccaatacatattttgcttttcttgaaggtatacacgtacatctcacccctaatgattctctaattgttagaatgtagtcatgaagtcatttcaatacagatgaatatatgtcagtgatcagacaacgactccacagagaatctatttacgttcttgattatcttgtaaattatatttctctggtagctccctaaggaacattaattcaaattcaatacacatggcttctgtcactacaatttcttcctgtagccagtcatcctaaaaaaagtcttccatccagtatttcttattctctatagagctaagaatccccccattctacaaatatgtagatatatctgattaattttatgtcataaagaatataaactctgttgtctacatacaaatttacactcaaaaaaacttcccaaccaactaatggacataagagattaatcaaattggcaaggcttgttcccttaactcaacctgctgaaaacatgaaagcagctggcccttttagcaatgatttatgagtgcctctctagcaatcgtaactattatgtatgataaagaacattacaacaatctctgtgtaatttaaactaatttacaaaggtcaaatgatttcagtgtaagtcatctactctttaaatggagcttccctactacgtgtagttatatagttgtataatgatatttatgaaataaagaaatgaaggtcactttccagtgatcaatgttttcttaacagtatcatacatttaactgtataccaaagcatgagcacacacagggattattttgtaaagtagaacaactacaaagattgccatctaaaaggaatagatccaaagaaatctggctttaccctcatataatattaaaagcagctaaatcatatccaccaatctaaattcaggcaaatgtagtaaatcatacagaactattacagcagctataaatgtagccaatcagcagtttttttttaaatgaaagacaaattctgcaagcaagatgaactttaaaaactggaaattgcattgagcccttgaaattacaataaagctcagtgcaatggctcacacctgtaatcccagcactttgggaggttgaggtgggaggatcacttgagctcaggagttcaagaccagcctgggcaacatagggagacacccccaccatctttacaaaaaaattgaaaaaaattagccatatgtcgtgacacatgcctgtagtctcagctactcaggaggaggaggctggggtgggaggaccgcttgagtctgggaggttgaggctgcagtgagccatgatcatgccactgcactccaagctgggtaacagagggagactccatttaaaaaaaaaagtgacaataaaattttacagtacagctttagacatctttatcaaacacaaattcaaaaatacccctaaactaggtggaaaaagacattaataaggataagctcacagggtgagaagtaagactatgcatattttaggtcagccttaagcaaaacagtaaaaatggcaggacccctccaggctcttgtttctaatcatttcttagcactgtccccctttaaaacattcagagccttacttccaagccctttcctactgaaatttgctcagtataaaggttttatataagacatttacattttactgggattttataataaagttgtcatttcttctagtgatatctgcattttaaaacagatgtcaaagaacgtaaaggaaaaaaataaaagctttgccccatcaggggaaaggttgaacaatgccactttttgacacgctgcctttgtggtgcctttcaccatccatggctgaggagagaattagaacaaggcttgagagatggtcttggattcagaagatcttgatttatgacttacttgcctctgctgcttgctgaggctgggcaactgacttaagcactaattcagttatgaggattattaagccagtatggtcgacattctatatgtcaaactttctttgaaccatgcccagcccatactgtgttcaataaatgttggttactattattattgttattacttctttctctatatattatttactttttggatttagaacctcagatgtgctaaaaacttcctataaaaagaaagcacttaattatctgaaatggaagcaatctacttagacctactgagcttggcagaacatatgcatatctagcgcttagaaagtgactaatcactcagtatttgtcctgtagatacctgagttctagcccctagccacattgtagccacccccaaattttggaattattgtgtatcatccatcatctgtgccttagtaaagtttatcacagctgaacatctgggcaaaatgaaatcactgagttaagatcactaggatgagatttccttgatttgacccaatacgctaggtatgtgatgaaactgtcaaattataatatgtccatggatcattgctgaaataaaatatgtggaccaagggtacagggttaatgtatctaggtggagtctattttctggatatgtcattgacacgtagatctgtatcttgctcaagttccaagagacagaacatgacaatattaattggcttcagtttcttaatctttaatgactgagatgtttttcacaaattcctgatcagatgctaattcattactgtctatagactaaatgtattaatcaaaagttcaacacaagaagaattcataagaaattttaaccacttataactggaaataagacagactaacaaaacctaagacaaaaatggcagtggctggtcatcatcagccaaaaggaaaaactaggattggagaggttttagaggtgaagaactctagtcctcaggaatactgccattgggaaaagtgtgtttccattttcagacaaatacagcaaaatatcaaactttcattgtctgtggtcagcaaaaagccgtaacagtctctagaagaatcataattttaagctttgtgtgtcccggcttcaatccctcatgcgtagttagacttagtcttaagttctcccagtaacttcaatttgatggcctatttttcactccctggcatgcactgctatatactcttgccatatatgatcctatggcctcctctattacaatgacagaaactatagaatcttttttttttttttctttttttgagacagggccttgctctgtcacccaggctggagtgcagtggtgtaatcatagctcactgtaaccttgaattcctgggctcaagtgatcctccagccccagcctcttgagtagttgggactacaggcatgagccaccatgcctggctaattaaaaaaaaaaattgtagagacggtatctccccatgttgcccaggctggtctcaaattcttggtctcaagtgatcctcccacctcagcctgccaaagtgttgggtttacaggtgtgagccaccatgcccagcccagaataacttctttaaaataattaccggtacttgtacatgaatgttcatagctgcattatccataacagacaataagtagaaatagcccaaatgtccatcaagtaatgaatagattaaaaaatgtggtatatccatacaatgaaatgttactcagcattaaagaaagaatgaaatactaatacgggctataatatagataccattttaaaagattacgctatgtgaaagaagccagtcacaaaagactttatattgtattatttcatttacattaacagtccagaataagcaaatccatagagacagaaagtagatcagggattgtctactgctagggctgaaaagagtagttgcaggagaaacgaggagtgacttgaaaatggggatgggatttcttttggggggtgataaaaatgttctaaaattgtgcgctgatggttgcacaactctgtaattaataaccagtgattactaatactggttaacctattaactaataatcagtgactaatacactgtaaatgggtaactcctatggtacgagaattatatctcaataaaggtcttataaaaaactaagttctagattcaaaattttatttcttatagcacaaaagatattaccccagtgaaaacaataaaatcttataatgctttctcctactatggaaaaatcaaggtttaacccatgtacataaaagaaaaatggtatgcacatgtcttcagaattatccgtgtggacattaaatattttcagatgatgagttttaaaaagagtccaaaaataagcccagaaaatgcttaagtctgggttagcctaaacaacttggatggtttcagtctaatggaaaatgacatcacaaactaaacaggtatattaagggattttgggaaagaaaataatgtaagaaatgagaaaaacaagggagatacctgaaaatcaaccccaaaaacccatcaagtaacagaaaaactccaaaggatatttacccattcatttttatgacacatttatgtacccagtgctgtggagataaagatatatgtaggacactgtcccttacccttgaagagctcacattctagagtgtgggatattgtttacttccaccatggaaacaaaccttactcgaaggcaaaaagactgggaatcatgctcactgctaaagctaaaaatacagatttttatctttgaaattatcgccttgatttaccaggaaattacaggaaaagaatcatatggatttacttatgacttgtagttacaacagacagactagcaccataaggtaactcagaatttggagacacaagaaaaggtcatattttaactattaagatagtaaaaaaataaaatgggtgagtttagccatctgcagaagccatccatgtacatatgtaataccaacaggaaaccatttctaactgggctgctcatgcccaattacaatcaagtacatcaggaggtccttggtcttcttcttacacaaactctcttcctaggaggtctctgtcctctccccaggcttccatctccgccacaaccatgaccccttcccgcaactcattactccttaatcaagacttctcttctaaggcttcagacctatctctccaacattctcctggatggctccattagccatgggctctagaagctgaaacttgctaagcaccaagccacacgaggttgatatactgattatgcaagctctaaaatttcagtgccaggaaaggaacagccttcctcaagtagcattacacaggaccatatagtagctacacatctttgtaacttataccttaatcttactttgagatgaaagctatacctgcatttctgtcataagataaagagggagaaatatcttcccatgtgttgatgatacactttaaaatcacaatccaggagaggcctcaagcaacaactggcctttgcatctaactacttacaaagaaagattccacagtaattgtgatgaagctaaaggtgctgtctttggtaaacatctttcaaagttcaatcatttcacaagaaagaactcccgatagcaagttaattgcatcaagtcactggtggcaatttttcttggtggtttgggtgaaaagccaagttattcggtgggatattctacaaaaatggtgcaaagaattttctatgatcatgagagttaatttaatacctatctttagatttttcagactaaatcattctggcttctgggtctacagggtaactgcttcaccactagagcatatgaaaagttacttttgtgcgaaaaatccaggcttcctacgtgggcacctgttatagctttatcttctgatgttcccagagacacaacggataggcttctcaacaactacagtagagagtcaactatgctatctcctagactggttttcaaagtttacttcagacttgaatttctttaccaaagtgtgttccatataacattgcagttgggctcgaggtcaagtaagtgggagcaacatgaggttagacaaagctaatcaggtttcttcacttccaaactcctcagtgcaaatgctaacgtaatgatgactttccagtatgagtgctttcaaagttttactgtccttggaatcctttttttctcagagtatctcagtggtattctgcagaatacattttaggcaacagtgacctttatccttggagaactgtcaccctatctttggtgttttaatgttaagctttccacaattatcaaaggccatgagaaacagccacatataatttcccttgggatttgttataaaaatgttgataaggacactagccaataatcacttcaagtgtaacgctgcttaagagttcaggaccaccacccaagtttgaatacaggtcctattacttgctggccatatgaagtgtccttaatactctgtgccacgtaatcctctggaaacagcctctctttcatagggttgttttaaggattaaataggagttcatatgtactcagaacagttcctgtccatagcaatcactcaaaggacagctatttttgttattattattattacgtagagccaggaaaacaatgatgtttctttaggatgctgcgtgcttctttaattcaatattaagagacagacaaatctttgtttcctattatctccctggctacagggaagctcaaactgaatctgaagcttagtcaaatcaactatgctaatccctatgatgttcattgatctattatttatattgcaggaattgtattgctatgactttttaaagaatcctttctgaaaactgaatacgtaaaatcaacataggaaatttccacttgaaatgtccttgggcaaatagaattcagtatgtctgatacgtagctctttctctccatgcactaaccctttgcaaatcaggagtttttcctgggtgcactaggttgcttttgtttgtttttcaatgatcatttcccagttcccaaattaaaactttccgtaacaccagatgcctccccctctccattttcccttggtctcattcattcagtgaccttctaatttctccatccccttcttcacttgcctaagacatccttagttaagaacctggcatcttttaatggactattccactgtgcttctaccaatcttcatggctttagctttctgccaggtcagttatttttctcaatcctcccccccgtcaaaaagccatcactgttcacctgcttataggataaaacccaaactccttagtatgatgcacaaagtcctttaaacagtagtccccacctaccatcccactgccctcttattctcctcattccaagccacacattactcactggtccaccagtctggaaaactcatccttcccccatctctcagactggaaaactcccattcagtcttcaactcttaaactctctttgtaaaggcctctctactccctctgatagaataaatcattcacctctgtgcccccagagcacttgtaacagtaggatataagtagttgtttctattttaacttttttaaaataaattttgagctccatgagggtaagaaccaaggcttattcatctttgtagtctcataattttaaaattacattaagcactcagtaactatctgcagaattgaacagaattacatcctcaggcctggaaagtagctaaagaaactcatgaccataatcaattctactgtagagggacaattggcaaatgaaggccaacaggaggatgagggtcttcatgaaaaatctaaaaaaaaaaaaaaaaaaaaaagggaaattggattgtaagaacataaactcttatccagcatgttctagggagatggcagctgtacttgtaagatgtgaatattctaatcgccagaggggtgcttcaatttttttgtagtatgaagcagtcctcacaaacatccaattttagatgccaagattctaggctcaccagaacacaatttgatttttattgtgattcctaagacactggattctaagacacaggatgctgtgtgccgaaaaaatgaatatattcctcattttaatagatctagtatttgcacttaaaccagatgctgtctcctcctaaaaaagctttaaggcaaccttgataacattttaatacaaggcagttaaaaagagagataattaggataaagggagaaataaactttcattctgggttatccattcactgccatgaactgcatactatgaatcagtcccctcagacttcaattaactttggataaactgaaggaaatttagttacactggccctgctagttagaaactgagtctgtgaataatggtgattccacttctaccatgttcctgtcctccctgcctgagtagagctgagatggttgaccccattcttacacagcttcttaaatgtggcatgtatgcccttcagctcttattcatccttgccataaaaggtcttggctttctgatttctgtgatcaaactagctccctttgtctcaagaagggctctgtagccctttgttttggggcccatgtcaccaaatgatatagtttggctggatctccacccaaatctgatcttgaattatagctctcataatccgcacatatcatgggaggaacccagtgggaggtaactgaatcatgggggtggggttttcccatgctgtttttgtgatagtaactctcatgagatctgatggttttaaaaagggcagttctcctgcacatgctctcttgcctgccaccgtgtaagacatgcctttcctcctccttcaccttctgccatgattgtgaggccttcccagccacacggaactgtgagtccattaaacctctttttctttgtaaattgccccgtatgaaaatggactaatacaccaagtaacttgaatgcctagtttcgttaaatgtatcatataccacgctttcctctccactccaactttaaaaacatgtgggaacagccgtaggaatcagtcttgaattatttccagtgatgtctactggacattttaacattcattccattatgcttctttcctcccttccttaccctaaattccttacctaccactttgtcttcagaggcagtccttcctctcattcaaggtcacgcctcctcccatactttagttccctaacccttctctctcctgcctcctgtgggaaaatgctcccatcattcccaagctctgccctcctcttcttctggcacatttctccagcatgtgaaaattagagatttttaagtaaaaagagaaaaccagagtgaacactgcacgacactgtgtgaagtaaccccaacaaccataaatatgtttgcaaatatttgcatatgtagagagcatgtttggaaggaaacacaagaaaccaagaaagatggcagcctccagagctggaaacaccacagccaggggagaaggttggagaaggattcacttttctctatatgtctttttgaaccctttggattttgtataataatatacatgtattctctactaaaaataaaagtaattaaatacacactttaatgttcacatcttccggagttctaccaaatccagtgttctccttctgctacatgctcccgggatatataaattcattctcacggtttcaactaccacctgtgagctggcgactcacagtcctaatatctcaggcttatatcctttctacaagcatcagagttctatctctcagactgtcagacatttacacatggagatgtcaccaggacctcaactcgacctcttccatacctcatttatcaccttccagctactcagcccttcaggaaggacctctaataaacactgctgcattaaaggatggacctgctgcaactcctcctgaattatcagtcccagctgcaaataactactatcatcttgttttgtagttaccagccctgggaatcattccttcataccctagtcccacagaactaccgaatcaaacagctctatcctcccccgaaatatcactcagatcagcctgtctacttcatttctatcaccttacttaaggctctaatcatctctttcctgggctcccatgtgactccccccagcttgatttcctcgttccagcatcgctcttttcaaagttaccctccgcacagctgcctgtgtggcgtatattcatgtcaatatcatggcctgactcctggatcacacccttgagttgctccctagactaggcacggaggcagcaactctgcagtgggtaccacacccttcccgacctgcccttgctgacctggtcagcctcatctcctctcattctttgccttcttaaaaaaggtaatacaactgcagtttccctcaaacaaactctgccattcctcaccctgacacctttgtttatattccataggaatgcccattcctaacctcttcagattcccttcattttggccatcttttcaccatcattggagacttgcacaaagacctaatgaaagaacattgaataaagatttcccgtagctatgaagattgatagctactagactaggtccaaagtcatcaagtcaattacaaagtaaagcaacgggatcatgatttccagctactttaattcagtggtatcagtaactgatctagaacttctttgactgtaacaataataatcttgcacaatcactggaggaatttaaaggaaaaagagaaaactcaaattttggcttcataaggtcttactgcccaacaagacatatgaaaggtcctgagtaggtattaagaatctacagagttccctcgtgttatataacatctactaacaactttaactttagactttatggtgaattaggttaatatttagccaccttgttgacttgagaacaatctaatcaatttgctctgcaggtagtagaacgacaatgtctttgtctctcagaaaggctaccttttcattgctaggatcataccttgaatttcagagcaagtcttggtttatttagacagtgcagagacaaatacatctctgtatttgaacactacaggcttaagtcaggagactgaaggctttaatcaacgcaagaaaaaaaagtaaaccttgagtctgcaatgctaaggacacacaatggggcaaaaacccaagatccagtggctctttgccaaataaagatgtatctgaattatatgtggtaatgagggagaaatatgatgcagaagcgaaatattaaagattagatatctcactaacaccattagtcatccaaacttatgggaggcactatgggaaaaactcagtcagatttagcttttactcagagctttagccttatctctgtggcatcaaccaagaatcagagaacaccaatgtgggatacatacagtgcctgtgatttggaaaacgggttcttaacattctaaatttatgacaaagccatgcctggtgctaatcaaggcagtttgaaaaaggggagaattttgaaaagcaagcagaaaacaaagtctttgaaaggcttttctctacgaaattaggtttgtaaaagaactttagtcaaaagtgcatgcatgtatgctacaattaaaataaattcagcttcaattcatttattcattaatgcattcaacaaatatttattgaatactatgtgcaacaaccaggagaaatggaattctaaaggcagagataagatacctctgagacacttctcaaacagccatcctctgtttttctagggggttgtagggaggtgtcatgaataagaacaattaatggaatttaataaatatctagtcaggaatggggctctccaggcctctctcttttgctgttatttggagataaatcacagctaaaggaacataaaatatatatattaacagatcaataagtacacatccaaaggacttggggcaatctcaattttaaatatactttcttattttctctaaaagtatgctcgtatttgtcagattgcgtagcccaatgctgacttaggacatagccagctagacatgcacagagagggcatctaaagaattcctgggttttctcaacaggaaatggcaaattaaaggctccttaagcaacactgaattcaagggtagcgaaggcaaatctagggctctgaagctccttgcgcagaactgcaagaagacaggacagggcagatcaaagaaaacacacgggctgttttcaggaagggaactctgtggagacatttctttggaatttggtagaaggtcaaataggacaaaatgaagggacaatgaaggaagctcatcctgatcatttcgtgaaggtcaaggtaacttacacaaagatttgcatcaaccccagagtcctcattttggagctctaagtaggcctggtgttatgttttttgttcttttagagaacaaaccatcccattcttggagaatggtcttggatatcttccagggtaaagcggttatcgctgtgccacaagtagatgaacaggtttattccgggacactcagtcctcatagatagtccctcaagttaaggcacattctggggaatatgccgcaattctatgtaaatgacattcacagagacttactcttctttattatctggttgaaggcagagttgcctatttagagtcagaaaaatctggatttcaattcagttctaccactggctgactgggaaatctggggcaagctgtgtgaacctctaagaacctgtgtctcattcacagaaaggcgacagtctcttctccatagcgtttgtaagaagattaaatgatctaaaatatgtaaaagtgcactcaaaatgataaaatgataaataaatgatagttatcagtactctttacaaacattctttgacccgggtgcaatggtacggagaaagactatgctaaccacaaacgaggcagggctcttgaccaatgagctcaaaagatatattacacgatcatatacttcaaaaatatatttactccttggtaacatcaaattctatttacagtgtcagttccaactttttattccgatttgactttgacccctacaataattacagatttaacataaatggatattactgattattctcaataaagtagaaatgttttctctaccatggtcttcactgacaaatgatctcaaaagtacggccaaaaataaagctatcattaaaacaacaaaaaaagttcaatattatctcgtggatggtactcatgtgatgttcttgctgtattttcaggtttttagcaaacatttcctgagtagccattaaatattcaaaccatgctaagtactctggaggatatgaagatgattaagatacagtccatgccccaaagacacacactagctcattaaagagaggcactggtaataactgataaaaaggaaaactgtcaaggaattttctgagaaaggtccaaagtgctctgggaatagaggcaaaagacagatttcttccaactgcagggatctagcagggctccatggggaaagttattttgagcagtgtgatggaggataggtgggattcctttgtcagatacggcagtggtgggttagaggttagcagttaggctgagactcaagcttgagcttgaccccaaaggtagatgagagcaggatgtattcagaaatactagctacaacagcatagccagaacacagggagaacaaaagaagatggcatagaaaaagcaagtcaagagaatattgtggaagggtttgaacgccccactaagaagcttgatttttttctacatgcagaaatccagtgaaaggggaatgccatgatgggtcttggttctggcaagatgtacaagtagagtcagtatggaggatttattgcaagggtgggaaagagactaaagggaagccaaccagataaggagctatggccataggtaaaaggtgttaagagctagaaggctcgcagtggcagcaggaagcaatggaagagtggcagtttgttttttcatcctgaagtggcatactcccgagggcactgatctcagacacactgcgttgcctacgttaagagcttttggtgccttgggctcaaccaaagagatgaaagtacttaagacccacaaatctgagcaacatctactttaaatccttgcttggtggcatctgtctgaagaaggcacattgtgagttagaagtgatcatgtgagaagactttttaaaccaagggacctgtgacataataaatgtaatacagaactgaaagtccaatgatttgcattatcctgacacaatacagtaccccagatgtttacatctttgtcctccctgcagtcattatgagagttctttagcctttttctcttctacaatttctgctatttttacatgactgtcttttacaggtgatggctgacaattggaattgtctcactaacctgctatgatggtgagcataaataataatttctgcatttgatgatgaaaaataagatgaaacaattggtttcccaatatgaccaagccaataaccctactttcttaaatgtttgaggtagataatatggccaaacacatgtaaaaaaaatcatataatcataaaattaaataacctacttttttcttaaattctattctgaaatataaaatcaaagccttggagacacatgcaacaagtcaaataccaccatcagcattaactccttcacacctaaaatatgagttcttcatcatactattgcatccattgtcttctttcagataacaaaaaaaaaaaagagagagagaatctgcaaatggagctaaacagattattttagaaaacaattagacataaaatgactctaagtgaagattcctggcacttttctatgtgtgcaagtgtatgcactctgcataccaatgacaaagctagaaagaaaactcacctgttttcttcctcaagatctgctaggattctctctagctcccctctttcctcactctctaaggaaatcaagatctgggcaggactacgaggctggctcaggggggagtcctggttcaaactttggcagtaatgctggattaacaaatgttcatcatctctggaaaataaaatcaaaggttttggttttttcccccccttattttgctttgggggttagggactcaggagtgtatttgaaaatagaaacatttatttgctcttaacaattaattagaccttttttcctgcttctaaagaccttttgatactgctgaggttgtgatctaccattctactggtaccaattcaaagtgttttcttgctcagattttcaaatgaaattgattggcctatttacacggataaatgaaaggcagaattacagaaatactgggactctacgttgatgttagtcaatagctaaaaaatattaaaagatataataatggctgtataatgctttggccaccaagcctgtcaagataatctgttcactaacccacgctattgttgtactgagtaggaaaaaataccttgcagctctaaaagtaacagaggaaatattttattaagtggaaggcaatgtaaccaaaaagtattgcttcagtaagtcagttttaacttatataagtcattgaggcagaatgacaacaacaattaaactggagatacatgattgtttcattcagttattgtttagacagaagaacgaaaattaaggggaaaaaagacattaaggtgactgattaaaagaagactgaacatctcattcctcggggcagagtttttttaaatacaagttttatttatttttaaatttatacataatggttttaaggactaatcttgcgggaaaaggaggcaaaaaggcttctatttggggaggcagctacaatctttcctggaaactaggaactctctaatacacaggacaaacttttttctgaatgcattgctccaagctccggaaaggcctgtttacctccaagttataagaattttcttctgtccgtaatgacaggctaaagctcattgtttctggttagatatcattaagatgatacgctaatattctcctctccatacccacttaagttgaaaaatatcagaaatttaggaaaaagtccttctcatttgaattatttttgtttatcaagccagttacctggtttagatgtgaaaagctgactaaaaataattattgggtattaaaaacacacatttaagtgaagtcaaccaatccaccaaaccacttccccaaacctgcccctaaaatgccatgagtttttgccatccaacattgagtcaaaatggattttatgtcctcagaataagctaaagcttattttaaaataaaacaaaagcagttttaccacctaatttatcacactcattccaaattctgaagttgtactgctagaacttcccatgtttaattataacctagagttgtaactacacttttcttcctgttctcttaggcagtcaatgaatgacagccactgttacgtagatacaactcgaattaatctgaatgtgctagagcttctaataccaaaatcagtgagccaaagaagcacaagctatttacatttggctgattctttggccacacattttactgttgaagtatcttatatattagtaccattaatactttttcccatagctaagaaagataaggcatcacagttatggttggggaaaggcttttttgtttgtttgtttgaaggaagtaagtcatatacaaatgactgagggttgacttgattctttattattagcttgatcgtttatgtaccagatgagattatttattctcatgtcttcaataactagttatatatatgccactttgatactatttcttttggcctaatccttatgaaggttcttttctcatctgagcatgactttgtgttgccacaccaactacatatgataaatttaccattcttccctttgtctatattctccaagatgggtgagatatccttactttatcaaactaaaaaggcatcgtaatactttgactagatttcttctctttatgttatttattcacttggcaaatccttattttttccttcatatttgcttcaatgtctgctctctctacctcaagccccggtcagcatttacttggttcatggcaatgttcctttgtgctctgtattgtgaacactgccctcactctataatgaagcctgtttccctgccatagctgtgttccctgctgctcttagcaccgctctatctccgtccttaaagtttaacagggttggcttatcatcctgctaacaacctgcaacctgaattggtacttctcctctggaaactcttcataagattgcctcactttatttatcttgtgaagatgctaaatcacaaaaatctacttctttggatttctgaaggaaaatgcccaactaacctaccatatgtgaatagccatgctataccaagatcacgtttccactccccatgagtggagaaaatagtacttagccatgactttaaaattaatatcctatccctttaaatatctggcaggtttggtcaaagattaagcattactataaatacttgggactctgcaatttgtaatcatatggtatgaaataagttcaaataagagtaaggcaaactatttttgctactctgaatactaataatgccagaatttggatgagctcattccatgccagggcattaagaattaaaggaaaaaagtaaatgaatggctccttaaaagatcaaatgaatatgatgctaattcctatatcctgtgctatcctacctctaaatccctcaaagcaatttcattgtcaggaacattttgtaaaaagagatgggatacttacatgctctcattaggagagatgctatcatttagataagatccattgctgttttccatttctgctagcctgataaaaaacgtaaaagctcattaaaacttatgtgacgtcttagaatctattcaagacctaatcgaacattcctgaaaactaaaggataaatcatggcaagaagagaaaggaatccttcaaattaaaggatgtgtgtgttggcttaaccatttgaggcagtgtgtggtagaccacagctagttagtagcactacatttatgatagaaattctaaggaaagttatatttcactgttttccccctacagatcagtcttgctttcactgagaacaggtctttgttttcagaagaaaagcttccctaacaataagtgcactccctaccttacactaccccttgtcttttaggacaattactactttccactgatgacagacttacacagctagctaatgcttttcacgattggtaaacatgtccagcagttagaatattgacaaaggatggatgcacagtaagctctctaaacattctgccaccaatttttacctttaaaatcttcttcacctcaggcaattatacagggggttttttgtttgtttgtttgtttgtttttttacaactaaaaaagttaaccaaactcttacggatttaacaagcataaaatattttaaaattagtaattcagtttttaggtataaaaatcatctcaaacacaaagaaggtgagacagaaaagtccaaggattaggaaaattaattattctcttctttacagcatatcatgtaaaataaatacacaaacggaaagctgatgctttcatattctccatataatatagtatcattttttcatatatgaatgtctggtctagcagttttctaaggaggttaaactatttgtaagccaatttagtaaatgtgctcagtataaaaaaacatagcaaggctaccggaaatgtttaaaagccagggttagggaagattattctggactaatgctcttgttggtgaccaaaaacaacatgcagtggaacggcatgcacgttagagggcaagttgattagtaggaatcagacaagtttggggaaaaaaagaaaagatttgtttaaaatatcataggttagctttccttggttagttatttcaatcaatatttgcctggcatacaactagtctcatacctgctagcataatgttcaatgcgtgaatgagtatcatcgtgtgaaagctgaggggacgaggcaggcctataaggcagaaaatgtgattagtcacagataccatccattaatggagaaaaaacccaccacacagttatgttatacacatggcctagaatgcttttattctaattctatggataatgtatacatttagttgctcctatatcttaaatattatcaagtattttaaaatccaggattgagagatgatttctcatacttctgcttttattaaaagccatgaagagaggccaaaatcttctctggaaaattcccatcgtagaaaaggttgggggagacagtttctaggaagcattttgtcctcctactttgtaatttctcacatcctataattccgaaattgtgttagccctatgtggtttaaaattttaaatagtttacacctgcgccatttataggctatcttcttattggatcaaagctgtatatctgcctagatacttacaattattttagcttcaaagaggctactctagtacaagacttcttaaaactccatgtatcaagatgtcttgatctatgcaattttgtaaagaagaaatgtatcttccaattcagcagcaagactataccactaatttctagcacaaaatagaatgaccctggattatattgtgaggttttaaaaaagaatgactaaatttcatagaacgtcatgatatctgaaatatttcttagagatactgtgtgctaaaacataggtgagaaaataagaggagatcattagcaggaatagtctatatgctttttgtatataaacacctatcttttcttatctccataggctagaattctggtagggttaacattttttcatcctttcatatctgatctattaattatccttgaagtttttatagtatcttttggattaaccttaggaaaaaaaaccatctgttctgaaaaccagtttaggcttggactttttcttttaattggaatagcacaaaaggtctcttccatttctctgctgacacagaaagcccttaggtaaaggcataaatccaaaagtcaacgataatgtaattcagagaggaccctggtttagcccagtgtccaagtagcgttgaaggacttggttgaaacactaaggagaatgtgtttgtttcttcttacattaaaaaagaaaaagatgcagttaccagtagctaagcttgcattagaaaatgtgccagaaattcatatttcttaatatactacagtaagataattacgacacactatagcaaataactagggaaatggaattcttccctgagagagaaaggtcttatttatgaaaccaatgtcatctaggtcaagtgtaatcataatcaaattgaaatgagttataaagacgtttaaattgtcaagaggaaacaaaacgatgactactcaatttaataagcagatccaaagatttccatgtgaaacttcactatagttttggagagttaatctgttaatcttctagaaccctggcatagcccattattagaaaaatgctaaggtctgttttgaaatcttcactgcagatcaagataaattaatacttggattatttgtattataagaactatcttttggaacagaccagtctttcaattacatatttttttaataagcaaaaagcctaccatcagggaaaatacattagtagtgttttcccttgtaatagttgctatcctggaagtgtgtacaagaatgaaagcctaagaccttggagcataagtacaccaagaaaagtaggcatataaatccaaaatactttaataccattttatacagaaaatcttatacagagctttaattctttgcctcaaggataattccatgttatttttcttattaatatcagtggcgcctatcacagcatgcataagcacaagaacttacaataaccagaaatcttaaaaaatatacactaaaagagacatttattaaaccagaaaatgagccaaaagggagtactggtcagagatgaatcatttaaaaaccaagaattagtgaaaatacaaagccacttagtccacaaacaaaactaagtgcaaagccttctaaaacacttccaaaagaaggtaataatactgttccccgcttcccacttcctaaacacaaaaccatatacccagaaggattacttactataagagttaatgacctacttggtcaattccatcccacccaccaccaccttctcttttatgaaaactctattaattaaaagctgacattcatttaggtttcaatgcagaatcgctcaaagaatatcgtttgactggctcacttatggacagacaacgtaaaggcctatgttagctttagttttaaagtaatatgacaaacacaagcaaataagagtttagtctaaggaaaaccaaacggtctgtatctctggaaactttcaaattctgtgatccatatcaaatggatcaaatattgtaatcatcataggatttgttaacattagatacaagtcttgcaaaatgaaacacgttaggacctggctcttatgcctgaataggatggctttgtaatatattttatacagtatttataatcctatgaataaatactttaaatacaattactgctattaaagaaaacacagacttcagtctgctagatttgttttcttcctcaaaattaaaacttcccactatttctgaataatctaaccaactcttcataaaaaggcaaattgggaggtgtgttttagttgttagaaaatatttttaaataaaagatgttattaattttaaagtctttcaacgtttaagacagacaaaatcttctacttaaaataagttaatctgattgtcataatgtttttctcattagcttacgtgtagctcctttttgcctttcaaggactattaattactctttgtttattatttggtgctacttttatctatgtatttgtaacaactgttctttagcatatttgtcgtttggatttcttactcggttaaacttatttccacatagagtaaatccattcccttatcaggatccaatcaagctgaaactgtagtgtatcaactctttaaaagtttcttatttatgaacggttgtaacttctataacagactacctgggttaggaaacacaatttccaagaggcagaggacataactgaacctaaataactccctaagttctttaagcatgatgattaaataaatcagataatatactacttatagctaccatatctcaaaattaaggggcgcaataacgaagttttaaaaaggaaagcatagccttccacttcctttaggcctattaaagactgaaaataaacctcaattaataatatgcatttatcacgacagggtttttaaaaaaggatctagtttagattaaattatatggtggaacaataaaaaagatttaataaaaagaaattgaattcttacacaagcttatcttccgaattggtcatttcccctttatccataacagagctgtctgattttcaataaatattttaataaagcatactttgaaataccaaaagtttgttataacaaccctacataatgtagttttaaaataggcactttgtttgctaatatagaaatcacaggccccaaaaaagagttttctagcattataaactctgagataaatcatctgctggtatctaagctcagtattattaatacacaccaatagtaataacaaagaaatactttcctcctagagcaaatgtataattgtttatgagctgaatatttagcttggagaggagagcaaagtgagtttagttcaaaatttagaaacccttgtatataatgattagtcaaatagcatggcataacctgataaacagtccgcacacctcattaaaattattcaaccaaactcagcatcatactttaaaacgaattctgctgatttttaatagtccacttataacagaccctaaagattctaaaaagcatcgaatctcaagaaatatggctaaagaatgttattatgtaatcagaagcttcttccttgcttttatatgaagaaatatataaacatgtctcccaggaatacagctaaaactccaataacttctttgattataatttgaattcaagccaggatttctgctggtttgaatttcacctggtggaggaaccaaaaaacccactctgattctcctgatctgtgtagatggtactttcaaagtctcatcaagaaaagaaaaaaaaaaactgaaatgaaggaaggggaattaatatgtccataaaacaaaacaaaacaaaagaaaacaaacaaataaacagaacaaaagagaaccaagcgagcgaatgtgttggtggtagcagcacccttcagcaaaaaaagtactcacgcagaatctactggccagaagttgatcagagtaacgggactgcaaaacaaaaaatgaggtggtgaaggagacacacgcaaactcagccgcaaaaaaatttactgaaaggtcaaaataaataaaatccagccaattaagtatgaaccatggaaagcaatagccaaaccaaggtgtaaagtgaattaaaagaaaaacacacagttgtgtgactgccatcagagttaaggcaaaaaagaggagcaggttgaaaagaggtgaagacgtcccctttgatcttgagaatcattactacttactgtgaagtagtttcctgtgactatattttcttttgagtagaaacaagtgactagatatgaccacacaatgagatacaaaaagacacacatttactgatttgtgagagaggaaaatcaaaatgaaatactggaatcactcatttgtaaacagtcccatatttcttataaggcttgtaaggcaattagtggctgtattgtgttgtggtttttttttttttttccccctgtgagataaagtttaacttttggaaaaagaaattgtcaagtgacgtgggaaagtggcaactggacatcagcttatttttctcttttcagctaatgtaaataaaaagaaagaaatagaagagactgtttgcatttgggagtgaaggagggtgttcagctgagaggagttcaaatatacatcaaacaagagtgtgttctgcttttgctactactcacgtttccatgttgtccccctctaagacagtctgcactggcaggtagcccattcggggatgcttcgcaaaataccttttggttcgaaatttgttttttagtaccttggcaaagtctcgaacatcttctcctgatgtagtctaaaagggagatcatggtgagatcagatttaggacaggatgatttcaaaactaatgaccactccagtcttctgccccatgacacttgttttgtaattaaggagagtgttgtggttgtgagcaaaggctttggaatcagacaaatggggctctgaaaccaggcctggcatgtactaatttggctgagttatttacttctcagaggctctgatcatcagtaaaatgggagcaacaacacctcaacacgttgttatgataaataaaagaaacatacaagcttactaggctactcaataaatggtagtttataggtcttaaggtcaaaaaggtgacattaaattttaccacactttatggtattttaaaaactacttagtacaaaatgatagcatgcttcacccactaaatttcggtctattcatagcatggtacattctcaatcactgaccatctctataagaggaataaaagtgagacaggcaaatatctgggaggatcactctgatgatggaagagagagatgctctaaagcagagcttctcatactttgttgtgtatgggaaccagctgcagatctcgctaaaatgtgggttttgatttagagcatcaggagttggggcctgtggtttcacatttctaataaagaccaaggtaatgccaatagacatatgatgattagtcaacagaccgtatcttgaatagcaagcatgcaaagtttagagaagaggagactgtaagaattaaagaaagagaagagaaacacgaagggtggctctacagtcaacagggacaggtttattttagaaaaaacaaacctgagaggagcctgtctttaattcttaggcagatttgtactcaggtctgtctggccaccaagtctacatccttgccatttccctagtgatttttcacagttctattggccacttaacattttcctaaaataacatcttaggagatggcttcaactcttacttatagaaccttgagtaaattatttaacctcaggacctcagggtcctcatctgtatagaggggataaaaatcatagtacttattttacacagggtagtttaaaaggtaaatgcctagcatttagtaagtgttagcatataaaatggatttttaaaatgtcactagtatacaggacagataataggtgagcaacattgattaaaagtggtagtttatgaatttgggggaacctagaaccatcccccatactcaacatgcctcatggccataagatcgccccacacaacctctaaggctgtgcaaaataaacgtgaaaacgtcttcaatacaaccatgcacacagaatgaaaaccctatttattcatccaacaatatttattgagggtctatcatgttccatatgtgccaggcactcccctaggcaccagggatagggtaaatcctgaagcctacagttgagagccactttagctggggaacatctggggaagtgacaaatcacagcattatacatgatctgcagtattgtacaaaactgaaatttatcccaggtgaactaactctcacgtcaggctggcgtcaaacttaccggagtgcaatattccaccatgggatagtgcattttatggccttttgcaactcgaccagaaaaaaagcagctttggcagatgtcataattaaagtgctttagactcctgtacctgataaagagcaaaaacaaacacgtatgtatttcttcgaatcaaattcccaaagaacactctttaataaaccttctaccacgttctaatttgagaaacagaaagcaatgttcattagtcccacaaggtaagtgattaactttctgcctccagatttttccggtgcctctcctacagtaccaaaacattttggcagaaagattatcctataaacatatggaaggagggaagaaaaactcagcttttatttaaactccactaggaactctttgagattaagtaggaaggtactggaaaatttccagtcttttgaaaaccaaatactcaaatttaaaagaacttccaggagcgacagacttacgctgtgcatgccccttacccatcatgggacaaaagttttctgaagcaattattttcaaaacattgtcaagataaagcaatttcacaagacaaaagaaatgtgaacaagaactttcaattaaaacaagtctcgctttaataatgttttctaattgactgatacgattcatcttcaaacagttactcgaatgaactcttttatctctatctcttcagaaatctctcaccccattacctacaaatgataactgaagccccaagagaacatgaaatttggattagatggaagaatttataatctgtaaatactagttggtacatttcctccattatcagaatgcgatattctttgtttcatactctcctgccttttgctttctcagataagaaccttagccaattcaaataaacatatttcttatgtcacatatggggaagtgggaaggaaagctatcttttttagattccagccatctttcaagagggggacaggaggaatgagaagtgctgggtcctaaaataatataatatgataagggcaaaagaattgaaggtgaaagtgctctttcagatcctccaaggcattcttcttctttattttataaaaatttcccttgtatacaaagcccactagctaaggaagcagagaaaaggtagcttagaaatctaatgcagtcactgtggcttcccttccccactccccacccccatggtatcatttttacctgccaagaaaccgggaaggaaagaaggtgacctttgcaagcagtacctactcactgttgtctatctaggcttcagaaacctctaaaagtttttgtaaaacctctttgtaaacagcatgactatggaacaataaacaccaaaagtaaaaaagcactatgaataaaaagcacgcaacagtacaaggtagttattagaaaataaagtaacaaaaccagttcacacgtaactggaaaagagtgtttactttgctgctaagtggattctgcacaggcatagaccatagagctagtttacaactttgtggcttattcatcactatagaaaccttgatgttgattcacacatttaaggacatcgcagtttcagaattaggatttaggattaatgttaagtgagattaattcatttaaaaaaaaatcctgtctccccaaacaggtcagcagggctaaagatttatttggccttgttttccatgatattttaagactatcagaataacctgctacgtttcctatctctttcacttctaaatgtataaggactggttgttttttagctgctttgtgaatcttccatttacttgcctactttttattcctttagaagttcactgggatactatacaaagaatgtaatcagattcacagataaagaagcaagttctaagatgctgaaaacaattcttgttacttaagggagaaaaaaaaatggtgcaaagtgaatgagagactgagctactattatggttcctcccagaatagaatcatctctcagttttataactgattcttgggaagtttctataaacaggaaagaccgtgaaaaaggaaagatggtaaaaatgttttggttccaggaaggaggaggtacagttcatctgtaatacctccgtgaagacacgcactttggcctgctcaaccaaaaatgtggctccgaagagctgaagagtgaaggtggtaagggacaccagcctaataagtgagatccaccaaaataacctagcgatcaggagggtgacaggaatgatcgatgttccagcccaatcaccttctctcccactttggagacggtacgaactaacagcaactggcacaggagataaaagatcaagtcataaaaaggtgaaaaatgatgagaaaaaaatgacattttttttttggttcctaatacctgaatccaatgattggacactctttgcagatgttacatttggcctgatgcttggcagtttctgcagcagccactctgtgcaggacgggcagccacaccatggactggggttccagtctcatccagtctaggaagagggccgcttcgatctctggcttattattagcctgcaaagacaggagggagagagaaggagggcaaaaggatgaaaggaaagaaggcaagatggcaaaggaggtgtatatcagttcgattaataagttaaacagaaaagatagaaagaacaatggttgcaaagctaggctggcttttcacagcttgtttctgcaaatgctccctgatatccaaagagctacccactcctaaggctttggtaaactgccattactctttttggctactagatgacaagaaaagaaaacaaaaccaacaaacgagaaaggtaagcaaactacacacctgagcgagactttatttagctttaatttttgaactgatacataaaagttagccagaagtgaaatgcaggtgtttactgataaaatttcaaaggagggggacaactgatttttttttctagagaatctgtttctcatagaatcataatgaggggctttaaaattcatctggttccaaagcctcatctaacagacaagcaaactgattttgtagaccagaaaaggagcttttcaaaggccatacagctagcagcagagctgataatagaatccaaacctcctggcttagcgctgttttcatgatgccctgttgattctgtctgcctctctatttctctctctttcaaagtctaaatgtaagaaatacaattcatcccagacaggacaatgatctcaacaatctcaaaataccaccatttgatttatatgttactatattcatgaattttaattataccttgtttttttcaaccctataggattgttttaattttttatattattagatagattgacctatatattgactacttttttgctcttcattgctttctttcatctcaaatcttccatctgggattagttctgcctgaaatatgtcccttagaatttcctttagctgttggtggtgcatttctcaagctctgtttgtctgaaaatacctcctttttttaaaaaaaaaatccatattcctgatagttatcttcattaaatacaattttttttttttttgagactgactctatctctattgcccaggctggagtgcagtggcgtgatctcggctcctgcaatctccgcctcctgggttcaagtgattctcatgcctcagcctcccaagtagctgggaccatgggcacacgccaccccacccggctactttttgtatttttagtagagatggggtttcaccatgttgactaggcaggtctcgaactcctgacttaaaatgatccacccgcctcggcctcccaaagtgctgggataacaggcgtgagccactgcgcctggcccaagtataaaatttttgattgaaaggttttggggtcttgtttttattttgtttttgaatactgaaatattactccactttcgtctatctctgttgctgctgagaagtcaatagtaaagatgactgttgctcctttgcaaaaaacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgcccaacaatgatagactggattaagaaaatgtggcacatatacaccatggaatactatgcagccataaaaaaggatgagttcatgtcctttgtagggacatggatgaaattggaaatcatcattctcagtaaactatcgcaaggacaaaaaaccaaacaccgcatgttctcactcataggtgggaatggaacaatgagaacacatggacataggaaggggaacatcacactctggggactgttgtggggtggggggaggggggagggatagcattaggagatatacctaatgctagatgacgagttagtgggtgcagcacaccagcatggcacatgtatacatatgtaactaacctgcacattgtgcacatgtaccctaaaacttaaagtataataaaaataaaataaaaaaaataaagataatctatctgttttctatcttgtgctgtttctaggatttgatttagactgcttaggattcactggacttcttaaacctgtgatttagagtctttaatcagctgtggaatcttctccgtcattctctcaacaaatagtgcctcttctccattccctctccattctactttcagaactctgttacataaatgttactcttcttcaatctatatttctctgaacaggacttccctagttcccccctctctgccccacatctttttaaaacatccttctgtgcttcattcttattaattccttctgccttactgtctgggtatccatttctcttgccggtctgctgtaaacccatacagttttaaattttgattattgtacttttgacatctagaaatactacttggtcatttttaaggtaacttctcaggtttgtggttccctgtagatatttttcaatgttgttttttatttttctaactgcataaacacaattaagaaaataatctgtctaataattctggaatatgatgttatcgtaggtctgcttctatggtttgctatttcttctggttctcattcaccttgatttctttctttttccaccttgatttcttgtgtgcttaatatgttttttgttttttttttttaccacgtactaaactgaccttaccaatattttctagagataaataaaagcttgagcctagaataaaagtgctttctccagagatgattctcctttgcttttgccaagaaccaagaagcattacttattccacagccaatttcagttgaatatatgacatgggaatacttagtatcacacaagtcatgggtatttgagctgcaaagccaagttgcttctcttgtaatgtggtttcctaataaaggacatatccacatttcagatagaaaggcaggagggtttagactgacaggtcatttggcttataacactgatcacctcaacagcactccagtcattacccctaattctaaatttagcaacactataataaactgtttaactttggatttcctagctgcaaaatggtatcagttcaaacttccgatcaaatgctactgtttaccaaagacctagaatcaatctaaatgcccaccaatggaagactgaataaagaaaacgtggtacatatacaccctggaatactccggagccagaaaaaagaatgagatcatgttctttgcaggaacatggatggagctggaggccattatccttagcaaactaatgcaggaacagaaaaccaagtattgcatgttttcacttataagtgggagttaaatgatgagaacacatgggcagatagaggggaaaaacacacactgtggcttatcagaggatggagggtgggaggagggagaagatcaggaaaataactaatgggtattaggcttaatacttgggtgacaaaataatctgtacaacaaacccccatgacacaagtttacctcataagaaacctagacaggtacccctgaacttacaagttaaattttaaaaagctgttgctgagcacttttctctgtgtagagttccatcacagaggtactttgtggaaaaaaaagtttataaagaattatgcaatctaaaaatgaaaaagatcatgcaagtccattcatccttttggcatggcaccacagagctgtaagactttcaggattcactgagtccaaactcagcattcatcgagtccaaactcttacccatgccagtgtgtgcttacagccactacaccacccatgtgagagagctgggaaacatccttagaaggtgatcctgaacacctgtgtccagatacccctgtcaaaagtgctgcatcacattgagctgaaatccatcagcacagcatatagaagttccagagttaaaccactggagttcaccactcactggctgtgtgaccttaggaaaataactttatctctctgtgtcttactttttctctgctacaaactggaaatattaatagtgcctacctcatagagttattttatgattacgtgagtcagcaaatgaaaggcaattggaaccgtgtctgacacatagcaagaatcatgtttgctattgttattgtcattattattatccatctgaccagcaacccagaagttcttggtctttgaacagccctttaaatattttaccagagctgtcttatctgtccatgcctcttcattcctattctttttacttcttcttcatatgacacggcttagtttgccattgtcatttagaaaactattcttcaaatatgattgcggagaatgtacctctatttctccagacagtgtaactggattactttcttttgttctgtaccgtaggctcacacacggttcctactcaactaaaatctctgagtcagtgtttcccagtatgtccagcagatcaatcgtccagcaaaatgcttcacgagaaggtcaaattaatgaaagaaacagtgcacattatatctgcctcttaaaattcttagagcacgttaacatattaaaagctgagaaggtcatcagtaaagcaacatgttaatcagctctggaatcttcccagattctcagagagagagagagagagagagagagagagagagagagagagagagagagagagagagagagagagagagaacaagcaagagtgacttctgaaggggcgatttaataacagttttcaattatgtgaatggctctcgcataggggcctgtgaccagctgttcgatctctccactgaggacagaacaagaagaaacagacttaagcagcatgaagaatttaggctgtagctcatatggaagaatttcctgatgctgaaagttgttaaagcattagtgtgaattaccaagggaggctgtagaatgttctactctttcaaaaaactatagattcttctatgcttaaaggttgaacattctcaaatttctagcccctaagatgcaagatccatcatgttggctcttttaaaactgctcacctacgccaactgacagactgaagacaaggtacggggattcacgttctcattctgtttcaatctttcatttttatgacaaactactctgtatcctagtggtatattccctctccttttgtctggcaatgaagaaggaaagaattaaaagccaggcaagcttctgtaaagacctaacagaactagaattaaacccagctaaaattacatttcgatcattccagaaaaaaatatatagggatagattggaatagcaggaagttattaaggtcaaaagataagtatgatggcattcactggactgagataatctttgtaagtaccattatttgttgagatacatataagtctcagatataatcccctctcagtatcaagggtgaccttgtcctcatctctaaacaccagtttcaagccatgcaagcaaaatctcttggaaaggtcatttagccctgggttttgttttgtttgttggctttgttttgcttttgctgttgttttggcaataactccattttccccttctatgtcatgcacacacagaaagcaaagctatcacagctccttccattatgatggtcacagtttggaattatgttgggtttctcctctttttctgttggtcctcacctgccagcaactatccataacagaaaagctaggggaaggaatcagttgtcattactattgctctgttacagcacactggagggtggcttcatacaaatatcacctttatacaaatataacaaggtacacagacaaagaattctcaatatctggaatttctagcaaaccgatttacctatcaatataataagtttaaaagggcattacatggcaagtttggaggtaggagagttgctggggttccgaagaacttttggatttctttgatgttgtgctttctataaatccttggacactgaagggccaaccgcctgccaggaggtccacctgaatactcatttttctctcaaggtaataaaatcaattcatggctacagaagaaatgcaattaagtatttctcagcaagccctgcatcccagctaccatgaacacgtacattgtattttttaggagaaggcaattggcatttcaattgtgaggtttgtgaaaaccatgtgaacacttaataaactacaataattagtacagtcatccctcagtatatgctaggggttgcttcctggcccgccgcagccccactcccacggggattttgctgttgagatacagcaaaatccacgcatacgcaagtcccacagtaggcccagctgaacgcatatccgcaggtttcacatctcttgagtactgcattttcgatacgcatttggttgaaaacgatccacttataagtggacccacacagttcaaatctatgtttttcaagggtcaactctatatagagaagtaaacattgggcaagagactgtgcccagtaattctcagataacaagaaaccaccatcctggaaacaatacagaacgatacctccttaatttctttcctaaattgcagattaattaaagacaggaactatacttctggagtctctgttaaaatctgctgaattgaacagtgggtgggaattcaactgcaatatgatcgcaagaaataaaaggaagattataaaatctgtatgaagtcagaattttaaaaagctgcctagtcatcctgaagagcaaaaacatacacttgtaaagattttataaagagcagaagacaaaataagttactttctcaaactgtccaaaatttcctttatcgattacagtaaatgtccttgtgttggtttctatgtgatggtatcacacataaaaggctaacagacttcatctggacttagaaggtatgtacagaatgatctggcttaaaatataggtatacacaaaattcacacttggggcccttgaaaggaactgcacaggcagatagcttttctctaggtcggtggttctcaaccggaaatgatgccgtaccccagaggaaatataacaatgtttggagtgtcgaccaaaaaacatcagagaaaaacatcgccaaatatgttaaatttattttggaattagaaatgaggattacaacccaagatgcatctgaagaggagactgtagagggaaacttttattggtaaaaacagaagtttacataagctgcttggaaacatagttcgtttcagatgctcaacgccagaactggtgtcagtttattagtggggatgccattactgggcagatgttcttttgagagcatattacgtgcactgctgcagtcctaacagaggaatttcttgtggggcgattttagaaagtccttgagacagtctttatctcaggcatgtaaccatgaaccctcctcctttcatgctgccctggctctagttagtttgggactgacaaaaagtgatttcatcctggtatcttttacgggagacatttttggttgtcacaactgggcgggggggggggggggggggggagggggagggcggggagggggtgctactagcatttagtagatagaggccaggattctgcaaaacatccagcagcacacagggcagcttcccacaacaaagaactagaatgattcgggccaaagcatcagtagcaccaaggttgagaaaccctgccccaatgttaacatcttacataaccatatggttcacttgtcaaaactaagaaatccacattgattcatcactattcactaaacaacagacttccctgagagtcctgcaagggcatttaataagccggcaactatcctctacaacacagaaactgggaggctaccataggcctattcaactgccgaaatgccacactcgttcataaactgagggtagagagagcaaaagggaaattaaaagccccaaactagaagtcacaaggaaacacgctaaaattgtagactcagatttgaaatcaagttgcttctcaaactgacaactctatgcagtgtattccaggataaacagttgcagaaatttatttatttaatcatggcagataattatcccaagcaaggtaaagcaggtctgctagtacaatgtgtatgtgtgtgtgtgtgtgtgtgtgttttgattttacttagtacaggtcataaccatttagagaaaaaataagaactaaatatgcaaatattaaatacatacatatccataaatagaattcctaaacatttttattgacagaaaaaggtaaatttatggaaaacattgtgggcaaaccacagatttttaaaaagggtaatctctcctttgtggctgatatggtttggctgtgtccccacccaaatctcatcttgaattataactcccacaattcccacatgtcgtgggaggagcctggtgggaggtgattgacttatgggggttggtctttcctgcgccgttctcgtgatagtgaatgagtctcacactatctgatggttttaaaaacgggagtttctctgcacaagctctttttttgcctgctgccatccaggtaagttgtgacttgctcctccttgccttctgccatgattgtgaggcctccccagccacgtggaactgttaagtccaatgaccctctctcttttgtaaattgccccatctcaggtatgtctttatcagcagcgtgaaaacggactaatacagtggccattttcatttgctattttcattagtaacatgttcccttcataaatccaaaaaatcatttcaatgtcattgccattgttaataggtattggcattaatagctgacaactcaacttttctagccctcgttataaaaagccttagcatttggaaagatttgctgaatttaaatttataaaaactgttttttgaattacagtctgtacacaaagatttaaaactacaaggagaacggttagtcagggtcagacagtataggacaggcagtccctgactgttccctgatctgttattacaatttctttaacaacctctaaatctaccaagggcatcagtggaatattttacataagagagaagtctgcaccagcagagaacataaaaggaggaacaagaacaagctgtaaagaatattaatgactcttcttccaaacaatcccaatttttatgaaaatcaaatgagtgataaaaagactctataaaactatacaaaacctgcatgtaacaaataaaacagaaggaaggtgacattttgatcctcttagacacaagatacttgggttttacctttgagttactgaggaaactatagtgtacggacgcaagggatcatttacatgaggttgtacacaatggtttttcacatcttgctcttagtgtgtgtttccattcagagaacacttggtctcatgtgaaatgccacactctatgtacaagactgttttctatatcttatagctctgatacaagagttgttacccggaagatcaggtaagactttgctgatcatggccaagctttgaaataagtacaataatccatttccctttcggcctttataacatttagcatagaatcaaagacacttagggataagtaacttttgagataacctgttttaactttatgttacagataagaaaaggcccaaagaggttaaggaaacagcttaagattatctacgattttaatactgaaatatatgcttaaaatagtcttaaaaagacaggacaaaagtgatttcctatgggaaaaagcaaggcgatccccaaaatcttttgaatctttaatttgtttgaaagtactagagtctgatagctaagtaagcaaggcccacttaggacaatttccaggtgaatataaatcttcaactgaattatatgccgataacatggctgcgagagccaatggaaggtgcaagtgaataccccacaacactgataaatgcatacttatatctcatctgatcaactcctttcccccttcttttcagcattacatgtccctcgtaccattagatgctacggcatgtatgagctacctggactgacaggtgcgggtccatatatattgaagtggcaaaaaggaaaaaaaagaaacaaaactctatgagcttctcaattcagcacagttttcatgttacgtgttttaattatgtcaatgtgttgttcccataaaaggattggttaatatggaaatgtatttattagacatctgtttatgtggctctctggagaaaggactttcaattccatacactgccattttaaacaattccaagacaaaaatagtatccaatggcagttcagtaaagagagatatcattctttgtacactcagaaccaccttggatgtccacagtgatattcatgaatagacgggggagaggtagaagctcttctttacataagaaaatggtctaatacatgcagaaagtatggtagaattagaaagccaccattatgcaaccaccaatattataactgaattagacaaggatcatccataaatgctaaaaccatagggtaaaaggttaaggaatggatattataatatgtcaaaatatcaaaaaattactttctcattacaaagggaaaaggatattttacaaggaaagtatcttgtagacaccaccttaacattcttagtgataccaataggaacaaaatgttattttgttcctccagattgtgatacagtggtaggtacagagcatcatcttatcgtcttttggccaaaaaatgttaacattaatctaatcacaaggaaaccatcagaaaagcccagagtatgggacattcttcaagagaactggtctgaactcttcaaaaatgtcaacgtcagcccggcgtggtggctgatacctgtaattccagtactttgggaggccgaggcaggtggatcacctgaggtcaggagttcaagaccagcctggccaacgtggtgaaaccctgtctctactaaaaatacaaaaatcagccgggtgtggtggtgcatgcctgtaatcccagctactcctgaggctgaggtggagagtcacatgaactcgggaagcagaggttgcagtgagccgagattgcgccactgcactccagcctgggtgacagagcgagactctgtccccctaccaaaaaagtcaatgtcatgaaaggaaaacaaaatgctgggagactgttcaaaactaaatgaaggtacagagacatgacagacaaaaaccttgactagatgctggaagaaaacagtggctataaggaacaattctggggcactggggaaagttcagtgtggactgcatatcagagggtattgctggattgctgttaaatttgtgtgtaacgatagcattgcagttatgttagagaatgtcatcctttaagaaaatggtgtatggtgaagtgtttaggggtttatgttgtgatgctcctttacttttaaatggcataggggaaaatgtgtttgtgtgtgtatgtacacagacagacacatacataaacagagctgagagggtggaggaggtaagtagagcgaaaagcaaccatggattgaacagatgtatgacacagatgagtgttctttagactatcctttcaactactctttgtgcttgaaatgtttccaaaataaaacgttggttggaaaccgttatttctcccaagtcaccccttcatgggaataggttgtgggcaaggcaggagggtgggcaagagtgattttagtaactgtgaaagggacaggacaatggtattaatgtcaatagtaatgagtgtgaaaagttccccaggattcgttttctctaaaaatacaaacctaacgcaaaattgatttccttcctgtccttgtcacggttcttaaagcatctcctcatcgactctgcctagatgtgcttttcctagatccctaaatgtgaatctccaggcatgaaaatgagtttaagagtccccacatgcgcagaagcagaactttttgtttaaggattgagaggtcaagagttgtctttgtgagacaagaagaagtaaaaggcttcccataactaccatcttgggtagaaatcaagtattttatttaaagttctgaagataatgagcaggtaggaggccagcagtcactgctctaaatattaatcaggactctgaatcacccattaaagataaaatcagcccaaacaataacacatggtgattatccactcttcatttccatgttcaaggacaactgtcctgacctcaggctctgcactccacctgactaataaaccaattaacgccatggccctagggaacatatgcacaattttaaatctatgcaaatccctaagtatactcaacagtattaatttatgctaccgagttctaatttaacaggaaagttaaattagaaaagtttcacatatacatggtaaagcacatatatctgtctataggtaccatggaatatactttcccaagtgtggatcagggcgcattatgtaaaagaacaagatataaagttagctcttccactactgcctcctacaatcctttaaaatccagttcaggaaaaggcaaaattacaggaacagaaaacagagctgtggtttccagagattgggacttagtgagatgatacagcatgatggaattttaggggtgatagaaatggaaggaagaaaggaaggaaggagggaaggagaaggggacagagagagggagggagggagagagagagaacgaaagaaaagagaaaagaaagaaagaaaggaaaggagaggagaggaaaggaagagaggcgggagggagggcaggaaggaaggaaggaaaagacagggtgagaggaaggaaggaagaaagaaagatttggtcataacaatgaagtgctactttagaaggatgaagatggaaaacaaaatgacatgtgcttttccttagcagtaagtgtataaacaaaacaggtttcaactacaacacaaacctatcttcaaaattctggtgaagaaaacatccattactccaatagagaagttaatcaaacaaaccacttaaacagatcatcataaagcttaacccacggtagcttaaaatttttaaaaataacaactggaaaccaatattaaacttaagacaatactgataatactctgataagggtcttttctgaaaattgcaggaattttaactaactgttcatgagcaggcccagtaagaggtcggtgatatctctcagcttttcatggcagccagctatctctatggaaggctgattggactattagggtctaccttcaattctgggaaaggccacctctttataaataccaaattgtagtaactcttactaattacttagttactagtgagtattcatccgtccaaaaggggtgtaaaaggaatgtctatggaaccaaagggcccacagtctgattaatacacaaaaagccaaaggaaacctaagtgaaggagggtttttaggagttactttcaggatggaaaatctattaataaaatggaatcggccaggtgtgatggctcatgcctgtaatcccagcactttgggaggctgaggtgggcggatcacaaggtcaagagattgagaccatcctggccaacatggtgaaaccttctctattaaaaatacaaaaattagctgggcgtggtggcacgtgcctgtagtcccagctacttgggaggctgaggcaggagaatcacttgaacctgggaggtggaggttgcagtgtgccgagatggcaccactggactccagcctggcaacagagcgagactctgtctcaaaaaaaaaaaaaaaaaaaaaaaaaaaaaaaaaaaaaaaaaaaaaaaagtaatcagttgacccggggaatgctgtctaaccagccaaaagtctcctgatatggcattttaacatttgcagagaaacagaatctccagaatctctaaaatgcaatccacagatgatgttttgttatagataaaagcaactgttaacattggcaggatattttcatgccacaacacactttagataatcatagctaacattcactgggcaccttctatgtatccactacagctcttaagtgctttgcttctattggttcatttaatcctcacaatcacctccaggagttcaggggccaggaaggttaagaaatgtgtccacagtcacacagccagcaaatagcagagctcagatttggactcaggcacagttcggtttcaaagcctatgcacttaaccactctgccagtcacttctccagatattctggaatgctttctcatttatgtgttactgatcctcccacctcagtctcctgagtagctgggactacaggggcatgccaccatgcatggcaacaataatacattgtatatttcaaaataactaaaagagtagaattgggaatgtttctaacacagagaaatacttgttctcaacagttgagactgtaatttattctcattttcatatcattctacattattacaacaactgtgcatagatggtattcatttttgtcatacaaatagagaaattcagaagatagatggaaaagcaacttactcatttggaatactaagtacaacaggaggcagaaaacagatgtaaaataaacagattttgacactccagctctcataggtgaagcatattgaatataaagttggtatacttgacgttatctaaacaataaagtccttaaaatgtttactgaagaagatactacaaaatcgaaaccacaaaaagatatctgcactcccatgttgactgcagcattgttcacaatagccaagatatagaatcaacctaagcgcccatcagtggatgaatgcataaagaaaatgtactataaacacataatggaatattattcagccataaaaaatgaaatcccattatttgcagcaacatgtacggaaccggaagacgttatgttgagatcagccacacacagaaagacaagtatcccatgttctcactcatgtgtgggagctaaaaaaaaaaaaaaaaaaaaaaattgaactcatggagatagagtaaaatcatgactaccagagtctgggaaatgtagtgaagatcgggggataaaaaagggatggttaatgggtacaaaaatacagtaagaagaaatatgatctagtgtttggtagcacaataaggccactatagtaatcaatatatttttaaatctttttacagatagggtctcactatgctgtccatgttggagtgtagtgactattcacaggtgcaattgttgtgcattacagccttgaattcctgggcgcaagtgatcctcccacctcagcctcctgaaacgctggtcctacaggtgcgtgctaccatgcatggcaacaataatttattgtatatttcaaaataactaaaagagtgaaatgggaatgttcctaccagagaaatgatgaatgtttgagatgatggacaccccaattactctgattgtgttaccctacacattgtatgcttgtatcaaaatatcacatgtaacccataaatgagtactattatgtgtccataataattaaaaatattttaaaacatacttttttacctgttaaatgactggcagtgcaggtttgtgaaataattcttcgtgctatgatgttacaatggctacagtgtcacaaagtaatgcgaatttttcagttccattataatctcttcttacgttgatcttatgggaccaccatagtatatatggcctgtcattgaccaaaacgtcattcttcagcacatgactgtatagttttcccacctaaaagtgatacttggttttatctgaagatagactaaacagctatgttgggattagagtattttcaataaagatgggtgtgtgtgcatgtatgtgttttgggggaggggtgtttatttatctatctcattctattacaatctaaaattcatataggggatcacattgacacattaacactctgtcatttcaatctagtctccgaactggttgaagccataacatgatgtaaattgcacgatgtagactagattcattgtgccactgtgggcctgttttctcatctgaaaaaggagaggtgcagaaaatcctcaaggttccttcaggcagtctatgtgactcactgccagggcaggcttggccttactaaggtcgtaaaaatcaatctaatctctcaacagggctgtttccatggaatatgagaaaggaacaagctggcaatatattaattacagctgtatctcttaaactcgttgcaaaactttacttctatcactaccaaaatgagtcaatttcccagtaaatgtgttgactgcaatatgctattaatgtggaaacatatcctgttgcctcatttagtatctacgaagataccactgtcaaagccataaatttacagtgactattcctttttcatatccatggatgtgacttcatttcctggcttaatggataattccttggaagacctatagtgatttttaaataagcaaaattttacatttagacctgataggtgatttccttttctaagtggttagtggggagggatatgagaaaacctttaatagataatccagagagtgtggcacacaaacacgtacctctcttcttgccactactgggcccttgtctgaatcagaagattcagtacctttctaactgtaccaacctgaaacaaagtaaggtttccaggtggtgacaagaaatcaaaggaaatcaaatctgcaatgcaaggaatgcacttgtaggataaacaagtactttattaccgtttacctcaggctggtagaaatagcagcctttgagcacaagcttgctgaaggaaccagcccagcctcattctgaaggtcctatacttcaaacaaagggcagaggacattttcactcctgttatctttccctacagcaaacattgtatttttatgcacgtggcacaatgaaaggcaaggtgaccgccagtgcacctggccgaggaaaagcatgccagggccaggacgtggattcctaagtattcctaagtatttacaatggatccattcaacctgattgcaaattgctaaaacgctgagaggctccccaaatctaagtaatgaaagcctcgccatacatatggaatttactagcatctgattagaaatactacatttgccagcacttcaaactaattcctcttccccctcaagggtcccctgtcttgttataccttttcttattctatccaggactcaggaaaagtagctgttgtttggccttgggaagctggagagcagaagtatcagaaactacatatttgggaatgaggtagtaaatgtggcggtgggcatactggactaggaatcaaacccttccaccagctgagggactttaagggcgcaaataaattattcatccacttaaacaataataaaagcaaaatctccaaagcctgactattctgttcccctcaaagacttggtgaggattaaatgagagaattcatgtgaacaaagttttgttagtagcaatggtaacaatattatttataagcataataggtacaaatggtaaggagaagctgtttcatgatagtgaaagcaaactatgggtggttatgaaaccagagtaggaaaggtctgagagttaaatagaggaattaggatttgttcactagacaacagaaagatactgacattttcaaggacggcatcatatgggaaatgcttttctctaaaactagtatgagggcaataagaccaatgaaaaggactggagtgtgaagtggaggcttgctaggaagccagtgcaatgatgagaaggcctggaaacaatgtaagaatggcaatggaaagcaatcaaacaaaacatgtttctttccctaaaaaaagaggcagcactttactaattttttttctaattataaatgttcaaagaagaaaactcagaaaataaaaatagtacagagaaaatcaaaagccacctgttaccaccattcatatcttgactgatttccccccagtctcatagaaaacatttcaaggctggatgccgtggctcacgcctgtactcccaacattttgggaggctgaggtgggtggacagcttgagcccaagagctcgagaccagcctaggcaacatggcgagagaccctgtacacacacacacacacacacacacacacacacacacacacgcacacacacacacatacaccaaaaaaatgccaggcgtggcggtccatgcctgtagtcccagctactcaggaggctgaggtgggaggatcacttgagcccagaggtcgaggctgcaatgagctgtgatcgtgccactgcactccagcctgggtgacgaagttagaccccttctgaaaacaaaacaaaacacatttcacatttcaaagagcttggagactggctggccaaccaggaggcattcaacaaatatgcaaggatggactgaattcaaagctttgagactgagaatacagagttgttattacagagacagaaatgtaaccaaaccagagacatgggcttaggggagtaggaggttatccagcaaaaggatgtagcaggcagaaatggaataggttggtctcctgataaggggggcagcccagggaaagcagagcttctgtatggccaccgcttatcctgacaaccaaatccaagagggccagaggctgcagtgaggatggtggtggcttcctgatgagtcagtactcgggcgagaaaacaaagaatccagctggccctgaatacagcctagtttactttgcagcagggaccatcactgagccttacctttaacccaagtcacaatgcacacacatatgtttatatatccctatatatgaacacgtgtgtgtgtttcactagaactcaaagagtaactgagacttgactaaaggggaaaaatgattaggacctgtaatcccagcactttgggaggccgaggcaggtggattgcttgagatcaggagtttgagctcagcctggccaacatggtgaaaccctgtctccacaaaaaattagccaggcatggtggcaggcaccctgtaatcccagctactcgggaggctgaggcatgacaattgcttgaaccagggaggcggaggttgcagtgagccgagatcgcgccattgcactccagcctgggcgacagagggagactccatctcaaaacaaaacaaaacaaaaaaaacacacaaccaaaagattaggaaataactcgcgtttatggcaagttgttttataattggattttaaaaaatcaaaatgaacctagattgcctgtggccattaatattcattgtatggaagttacttgtgtctacattttgatgattgattggattgatcatctatctgcattttggaaggtttgggtatgaggaggaaaagatatttatttctccacatgcattttacatttacaactaatttgccataattttggcaaaataattcaaacagtatatcccactttacataaatgaacttattatgtgtgcatccggtaaatctatccaactaactattaaataaatactcaaactgctttaaacacctaaatattcacagtgatctgcccaggaaaccttctatagtttcatcctagtctgtggtcaaagacttcagatataacccagttagttctacagctagttccattttgtaaatctcagccattgttaatagaattagaatggattgagaaaccctacataagaaaaacagctcttagcacttgaaaaaaccaaaaacaaaaacataagaacactgtgaataatgtgataccgaaagcatcttactccttcaatactgatagcgttacaattagaacaacttttgaagaaaggccacaaaaaatgtttatattattttgtctggcaatcacacgcctgagaattgatcctataaagaaagcttcaaagacaaaagctaaacgataaggatgttcattgtagcactatctacctaataaaaattagaggccaggcacggtggcttacgcctgtaatccgagcactttgggagttcgaggcaggtggatcacctgaggtcaggagtttgagaccagcctggccaacctggtgaaaccctgtctctactaaaaatacaaaaattagcttggggtggcggtgggcgcctgtaatcccagctactcgggaggctgaggtagcagaatcacttgaacccgggaggtggaggttgcagtgagcagagatctcaccactgcactccagcctgggtgacagagcgagactgcaactcaaaaaagaaaaaaaaaaaaaaaaggaaagagaaaaaaaaattagaacaagatgaatgtctaccagtggagtgctcaggcatttgggaagaagagggtgtttctggggcactgactacgacagagaaaaagcaatgggacaggataggaaagagaacggacaagagtgtgttcagtcagtgatggacattagcagagagtatacacctctagactttggaataataggggaatgtcaaagctacaaaggacagttttaaaaaaaaggacagctgtgctaacaatttaccaacagccattgaaaggaggctataatgatagaattagagaaaggactcagagactaagagactcgcctacaaaggccattttcttatatacataggatttctgtggctagagacttatttcctcccttgctgaacttcttcccctctagcacctcaataactgtggggtccctgctgcagatggagatttcttttccttcctcagcactgtcttctttcccaaaacctagagttccagaagctgcttacttacagaggttccaaatatcccaaatcccatacctactgcctactgaagagctaatatgagaaaacgaagctctgtgggttttttaattaatttctaaaatatgaaagaataaatatgttacctagaaggtgaataacttacaaattggaagcagctccggacacttggctcaatgttactgcccccaaaggatgcaacttcacccaactgtcttggaatttggatagaatcatgcagaaggaggcccagcctgcgctggtcacaaaatcctgttgaacttgccacttgcttgaaaaggtctacaaaggaagaagaaaattgcaacagtcaaaacacagcacccatggatgccagcagaacctgacatccaactcaattccagtagcaattctcaagagtagccagtatttccacagagtggggttacttctaatttgtgctaatctggatatttattatttttatgaatcaagttaatgatcactgtatatatatgaagtgtgataacttttacataaactgtgtcactgcaagaagcgcaagcttacacgtaccctcgacacttaaatttcttctaagccagaacataatccttgggaattattgtatataggatgtaactacatcaaaaaataagtgttttagcattaagagacatataactggcccaaagcaccaccctccttggacaccagagattcaaaaatgtaccacagttgggacttctttatggagtcataagatcactgagcttctagtccatcatgtatgtgttcccacaggatactgtgcatagtttgttgttgttgttgttgttttttgagacggagtcttgctctgtcgcccaggctgcagtgcagtggtgcgatctctgctcaccgcaacctctgcctcccgggttcaagccattctcctgcctcagccgcctgagtagctgcgattacaggcacatgccatcacacccagctaatttttgtatttttactggagacgtgtttcaccatgatggccaggctggtcttgaactcctgacctcaagtgatcctcctacctcggcctccctaagtgctgggattacaggtgtgagctactgcgcctggctgcgtatttctaattaatagctcacatcatgttatgctggcattgattcaatatgtgtctatcgtttttggcaggagacttatatccccttgagggaaggaaccatatcttggtcagttgtgtgccagaagtatctacagtagaatggcagtacccggtggatagtaggtgcccaatatatgtaacagaatgaatgaacatactgaatgcttgcaatgttatgttttgttctcagatataaaattttaatcataccttatattcacctagaagttgcccctcaaaaaaagtaaatccaagaaagctttctgtacccataagcacactttaaactctaggaaattaaatgttttaacaggatacctaagatggcactaaaaattgagattgtacgcacagctttttatctgctctccgatatacatacctaggtgtttattttcaaagttatgagttactttcaaacatctcattttgcatttaatatttttgtttcaccaacctaaaaacatgttccctcttagtagttattcgaaacaccaactcaaagcttcctcaattattcaatttaatattatatttacaatgtgctgtcactataccatatatacggtagattagaacctaacctatactaagtaactacaatatttaaaggagaaaagcacacaggtatcccatctcatccgaaatacattttaaaatggttaacaaaagctgttcagttatttttctctcgttctgaggatgagaaaactcaagtggaaactacataaaagtgagggccaaaatggtttgtgtattttgtggcttactcctgaaggagaaatgatcagtaggagacagagtggcttttatctcctgcctgtcctgaagcttagcacatctcctcacatgtgtggctaggcctcaggggaagagagaaaagacaagctaggctgaatttgtttaatattcctactgaaaagattgcttataagcatttcaaggggaaaaccaactgcagcctttcacaatatgaatggatggtcacttggtcatctgaaccatcactcctctagcattggcttttaatttggttttacagtttttaagcagaagaacccaatgcgtaatcaaaaggaaattctgtagggtggtacgtatctatcctttaagaaacagcaagctatctgtctctcaaataataaaatgttagtcacgtcacggaattggatgtgtcagtacaacttgcagtaagatgattataaaataaacaatgtttcttgaacatgaatgtcacatggtattctttaaataagaacccaaagactagacaagtgcagagattaaatcttcacacttatttttccgacttacagaaagaggttagaaaatcagactttatcccctaggaacatgtgttttattcagacacagtcaatgtaatgtaaaataatacctggactggaaaagctaatcctcattctctacttaaatgcctgcaatttaatgtttgacaaggaatggcacaaaccaaattttatgacactctaaaagcagttctacatcttacatgaggaatctgctgtcaaataagaacagtctgtcatttcccatctagaactagggtaattagccaacattaataaaagaatacagcattaatatacacgacttacatctgtacttgtcttccaaatgtgctttacacagggaaatgatgccagttttaaaagacaggacacggatcctccctgttcgtcccctattatgaagaatcaaagcagaaaacaattactgaccctttcctagagggtaaacacttctagttaagaataaagccttgaaaaggaaaaataaaggagtaaagtgctcaatgatgtgtgaactctattgaccactgttttattaagattgttttgaacttttccaaattcattatctctttgactgatgacctacaatgcaatggaaattcaaccaacttgaccactgaatgtttaccaagtttcaattcctaaaaacccttatttgaactgcaaaagttctacataaattaagaaaaaaaaattctattcacctatggaaagccaccttggtttaagttggtaagcagaagaattactaatcttcaccaatctactttggttactaaagcaaattacctactttggtcatggaagccaaaaaaattaccagcaactaactgctcagccctcttaaatgctcagatcttcatcagattgccccttattgaaagaaaattaattacttcaggccacataacacataatatagaatataaatgtttatctccgtaagaaaaatatcatactctattaaacaacattcaaatatatgatctaaaaaataaatttataaataacctgttgctatatcagtgttttaatatagattgcttttatttgcatagcattttctatatttgcatatagaaaactgaaataaagcatttcacataacaaatttattaataagctaattttatccatgggggaaaaaaaggaaaaataagaatgaaaagttttccattttgtagaaaatgtctttcaagacatggaatcaatatgaatgcccatcaatgagaaatatggtacatatacactatggaataccatgcagctataaaaaagaatgagatcatgtcttttgaacacggattagctggagactattatccttagcaaactaatgcagaaacagaaaagtaaatactgcatgttctcacttctaagtggaagctaaatgatgagagctcacgaacacaagggaacaacagatactggggtcttgagggtggagggtggaaggagggagaggagcagaaaagacaactgttgggtactgcgcttaacccatttatgctggaggctgcatattactttttgtgaaaatcagaccttggcgatgaccttgagcagtaggataggaataattcccacaagcttagtgttccaataatggaacactaggcataaatgggttaatacctgagtgatgaaataatctgtacaacaaacccccgtgacgtgagtttacctatgtaacagaccttcacataataccccgaaacctaaaattaaagttaaaaagtgtctttcaatagttttttggcttcttattttattacggaaagctactggcccttagatattggtaaaaagaaaaaggagaaaatatttcagaataattcgcctattagcacttcaaaatcacaaaggataggtcccaatggcggttattttcggtgaacaatatgctcaacttccagctactaaaatttattaaatccctcagtcaaaaagaaatcctgggcactaatggactaaacaaattcctatcactggaaaattttcttatctttctccctcttaagaaaaggtagatcaaaatttaacaaatccactttatacagcaactcaggtcttcaaggagttaaaattgtcaccaaatacttttcagtcaggtagaaggaagttatacattcagaatgcattcacatgtcatctgcaaagaaaacagtgccaaaatatatttgaggggaaacctgaatacaaactcttatcaaaactaatgtgaacgtagttcacaattgaaatccgacatgttcaaggacttggtagatgactatgatgaatgtaatagtcaggtggtcctgaaattttaaaaagcaataccttatcaaaataagaaagaaaaaaaggtataaattttagttcaaaaggtagtagaagtctacaacaaaggtaaaaggcaaaacagttgttttgcaactcttttcagaaaaccttcccagatttccaaatgggagtatgttcttgattggtgaaatgaggcatgtaataattttgagatctaagaagaatttaggcaaaattaagaccaattccttctgctcccttcttcaattgtcttcattaagctcaagaaaaaaaaaaatcagaactggggatatctcccttgtgtgcaatccaaaacaaacaattgttctctaagagagagtgatgaatggaggcgccaaactgaaacttcataaaatcttattaaaaaacaaaagaaaacgaaaaatgttctcagtttgagaagctaagtttgctgtattaagggcttgttttcattttgtttggcctatcaattcataatcttctgcaaaagtgtcctaagtatcagctaagaccattctgatctggagacaggtgtgccagtatctccaggagcacagccatggccgccagtgagaggaagccacccctgaagtgcatggaagaattccaaaatccatgggcgagaaagggaaagaaccaaaggctatatgtcgactcattccactatttgcaaaatgagtgtctcagggttttgtttgttttctaatctgagagcaatctacattctggctcttaactcctagcttatcaaaatatttttcaagtcataaatgcaaaaatgatttatcacaggaagagcattaggtccacagcttccagggccctgttgtaatgctaattacacttcaccattctgtacgctaagcctcctgtgacagagcccgggaaataaaaacatgccatacgtacgtatcataaacattcagcagccagttcagacacatatccacgcagagagggacgttgaccaaattgttgtgctcttgctccaggcggtcataaatagtggtcaaacaattaataatctgcaggatatccatgggctggtcattttgcttgaggttgtgctggtccaaggcatcacatgcagctgacaggctcaagagatccactgcaaaaaacaaataaaatcacaaatgactcaaagagtaaaaccttcctttcagtgtcctttttcctctgagaatcctagctaggactctctcataccctttaataaacaccaaacgtgaaccacactctctttgaaaggtgttttatttttatgcctcgactctaagttgatgagtttgatcagtattcaggatctgaagttgttcttaaatctcactggcattgggtgaagatatgggcaaagatataattcccatccttggattactggggaatatctgagagttaaggggacctagcctgttctacataaacagagtcaattgtcacctgaataagaaaaaaaaaatgttttagcagaaatttttaaagagatccgatgatactttcttgtattagcattagagaagatctgttagattaatctgtatggctaaggttgtgtaaactctatttctagctatgcatttataatcattaagcgcttttctccttgaaatatcagtcacctcagcatctctctgctaccctaatattaggtgaaaaaaatactctccactaaaattttctataggcaaactaaagtaattgcataatctatccagttttcagacctgaggctcgcttatttctcctttcaccttcaaattgtatttcataatattctttctaagtcctctaacaactttataaggctgagggaggaaaattcccttgatctgaggaggtgtttaatcttatgctggggacaaaaatttaacaaaagtgaaacttcaaccttgtccaacatcagcaaatcacaagctttattcccaagtgtcatgaaaagatgcatttctctaaagccaatttattagccaaactagaaacacaacaacattgcttttatactaccttatacacctaagctctggttggaattctcagtcctttgaggcaaggaatcaatgctaattaagtaaatctctcatgcatctagggggaaggggcaattcaattataaatgtagttcacataaatagaggtaaatcccgctcagtaaacacctttcccagtaataaagaaatgcaaacttaaggctttagtatattttacaagttattcatggccagttctaattaaatattaagaaaaaaacaaaaatagtggttaatacctatgtaggtttgtgcaaaaatacttttccacctatattgcgcacacatttttctcttttaaaaaaaggaaaacagaaaatcctggagtttccccagaagcatgaaacagacatggtggtggaagcaggagtctgcactcctcccttggaagggaaggcccctctgtttttgctctgaaatactctaaagatagagaaatgacccttttcatggaagctgagactttctttaaagtgggaggaaggaagataacttgggagacttatctgaagaatcaagtgagaaaaataataaagaattttaaaaagcaatgcaaggaggcaggaggacgggaggacgtgaggagggaatggctgaaagaagactgcgtgggaggctggagcgaggtccagagacaaaagactcaaacttttcttctctctctcttctgtgtgcttgttttcctcagagggcacatactcaagtgcacgtagtaggaacacttagaaacacggtatgccagctccattactggaagagaggaatggatttcttccaaacaccaatattcccaacatgtttccttatatactgaaggaagctatgggtggtttgaagtttttcaattattttcttttttgttactctgctttagtcatcataaatattttgcctctgatccaggcatttaagaagtaactagtgaaaatttttcgaatcacttttgtattaagagtcttatttagccgtgtgatggaaatgaacagagaaaaactgcatgcatttcattttatggggcctgctcttatctctgtacaggtgaatgggtaacacatagaacagcaaatgttgagtagaaatagctccagaggggagcaaagcaattgctctgaaattacaggagcagaagatgacacagttaggagagaaatactgtgcagtgtgctctgctaaaactggatgtggttaaacacaagaacaatccatcacagaagactgaagagcacatttccctaaacaaacatgtcaaacagaattcaactttcatggagctattttgaaaaaatttccatttaggtatacacaatccatgctatggacccgaaaaggaggtgagaatatcaatagggacaatttaattgccatgcatatgcttttcaaaatgagcatcttagagaacacacctagactttttgatgaaacattaaatgtaatgattagctctttctaggaccctcaataagcaaccagcagatacagttgtgtgaaaccattgtttccttaagctaggaatttccattaaatatattatatatatatatatatatatgtgtgtgtgtatgtgtgtgtgtgtgtgtgtgtgtttgtgtgtattcactagtagatatatctttaaagctacataaaaacccaagtattctaatacatcttcactttctaaattatgtttacagtagaggatgctataggctttgaagccattgaagaacagggaccatgtggtggtaccctatgcatgagggctgtgggggtgagagagggtggggacaggataaaagaaatggctgactctccaggatcctctttgctgtgcaggaaaagcagacagtggcggttggggggcggcgagcaggcaggacttcaacacagggatcccactaatggttcctgaggctctggttgtgcctaatcatcttctcaaccttctagcttcaaaagctcattcttttcctttctatgtatgccacagtagctaactcttgctattccttcctatgtaagacagattttttttgtcttttacagagtgatagactcttagagccagaaggttgctttaaaatcattttgcagttgagacaactgagaccagagatatggagactcactctgggtgttatggcaggatatctaggttttctgatttctcatggaggtacatattgtaagggggaaaagtgggtggcagaaggtgtccttactgactttacagaacaggaaaaccattctgcattccatgctaatgacaacagtaggataaaacagaagcaccaaaaagttggttagtggagaaaaaaaaagtctcatggtgcccatataaccccaagttcatcctataggtcaatctgtatattctatgttgatgtataaataattctgtgatctaattagcacagaaacagaaagaggtgagtaatggtggaagaactgctgtatgtttgctgatttttcttgcccaggcatgccactctacaggcaacttacacttatggctgagggacctcccaagcaaatctttgcacttcaagaaagtcaatgcactttgatgtagttgtctgtgcagtaagggttaattccagagaggctggagttggcacgagatgacttgctaaaatatctacacagtgcagagccctggtcaaagcacttgcttttcaaagtgacttactgtgttgaagtgtagccatgggttgcaggttatcaccattgtttattgctaacagtaacattgaccatttttacccgggcacagtcagaccaacggaagccactgagtttgaggctggttacataggaacagtatgcctaggttacccacgggatataagaaaccctggctgaaactccaatttgtgctccctggtttccaaggtgttctgtgctcacatcagtagctcttgttccaagagagaaaatgcatcgtggtgtggctcttgcagacagagggcaattatagcttgcacctgtcctctctggaccctatgctgtgaggcaggctgtggctgtgacacttattcttgttttaatgttgtgggtatattgcatcctttttctgcaaggaactctagattcgtaagcactgtcatttggttcctgtgagtcctctttagcaattgaaccctgtttaacttccactgtcagggcagtgagtgtcagaagcaagattgtttagaacacctccaactcattcttagctaaaagtatgactgaggcattatttagaaagaaaaaaagaagattctgataaaagggatgaaaaagaacctttgaagttgctcaacaagctacgcttggttgaaaagtaacacaggctttgaaattggttactgatggtgtaactttctagtggaatctggaagtgagagaacttgaacctaaggagctaacaaaatggattaggaggcaattgcaaactgatggcaaggctgctaaaaaaaaatccaaaagctaatgttaagttcagaatttctttccactgggcttcaccctctctggcctgcaggtggagtcccaaccaaaaagctgaagcaactatcatttttgagaaatgggctacacctgtgagaccagttacaattaaaaagataattcaagtggggcacttacaggtattccctatgtcactacaggtttcttttttgatgccagacctagtagtccctgaactggggctacaattaagagtttcaaaggctggtaatattccaaaataagatactatggctattagttggtacttaagcacaagcattccacaaggatcaatggaatggattactccttccttgtgccttgcctaattgaagctatcacacaaccccatcataggttgaaaatatcttaagtcacaaatgcatttaatacacctaactaactgaaactcacagcttagcctagcctaccttcaatgtgctcccaacacttacatcggcctacagttgggcaaaactgtctagcaacaccttacacagtaaagtgtcagttgtttagcctcatgatcttgtggctgactgggagctgaggttcagtgctgctgcccagcaaggggagagagtatcataccgcatattactagccttggaaaagatcaaaattcaaatctagaagtagagtttctattgaatgcatatcactttgcatcactgtgaaatcaaaaaattgttaagttgaaacttcacaagttggggactgtctgcattgtgtggtgtgtgtgtgtagctggggaagaggtttggcttaaaattaatgataaaaggaaaaaggtgagattgttgcaaggggaaggaaaccaccaaagatacttttttatttcttttttcttttttttttttttttttttttgagaccgagtcttgctctgtcacccaggctggaggacagtggcgcgatctcggctcgctgcaagctccgcctcccaggttcacgccattctcctgcctcagactcccgagtagctgggactacagtcgctcgccatcacgcctggctaattttttgtatttttagtagagatggggtttcaccgtgttagccaggatggcctcgaactcctgacctcgtgatctgcctgcctcggcctcccgaagtgctgggattacaggcgtgagccaccgagcccagccgatacttttttttttttttaaagggaaaacctaatataatgttgctgcctacggagaggtttaaaataagagaataatatgctcccttggcttagactcagatgcctcttggggtgggggactctgctaaaacctcctcctccttgaaagagccaagatgtgagtgggagagtcagccaacctatccaacacactggatgacgagatgggcgttctaactgcgactacaacaccatggagcaatattaatgtggcttttggttagtattcgttaatgtcttttggttcttctttcacaggacatatctgttattaatcagctgtgtcaggaaataacctgagggaatatttacccagtcaaatctgaagaacaatgatttataacaatctcaataaacactgtgtggccatcaattgtgatgatgaaggtttaacaaaggtattgggcatgtgatagaaggcttacgtgctgtatgtttcatctgtcataacattatgtgtttaaaaaaatagctatttgccccattactccgtgtggaaagccattagtgggtggagggacaattgggacagcttgaatcagtgacagatatttaagttgaatttggtgggcctactttcctgagactgaaaagctagaaattggatatggatggctacagaaatttctgtgacatacccaaaccaaagtccttttaggagtgactactattcatatgattttagcctagtcacatttttgtgtctcatgtgtatttcccattaaagctgctatttctcaatggcaacatgtctggtgggccaaggggcatgaatccacttgaaataaaagaaacttctattaggagaattaggaactgggctagagatacctggccaggtagaatttgctttgaatgagaaatgataaactgacgagaaagacttcctagtgcaagaagcgcacttcaagggcatccaattccaggaggaaggatagggatggcaagctgccaaggttgatagctggagaatggaaccaataattactagaaaacggaacctacgaggtgttctttaatctctttagcatctgactgagagaaaaccattctttccctagtgggtaacagctaaacaagattacagtatttcccctgggagatagatgggtcatgttatgagacctctcttgggcactaatatctgtcaaaccatataaactgagaaaattagtttggccatgtcctcaagacgtcttaaactcagaactaacagagacatggcctctaacctatgtgaaaaataatacatggtatatagaaaaagtagatttttgtaggacagtggcaaaataattacactggcctctcgagacccccttgctgtggaggcagcctgtggctgtggatccatatcctgacagtaatgctcttgtaatgtagccttttctggcaatagagcgcggatttgtaagccatgttattgtgggtcctgagagtcttctttagcaactgaagcctatctaatgtcacccttagcgcaccatcaaaaggtgaggtgcatttacagagaaggcggtgcatttttcacctggtttgtcatggtgagggcgagtccagaaactgtgactattcacacaactccagcctgtaccaaatctctataatgtgtgctttagttgctgaatagaggcaaaatgttctctatttcttactgtttgcagaatatttgtcacacttatcaactgcagtatatttagccctatggtttgggctctctccaacccaccacacattattaataaactaaatacacttgctttgttaagtgcgtttttatttctgctcttacaagttggctttttaattttagaagcctcacacctgtagaatgtcatcagaactacaaagggagaaagaaaatgcttaaattaccttcttcataactttcaatggagtatcagctatatgaaacagtttataaatccttcttaccaagattttatctttgttcctgcttttctaccaagtttcattttcatttccaatgtgttgagaggcagtaaggagtcatgcaacacttaactgattacaaactggggacattataggccaacggtgatgctctccacttaaatagtgaattctctatagtggatacaattgggttatttggctttctgcaatacggaaacattgatagggaagtgaaaaaaaaataagatcaagtgcttaatagaggtggaagtgcatatttccaaggcatctgtaattcaaactcttcactggcaccaggaaatcactgagataacatcattaattttccttaaagttagagttggtagaagtggcctttggtagggaaagctagccagggcaagttttatttgcctgtaccgcagacaatagctctttatcatggctttgcaggcttagaaatgacaaaagcctggaagctaaatctaagcaaatataaaattaggagaaaattcttaaatcatatattgaaagtaagtaatgtgaccacacatatgttcaataaaaggatggggtgaactcttcattctatagttttactatatatggcaccctcctagcattaatgagaattcaatacttaatttagatacatacaccttaattttggcatacttgaatctttttcacatattagaaaagccatgctcagaaaggaaatgcagagaatttcaaattgatttaaaagtgaaaatttaaagaaattattctacattcggagcttacctttattacaaggttatcacctcaaatggacaaaattttgtatattatgaaattcccccattttcccaaagtttattggaaattataagttgaaatgacagacaataaaacacatatgtgaatggaattttttttgagcaggaaaatcgaataatgcctaaatccagggtgaaaatggacattatagaaaggaacagtcattataaggtttttccatctggtctatttctgggtttcttttttttttttttccatagtataaactggaacaaatggttagcttctgaacttttaggatctcacaggaatattctctagcacttcatgataaccagtgcctaattactcctttattaaaggaaagcagtagctctgggatggggcaggggcaggggcaggggcaggtgaagaaaaagaggcaagaaaactttctctattcagccccctgactcgatcccatcccaaactactttttcccagctatgacgtattaacaggtcctaaggaaaccctcgacctggaaagccctttaaacaccagttaaacttggcaactatatagctgaaaaatgataacttcgggctataaggaaatggaagccttggtttactttcattcatgcattcatctcatgaaaacatattgaaccatgctgtgtgccaggttttgtactaagcattggggataccaagatgaagggaaaaggcctagtctctctttccaaataattccacttctaaggcatttcttctctatctctgtgtaagaaccatatgccaagtgactccttgactatcttattgctagcctctgcagatcctctggttgaacccctttatttctgaagacctggcagccagggttcacggtccttctcttttgcccagttctcgctccaattctgcatgatttcaacattggcatgggggactcatgcatcattctagcctctcagttccttaacttgctatttcacctccatggaaattcacatccactctacctctgccacctactcaaatggctatatcctagatctaatcacctgaaactgttccaccttcaaaataatgttcatctatgattctctctgaccacaacttcttgaccttcagttcctttactacttcttcccctacctccctgaagagttagcattttcatccctctacctcctaattaccagtttccatatgcgttcacagcttctcctacccaacagggacttgtcagtatcattttaatcaatcttttgcccaaatcctcacttctcttgcccagctgttccctccctaccccaggacagaagcatctggctcccaagtgctaagcgtgcctggggaaataccacacccctgcagattggagctaccgtgaaacactcagccgcctctgggttcacacagctggttttcaactccgccctctctcttattctccacaaagataagcccaacttcatcatctcctgctgttaactgcgttgcagggactctccactccatacaaaaaatggaagcctttatagtaagacatccttcaccttgctgctacctggtttcttagttacctggacctgcccagatccttccctctaccccacccattacagtggaagagaggtatctcttccctcccttgggctctggattacctgcccgtattctctgagaacacccattatttatcatctcctcttgggccaataattgtaatctcaccctgtcttctcatactcatataaatacattcccacgaatactatatgtttggcctgcatttgattgaaaaaaatccacgtaagttgacccaagcagttcaaacccatgttgttcaaggatcaatgtatacacacacacacacacacacacacttatatacacatattgtgccacataatgacatttcagtcaacaatggactgcctatatgacagcgagcccatgagattacactattatatatttttactgtatctttctatgtttaaatacgtttcgatacacaatacttactattgtgttccaactgcctacagtattcagaacagtcacgtgctgtacaggtgtatagcctaggagcaataggctatcccatacagcctaggtgtgtactaggctataccatctaagtttgtgtagtactctcctatattgacataacaacaaagttgcctaacaacacatttcttagaacatatccccattgttaagcaacacgtgactgtacatacatttccattaactcctcagccccctccaactagctaccaccccactcttctccccttcataagtaaatttctccaagaatcattcataccttctctaattctccacttttggttcacttttgaactcaccacaccacttccactgtgcctctaaaatctcaccaaagttactagggaccttcctgttgctaagtccaatgggcattttccgcaactttatgctgacatcccagcaacatctgaccctggtaacgggttctttctttcttcccatggagcatgtggcatcataacctcttggaattttccttctttcctcctggccattcctttgcagtcccttctgtaggttgcttatcctgtgtcctaaataacttcccttctcacgctacactttcctggagctatccaatcctctcccccgttacaagcagcacctacaggctcatgatccctaaacgttgtttgtatatttctcctgagcaccacagctccgtgtctaaccttaccagacaagtcccacattcacctgatattccaagccaagcacctaagtgtcttccttgactccctttcacccaccacatcaagcttgtccaacctgtggcccaggatggctttgaatgaggcccaaatgaattcgtaaactttcctaaaacatttttttttttttttgcgatttttttttttttttttttttttttagctcatcagctaccgttagcgttagtgtattttatgtggggtccaagacaattcttcttccactgtggcccggagaagccaaaagattggacatccctgcaccacatcaaatgaatcactgaggcctgtcaaatccacttcctaaatatttctaaattctctccacttatctcccttactactctgctaattcaagccaccacattgctggtttagattactgcaacaggtttttctcctgtcactcccacatcgcaccaatccatactctgttccacagcaagaatcatctttctaagcgacaatctgattatgtcacccccaggccaaatcccctgacctctaaattccttaacttgggttttaaaaaccttgcacaatctgcttcctgcttctctctccagcctattatttcacaatagatctttcccctggaattctgtgctttagccatactgacatattttcagttcctgaatgtgtcatgctttctctgggcccttcagcacatgctcttctttctgactagaacgctcttcctagagagagagctgcttactcttctagagttacctagcttagacatcacctcttcaaacaaacattctttgaatctcattccacacagttagctgttcacatagtaccccattgtcccactgttgcacaactaaatatatgacattgaaatggtcttggaaatagagacaagatcactttatttttttaaccaactgtagacattcttaatacattatacatatatttgcttatgtctacaaatttcatgaacatcctggttatcccttgttagactgtaagttccatcagagcagaaactgtgcctgttgggccgggcgcattggctcacgcctgtaatcccagcactttgggaggctgaggcgggtgaatcacctgaggtcaggagttcgagaccagcctgaccaacatggtgaaaccccgtctctattaaaaaatacaaaaattaggccgggcgtggtggctcatgcctgtaatcccagcactttgggaggccgaggagggcggatcacaaggtcaggagatcgagaccatcctggctaacacggtgaaaccccgcctctactaaaattacaaaaacaaaattagccaggcgtggtggtgggtgcctgtagtcccagctactccggaggctgagccaggagaatggcgtgaacccgggaggtggagtctgcagtgagcctagaacgcgccactgcactccagccagggtgacagagcgagactctgtctcaaaaaaaaacaaaacaaacaaacaaacaaacaaaaaacaaaaattagccgggcatggtggggcatgcctgtaatcccagctacctgggaggctgacgcaggagaatcacttgaacctgggaggtggaggttgcagtgagcccatattgcgccactccactgcactccagcctgggcaacagagcaagactccatctcaaaaaaaaaaaaaaaaaaaaaaaaacagaaaaaaagaaaaagaaactgtgcctgtttcatgggcatatcatcaatgcacacagaccctcagacaatagtagagttatacataaactatttgatgacatgatagagctgtgtaacacttcaggatttttccacagatgtatgataaaaaaggaggaaagcaattctgtcatttttcctctaccacttcattcatctgcacgttagcattcaagctaataaaccacacatgtctatgaagtttggtttagatcagatagtcatagtcttctaatactaagtacattttgtaaaaagaaaaaaaaacaaaggtagaacaaggattgtgcaagtttcacaaaggtaattatggatgccgatgccaatgccagtagttggaaaataaaaattctcaatatcttaattcaacatcagtagctgaggaatggtgacaggaatgattctaaaaataaaacaaaacattctaggcaaactctaggccaaggatacattaaagaatgaattatacattgcaacaggaattgtgacagctgtttctcccctctctaagtaaaaatgtacccaacctactttttattctaagcaaagacatagtatcaagatcttcaaatactggccaatacttacagcaaagggccttctgcagtcttcggagtttcatggcagtcctataagctgagaatctgacattattcaggtcagctgaaaagagggaaaacaaagagcatttgttattccatcagaaataacagacaacccacccccgacgcccagtgatttgccaataactacaaccaccacaaaaatagcctagaaaacatatagtgtgtatacgccaagctttcggaggtgaaaattctgttaacgtggggaaaagaaaaaataattccttttgccctttgacaaccaggaaggctaagttctgtgaagactaaagtggtatagcctgaagggcattcatgtagtcctgttcccaagaggaaagagatggacaggcattatttttttctagaaagtaatctggatctactgtagtgaatcttttctgcacaagattaaagagaacaagaaatacattatttaaatagctataagaccttaaacaatcaagtggcaatataacattttttctgactgtagaagttatacatgctcactttgggtaacttagacatttaacatatacatatataatcaaataaatcatccacaagcccataaactcaaaaataggcacaactggctggattcagtggctcatgcctgtaatcccaacgctttgagaggccaaggtgggaggactgcttgaggccaggagcttaagaccagcttgggcaacatagtgagatcccatctctacaaaaaaagtttatataaaccttttaaataagcactgttaacattttgagtattttttatccaacatatgtgtctatgtgtgtgatatgtatttaaaaatataattaggaataaaataaacatttggctctatattctaaggtacaatcattctaatgttcagcacagaataacaacaatatatgttactgtggtttctgcagtcaccggtctatcaagccctgactcacgccacctagcaggaagctatatttagatgatgttcttactcaagtctgcacaagccttgatagatactgggctacatttatttcaggaactcagctccaaaaagctccttgaagacaagaactctgtcacctacttctgtcatttttcctagcaacttaatatgcaactgccctctgaaaaagctgttttaatacagatcatggaccgactgaccaactgaatcaataaacaaaagaatgaaagaaagaaaaagtacactgacatacatgactgccataatcaaatgacacctacgaaaccaattctgatgaggtgttaggaaagggcaataattcaatccatatccaagtcacttgggtcaacattttcagctttatggccatcgcagagaccaaacataaaagcctgaatttcaactaggggaaagaaaacaatgtctgtaatttaaactattcagcatacaattttgtttaaaagaccggaataccaaatgttggtgaggatatggagcgactggaattctcagacactgcttgttgggaatgtacgacaactttgggaaaccagttaggcagtttcttatgaaattaaacacacatgtatattatgactcaaatattcttttcctggatatttgcacagaataaaaaaaaatgtatgtccacaaaaagatgtgtacatgaatatccatagcagctttattcataatagtcaaaaaccggaaaccaaccagtaaggtaatggataaacaagttgtggtaaagtcattcagtgggatactactgtgcaaagtgcaataaaaaggaactaactactgataatgcaacaatgtgaactgatctgaaaaacactaagctgggtaaaagaagccaggcacaaaacagtacatactgtttgatttcacttatatcaacttctagaacaggcaaaacttagctactatgccagatggtagcctggggtgtggtgggagtaggtaactgacctcaaaggaacacaagggtgttttctaggtgatcgaaatgttatatcttgattggcatggtggttacacgagtgtatacatttgccaaaatctaacctgaacacttaaaatggaaacatgttatagtgtttaaattatgccctgataaggtaaattttaagagtctttaaaaaccctcacatgaacagtacactctgatgtatgtgtgtgttagcttaagctacactgtagaggtggtcagttgtcttaatcaggagtgaactccaagggtggttggctagcaattaatcaaaaagcctcatgccacaggcggccactgtaagtgattcagttatatttagctcttattacaccaggggtttcattaattttcctaattaatagttagacgggcctgtgtagtgatattagtggtttgcaaaatatgaagattgttgaaaaacatttagaaacactccctgcctttaaattgagtttaagaagaatccagtaggttctccatctttagaaatggtgccctaggctgaattccaaaatgtccagctgtggttcaccggattcttagttgccagaattcagttagatggttgagggaatcctgctgctagaacaatggttttcagacttgagcaaacatcagaatcacctggagtggatagtttaaagatgcagatttcctaggccccacctccagattttctaattcagtaggtatgggaagggcctgggaatctgaatttctagcaagtttccaggtgatgctgatgctgctggtccagggaccacactttgagaaccactctaatagaggactgtggcctgtgtagactgtgagcctctcacaccaagcaccccaaaagacagaactgtgacttcactgtgtctctggcacaggctgtaagattgttttgtacccattggctaataaatgctcctaagtgacagaacttgtactgagacttgctttctttataacctggcagccgagaggtagttaagagggcagtcctcaactacatctaaccatgaatgactaccaacaccaattacagagaacctgtgtgagtccttgttagtcaaagtgtgatttgaggaagaatagcatcagtatctgcttggagcttatgagaaatgcagaatctcaggccccacccagatctgtgaatccgaatcaatattttactaagagcctctggtgattcatatggaagttctttaaatgaatattttaataaagtttcttgttccgtgttgttaaacttcaagtataaattctgtataccaacaccatcctgtgttgtcttttgtttttctatctttctatcttccattttgtgggcttttattaatagattatttaataactactatagtcaactacaccaaaacctcccctctgggatatatttgtgagtctcttgtttatgataaataccaataaaaagtattcaataaattaaaagcatctcggagtatcttgaaatgctatatatacagattgcttcttgaagataattaacatttgcctggacgctgtcctttagtgagcagaacttgatctagttgagtccctttaattgtccttctctctctctcccctaaaagatgtggttcttcctttgtctcttttgcccagtcatcactgcttacttttttaagtggtctcagccaactcatggtatgaattgtcttgcggcatcaatccatgagaaaccaattcctgtcctcccctccagattggtgcaacatccttcaccagtaccatcaaatttttcctgtacttgctagtgtggagttcccttacacacacactcatcattgagtccctttgactctttataaaaagaaatgtagagacgtggaaatgcacttttggtcaaatacagatccctttcccattaacaccagcctgtagcagtttccaggggataagcatccaatcccaaattttctctcattcctttacttatgcaaaagtattgagtgttagttttgtgccagccaaacatcttgtagaagatattggcataaagtttctcttctttttttccctttctaatcctccttctccactgcctcgtaactcatgtgcctagtttcctatcatctttcttctttcaaagaacgacgattcctctcttatgaccccaattctaccctcttttcctattttcctggttctattcagcatttagaacaaatggtctaaatgaggtcacaagctccatccaaatcttagcgttcatatcaagaattggcaaattccagtagctagagatccaagtgggagaggcaagaatgatctgattctttcagggcatgaatattagtgtggaacagtatcagagttcaaactttcttcccttctaaatacttctaactatgacacattctgcctctagttaatcctccctgacatcttttcagcctacccccaacccactgcagtgaataagccttctgctaccagttttccacgcaccaaagtccaatccattctcaaacagtgattcaggcataccagaagaaagtagcagggaatgcctccagctttgttcttttggcttaggactgacttggcaatgcgggctcttttttggttccatatgaactttaaagtagttttttccaattctgtgaagaaagtcattggtagcttgatggggatggcattgaatctgtaaattaccttgggcagtatgaccattttcacgatattgattcttcctacccatgagcatggaatgttcttccatttgtttgtatcctcttttatttccttgagcagtggtttgtagttctccttgaagaggtccttcacattgtggcattattcacaatagcaaagacttggaaccaacccaaatgtccaacaatgatagactggattaagaaaatgtggcacatatacaccatggaatactatgcagccataaaaaaggatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggagtgggggggatagcactgggtgatatacctaatgctagatgacgagttagtgggtgcagcgcaccagcatggcacatgtatacatatgtaactaacctgcacaatgtgcacatgtaccctaaaacttaaagtataataaaaaaaaaataaaaaaataaaaaaaaaaaaaaaagaaagtagcagggcaaacgtttagcttccatcacaatgctacggaagccatacaaatgtatatctggtaactgtcagtgaactgcaacggagttctggtgccctacaagtctactactcaagagagttaactgcctgtgttgtttgagtccgcatgtgttgctaggagtctgcagcaccactccctccggcttacagctggaagagataagtctctgccttaggaaagtgtgtaggatgcacacagaaacctcaagatgcaatacagctgtgaacaatgtgacactgtcctgggctaaagcttgggatgactgtgtagtgaaagtatgtatgcagtttaataaagctaaagccccccattcccgtgccccatgagagactgtcctccactttccctgggagctgactttccaggactctgatccaagttgtaatgagctcactagctctcacagccggaactcaagaggagtgagactatccaagaaaccagttacgccatgtttccatggcagctgggagaaagcgcacttcagaagggtaaaaatgctgaactgcacatttctcttcataacttgtattattttatccagggctggttctagcctataaatagagaaatctagaaacgtaaggaacaagggcaaacatcaaaccacctaccttctcaagttgaatttccaactactgaagtgataggccattcatcttttattttgaaacatgaaacaagtaataggcttctcttgcccctttgtttagtctatgcatttttcttgactttggtaagtatttctgttttatgactttcacttttactctgtgtaatagtagcaggtgtcaaaattcaccagaaaagaggaacaactggtcaagtttgcgtcacatatctacatgttacatgcttttgaaaaatagtgagaaacacctcagcattttaaagccatggaagcattccaaagatattacagaaaaaaaacattaagtcccttcatttcaattttatagctggtttctgtctttttaataatactgcaaaaatcctactatctctgactgaactgaggtctagaatttaaaacaaggagtgttttagtctatctttccaatggcttatggagactttttggaaaggcctaaggtttcaatatgcctatctattagctagaaagaacaataatgacctcattaactttatgagtggaaagagctgtacggctaaatgattattccaacagataaattggtatagtggtctttgtttcttcataccaactctatttcccagaagaaatttaatccaaatctcccaggtggtaagtgaaaaataaaatttagagcacatatgcttttgggggagtattgttctaaattcagtgtttggcatacaatacgcattgaactactactgcctgcctattttactaattttccaaattttcccaagaagccaaaacaaggcagtctccccacatactcctattatagaaaggtggcatattttaaaatataataatatgtctccaattttccagtctcactcctccaaaggattctaatggacttttcagatgacaagtattattcttgccagctcaaactcactagaacagacaagaaccttggatcttaatgagacttcagacaaattgagtaatttaaatccagtctgtcttgaaagcaaattaagccaaaatatccaggcttcagaagtctagaattattgggagatcttcaagaacagaccaggaattctggaacatatctttaaagaattagctgagagaagaggaacactaacacatcatacttggtctataattttttagatatatttgaggcctcttaaaatctcaactcgtaaaaacctcatcatcaacatagagctttacttaaatgggggaaaaataaacctacacacagataaacaggaattatgcattcatacttagataagtacagaaagtacagtctgtgaatttataattactatcaagttatgtttccagatgtgaaatggtattacttatttatcaccaatgactttgtaaaactcttctaagaaatgaaggagagggccaggtgtggtggctcacacctgtaatcccagcacttatggaggtcgaggcgggcggatcacgaggtcaggagttcgagagcagcctggccaacatggtgaaaccccgtctctattaaaaacacaaaaaaattagccaggcatggtggtgcacacctgtaatcctagctactcaggaggctgaagcaggataattgcttgaacccaggaggtggaggttgtagtgagctgagatcgcaccactgcacttcagcctgggcgacagaatgagactccatctcaagaaaaaaaaaaaagggagagaagcaataaagtacctagtatggcacaaatgtggaagactcagaattgaggaaaagagaaaaaggttatgaaccaaaaaatactgagaagttcaactgtgaaataaaagatagcacaaaatcctggctgtggattgtttaaggcatttctggctccctcctcttgcttggccttcctcagcagaatctcactacttcttagcaacactgtaataatggcagagttgaaattcaaattagttttgctcattgttagctgccctggtaaaaggtttgttgagaaagcagtttctgtaacaaatggccgatataaagttttctgggggagaactgtgtatcttaagtaccatttctggggcctgaattctgccccagataatggagggctgactcatataggcaccactgtgccatgctcctttaaatcaagcttcaagagcggaaggatcagggctctaactcccaaaaccttcattatatataaaacatacaatccataataattatggatccataaggataaatgtcttctaaaaagctacaaagcagtgttgcctgatcttttaaaaatcattagtattattttaatatataacatatattattttaaatacatttaaaatagtacaaatgacatatttaaatacatattttatatatttataacatatgtgtatttaaatatgtatttgaagtaatactactgattaaaaaagactctttaggcagaactgttttataactgcttaaaagacattcatctatccataatcctttcatctatcctttcaatatttattgtgcatgtactataagccaagaaccatgccaagtacatggaatacactggtaaccaaaataaatctctgcctttattgactttgcagtgtagcgaaggagatggataataatcaaatattcatatgtaggccaggtgcggtggctcgcgcctgtaatcccagcctttgggaggccaaggcaggcagatcacctgaggtcagaagttcgagaccacctgggccaacatggcgaaaccccgtctctactaaaaatacaaaaaattagctggatgcggcggcaggcacctgtaatcccagctactacctgggaggctgaggcaggagaatcgcttgaacctgggaggtggaggctgcagtgagccgagattgtgccgttgcactccagcctgggcaacaagagcaaaactccgtctcaaacaaactaacaaacaaatattcatatgtactgtggtaaaatggtgaaggaaacacacaggaagtgatgagactgtatacatagggaaacataggtccgagaggcttcttggagaaggtgacattgaagcaaagacttgaaggatgatgggagcgtgccaggtaagaacacagcagcgtaataggtcagcacatgttaaaaaaaaaaaaaaaaaaaaaaaaaagctctgaagcagagaagaaggtggggctttaagaatccttagaaggccaatattgctgaaatctcagagaggaaggaggaagagtgggcacagataaggcctgacaggtaggcagggggaggcccactgcagagccctgcacatcgtgtgaaggattttgggtgttgggacttctagttaaacacagcagatggagcagactcatttgtctctctttatccctgaaactctaccaggttgatagaagaggaataaaaaatggcatttacccaaaagaaaattaacaaaacaggagaggagatgagaacagatcagagctccagtattttggtggcttagaaaatgacctgctggtaaccaacttaggagaccagagaaatcccaagctcaattaatgatgttggggagacaaggagattggggcagggagtgggaggaactaacaagacgcatgccagtttatgtagccaagaagtctcagaaatgaaaggctccaggttcctctgaagactgaaatgtggctgaaaatacaaggactggttgaaagtctttagagccctaaacacctcccccacttggagcctagcatctcagccacctgctgcttcatcctgacagaaggctggaggcttaatctcgaagctgcaccacacaccagggcgcatgaggagcagtgaaatttggaagtgggagaaggcactggaaacagagggattacataccagctctgcatcctgaaagaaagtaaatcttcaaattcatttccttcatttcctactcctcaattccatatttagtctgctgttttctgttaactcattttaaaaagctcttctacctaagcactttcttttttgccacctttatctccagaaggaacttcaacttcagcaaggtatgcagccattaaattgttcctcaattatcatccctatatatcatattcttcatgctgcagttacaactactccaaatcaaatcaatgcactttccttgcagtctccctcttgacaggcgacttacagtcacacaggccactctggctgctggaataaacaatactattctcctcctttggctcagaaccttcagtcactgctctctcctgtttttctcagtcacaacatgggtaactcagctacttacagaactctcagaatgacacaaacttataaatttaccccaatctccttcaactctattctcaacctcattaattaacgaatcttaacagtctctcttcataagtgaacacacatcccagattcgccagggcagagccagtttaattaaattttcctctttgttataaaaggtaagactctaaaaatgatcagatgtgacttaattcttatacctttgcaaagccaaattcacagatttttttttttaatgttgtgccttagcttttttggattgcaaaaacatactcttcataatatggttgacattacctattttgaatttatcactctctcttacagttgaaaaatttgtggaaagcgtattttaatgatgaaaataaataacagtaaatttcctcatctgctttaacctcatcttttgccccttcctgttttaaaaagtcttaacttaattttcctaaaggctaccttttctaccttggccttaccgccgtctcggcttacttatttctctgcccttatctcccaagatttcaacatatgatctttctcccaaaactccatttcaattacttctctggtaaccacagaccagaggtcaccaactggttgaatttagtctgcagactctttttttgtgtgtgtgtgtgtttgattcgttggtcagtttgggctcacataatggtttttgaaattgttgaatgatacgccattagttaaaaatctggtgatttcccgttgtcttgcttctctggaagaacctgaagacctgacaatagagactcacattctcatagaacagtcagctgcaacggaggctctgttaccctaacagaagcttttcaggttgccccagttcccacccagtcaccttcagtcattcaaattaccagcttggccccaggaggcatttcttttcagatctttgcctcagcctgaccactcccttgttctcccaaaagcttttacatttacccttcagttacactctttttcaggtccctgtcaaggctctgactgtggagtccctccaataagtagctattacctggctgtcactcaaattactctatggaaacagttgttactgggttttcccaaaactttccagcgattaattctttggactccaccttttactaatgcattcaaactaaatgattgtgctgccaaaaatattgccttaatacacttactgttgcagtacaagaacaggtaggaagacaggccaaaatccatgagtctcctgactatatttcattaagtgacaattacttctgcatttaaaatcatcagttgacgcttacttaagcacctattatatgcctaactgtgtactaagcccaggggttaaagattcaggtttctaagatattggggaaaacaaaaagattattcaccctgtaaaaaatcagtacacgtatcccaggtatttgtgatgtgtcaagcaacacacacatacaaaactctggttatgtgagtgtcaaagaaaaaccagagatggacggtaaagtggtaaaaacagattttattcaggaatattgcaatagtgggaaagagacctcagtatagaactgggctcaactctgaatacagcatggacaagtgggaattgatagccaaggagcagggtggggtttggtggatggaaaactactaagagaaagcatgggggtaagggggattctagctaaaaaaaacttaacaggaaccttgctgaagacacaggccagggtgatcagacgtcacatgggggatggtggaggatgaggaacctgatcagatacataagaggaaggtggttcttgctaaactgatttagcaggattctcgctacagctggatttttacaaagaagtgcacaggtgggcctaggagaaggttcaggagtctggctgaagtttgatcaagtagacaatctttatcatgaggatgcttatgtacatacagaaacatataatgaaaatagaccatcgtgcagtttatatgtcaaccgcaaaggtagtttccaagatgacataagcagtattccaatgaacatttttaaggttaatggcattggaaatttcctacataagccatgttactcatgaaacagtaatttctaagcccacaaaggcttaaatttagtttaaatatccagtatacaataaaaataaaatctatagtaatactgatagaaatgactgatgtaactaattagaaatagctttatttttcattcttatacttgagggaaaaaagatgagaaaaatgcagacttctgaagaggtcatgttgtgttcacttatccttggcatctagggcaataaatgatggtgctcaataaatgtatttggaataaaattagattctgaaaggaacttccttgcttttaccaggtttaagctgtcgatgacattgattttacatctaatttttcttcaaataatataattttccacttctatggctgaatcactggaattattatttttgcttactccttacaacctgagctggagcttcttttttgaaacacacctcacaaagatatcaagactttcctaaggaataaaggaattgggacaaagagagaaagaaaataaatggtctaaaaagaatgcttatttgcaaggtgaatccgctgtatttaattgtggcagataactgtatgttggctcactcaacaccccttcccaaattctttctccttggtctttctctgctacaaaggctggaggatctcaattccctgatccagccaggggaagctgtgtggacacagttttggccaatgcttgagaagatatctgcaagaaaggatttcccttcccaaatggaaagacaaagagactctgaggctgaacgtcctttctctttcttcctgcctgagaagcagcagtcgtcttggaaccatcaggaccaaagtcactcgttaaaaatggtacagcagaataaaccatggcccaggtctctgatgacatcacggaactcttccatagctctcaactacctgcctccagacttcttgttctacaaaaaatatcaactcctctgtgtttaagatacaattggtcagatattttattaactgcaaccaaaagtcatctctaactgacatgttaattgaactgtaagcaacaaaatgcagaagactaaatagggagcatcgtccacccccgcaatcctccttgcggtggagaaatgacgtgagcactaaagagatcttgggtggcagagatctccatccttgctaccaggtggtgccactgatgcagaacagcttgacagctaatttaacgtttaaaacaattttataacagagggcttatatgggtaaggcactcttctagacaaagtctgcaaagtgtttagccatttgtttggaatgggacgttcacaagtctgattctgcccagatgtaagataaggattggaatttaaaaacatacaagttacttctctggaaattcacgtgtcaacctataaatgaacacatataatcaactagtttttcattaactctttagagttaatgaaatgttcataacttcatctctagtgcaaaatttcctctttatttatagctcttaagataaatgttatttaaaaaaatagttttggtaacttcaactaatcatatgttttgacagtcaaattaagattcttctctaccctttatctaacagtaaacattttaggttctgagtgaaaatgatttgcatcctccatctgcctctttccatttctctggtgcccaacatcaacacacccccaatatccatgccctctaataatcatcatgaataaaatggatgccaaaatgaaccacagtagaaattaaccttagttaccatgggaaaagcaaactgaccttcttgcaaaaaacatttttgcaacatttctgtcttaggctggtatgcatgctttcacctcattaggaaagatacattgtttgggttttgttgatgttgctgtttgagaggtgcaagaagagaatctgttgagtctttatgcatgaataatgagtccaagatagaacacaattcaagatatttaagcatctaggatcatagtaaactatgcgtatctctgctttttgtatactctagcataacagaagaggggaacaggtggtatgactcaaattgcccatgcatgcagaagcatgtgatagagaatgttttcttttcactgttatgtgttaacttttctggagactagatgctaatgatgagatcctgctgaagacactaatatgtaaatcattccttaaacaaaattacttagcagctgcagttatgataaaataaatcaatggtaggagattttcattagataatggactgcctggccctctgacatagactgaggtgcttttaataaaggatgcctgaagcgttcctgtttaccctctgtgtatctggacaatacatttgaatctggaaccaatattaccggtactccgggaaaatactctttttattttatttttattttttttagacggagtctcattctctcgcccaggctggaatgcagtggcatgatctcggctcactgcaacctctgcctcctgggttcaagtgatgcttgtgcctcagcctcccaagtagctggtattacaggtgcccaccaccacgcccagctaattttcatatttttagtagagatgaggtttcaccatgctggccaggctggtctcgaactcccgacctcaagtgatctgcctgccttggcctcccaaagtgctgagattacaggcgtgaactattgtgcccagccttgaaaagactcttctttatcacctcaaaactatgctgcatttgggagttgcttgatataaagctttaccaatttgaagattcaatccaagaatcgggcagactctgagttcctctgcccacctcatggatggccctgaagtcacaggagtgagtttgccttctttctcctctcagtggcaatgaccacggattccttgtcttttggattgcctcctacttcatagcagacagggctcattccccctttctctgcctctctgtttctctcacttctcacctcagctttcttttcaacacactggatctgacccagcttttattctcctcagaatcctggacaaaactacttgaggataaacctaaagcagcccttttttcctaagatgtaggtgactcttacttcagctctttttgtatgcaagtattccctgtagagccaaagagaaaaacggaagtgacaggccgatggcagaaggaatactaacattcgctgagcactcaagggcaaatgtcgtgtgtacctgataccatcgagtccttacaaggccctgagttctgtattatcagctttgttaaagataaaatgaggctcacaaatgtttggtaacttccctacggttgcatcccagagcctgcattcaagaccaaatctttctgacactcaaagcctctgatggccttccccgcttctccgctacagaacaaatgtctttccttacccagtgtaatcctaattagcacaagggtgaatgggcagtagtaccctcagaagaaccatgataccgggcaaggagcagagggtatggggtgaggcagaaacccttgcacaaggaccacagggagggaaactgaccagtcaatgggatgagggagtgaccaggaatgtaactagaccaataatgatgaagttcccagtcctccttatctagagaagtttgctgaataatcaacacctgcagtacgagtttctaccatttttcctacaaaagttttttgctcccatagaaacatacagctgctttctatttacatggtgcagtatatcaggcactctgagggttaactaagattctgtgacttagggacctaaccaccatttataacacatttcattccaaattgtatgcaactgacttacaaataaacttggaacagagcccgagggtaagtttggaaaggcctaaatcttgtctcaaggtgggaatgtggttcttgcctgactgctgagaaatttaatggttactgggcaaccaggaattaaataatttgggaaattttaactctacctttttcttatgagtattctttaggggaatatatatactttttattaagaaaatgaaatacatggtgccttagaaatagaatctctaatttaaaattttcattttccaaatgagagaactaaggactagaaagctcttagtaacttgttctgaattccctagtcagctaggagaaaaacatcaactagaatccaagtctttttctccccaagtgtgtatcccttccctgagcaagccacagaacaaaaatataaaggctcattctaagtgggacttcaagtctactcattcagcttaagggctcccaattgctcccaattcgaacagagggcccgtgaatttctttaaccttgacaaacatctgactggaaaacaaattttcccaaaagcaagcagggtctaattttcccctgttaagagtggtttctagaccttggcatcttcttaaatttttaagattcagctcctcctaacccgctctgacatataaagtcatagtgttgtgaagcagactgtgttatagaaggaagtcaggaagtaaggatgtgaacatttcttttaaagagtagcagcagcctccatcctgaatgaagaagccaggtctcagacactcccttagacgtgccgcctttaagaaaggacatcctctctgtacttctgatgatcagcttaatttcccatttgaataatgatttttttgtttgcttctgaagtcatgagaagcagttagcatttatgaagctttgaatggttgtccaatttgacttaaaggccacgagatgctgatgttaaacttcgtacatttatttctgggttcctgtcttattaaaacactgacataactctccatagtgcaagttttcattcaccatctgtcagtctattgcgctacaggaaaaaaaaaactccaggttaattatgtaaaaggtaatagcatcaaagaacagaacattgtgcctattatactctcaatgtgcaaaaatgggcatatttttatgtgtatgtttgtatatgcaaaaatatttacagaagcaaacataaaaactatactgttaattgtctctaggaagtaaaattaggggattgataccaagagtggttggagacttacttttcaatactatcctcttacaatgtttgatttcttaaagtcatgtgcactttttttaatgattgagtattaaatctatctatcttcttttcaagatttctctatctgggatttcttccaaattcttagcttcacccgctgtccttcaggagagtactattgtacaatggaaaaactactgggtagagaagaaaacttaatgggctctatttatgtctttgctgtaaaataatagtaataatggttatcatttattaggtgcttaccctatgtttgcaataaataacataaattctcaggttatcatttattaggtgcttaccctatgtttgcaataaataacataaattctcatataattaccttcaactgtgatatcattatttcaatcccattttataaataaggaaaccaaaggcctaagaagtaaaattcaaatccatttgaccctaaagcccttcctcttcatcactatggtctcccaataagcttggtctagtaaccttaactttcctaagcttcattttttttttgttcatttttaaagggaacagtaatagtacctattcctagggctgttgcaaaactaagagagatagtgtatctcaaaagctccaaagaggagatgtatcttggatatatacttgctcagtaaaagttaggaacctttctctgcccctgtacttcttgttataaagtataataaaagtgcaagtaatatttttatcatgctgtggaccaaactctttcttcggttccccttttcaaatggctttagagtatttcctcttcaaaatgccactgtcccctctcaggaagaaagtatagctgaggggctaaatcgctggtttaggagttaaaagtacacgtaaatccctgctttgcaatgtgagaaaattacctattttctctgagcctcatctgcacaatggagatacaaatatcttttacagggtttttgaaaggattaatgagaaatatatgcttatggtatggcagcacatacatttatatgagccaccaaaaataaatttttctaagaagagaaattgtaaataaacccataagtatgtaattcaatcaaattcatatctattccctgttgctccgctcagtttgcaatttcctcttttcctcaatggtatcaccattctctgtgtcaccacgccttcaaattttgaagacatataactccctttttctttaaaacctgtccaatctgtgattaccttctggcaattctaccttgttaagaaaaacctctggagtcacgttcccttttccttcccccattgctatcctaagaccctcatcatgtcaattacctcaaaacaaaacgaaataatctctcccctctctaactgtccttaaactcacccaccaaattcctattccaaaacacagaagacggacttcattatttctcttttctgaagatttaacaatgtttttcccattgccaatcaaatgcaatgtaaatttctcactctataatttaaggcacttagttcaccccaggggcactgaatcagatttcccttttaaaaatctggagtggccaggcgcggtggctcattcttgtaatcccagcactttaggaagccgagatgggcagatggcttgagctcaagagttgagaacagcctggataacatggcaaaaccctgtctctaccaaaaatacaaaaattagccaggtatggcggtgtgtgcctgtagtcccagctgcctggggggctgaggcaggagaatcacttgagcccaggaggttgtggcaccagtgagccatgttcgcaccactgcaccccagcctgggcgacaaagtgagaccctgtctcaaaaagcaaaaaaaaaaaaaaaaaaaaaaaaaaaaatctggagtagattctcagagaacaatgtcttcactgactcgcaaacaagccagtctttcatacctttgtttatgctgctacactatctggaatatcttggccctacattttactttacctgagtattacaaaatttcttcctagaacaatgtttttttccactctccaaacaactctccctaattattctaattaatactgctcttcctacctatataaggtaccatacgtttgaccttaatcttatttaagttggtgtacacggtcttgtaacatttattaactgttttattacttcccaattttatttcccccaaaacacagtaacatcttttgtgaagctgacataggcttttttcaaaggatttcttatacaacaggtagaaagatagcaggcaacaataagatatgtgtgtgtgtgtgtgtgtgtgtgtgtgtgtgtgtcatatataaatttgaatgtataagccttcagtcattccaacctaagacatctaaagtaaccttgaaaagcaaaatgggtatacgttggcattaataaacgataccactagcaataagagaagataaaataatatggttgtcatttgggttctacagacagaaaggacttagaataatgtaagtgttccaccaccggccacaagtagacctggtaccatctccttcactctcataggcaaggaattctatcacatcatgaagtccgctgcatgaccagagtcacgccagcttgggcaatgaacagggatcatgccttatacttttgtgcattctattacccagagaaaggttttgaacattctaagtactccatatttatgggggaaaaaaatcaatgcctcacagaaaactgtaaatgtaaactgaccatatctatggtatacatgagtcttcctcacccaagaggcaggaagcaatcttccttttctgttaataactgaatagccttttattaggacagccactgtaatttagggctctgcatatatttaaaaaatgtgaagaaacaggagttggtatagagaataaaatttaatttaatgggtagataatagatccactaaggatggataaagggataaggcttatttagctgaaaaaaaattaaactgtacagtatttatgtaaccaggaggctgttaccaactagagcccctcaacataacacacaaaaaagtgtgtattatatcagaaaagtttggaagagttgtgtttggttaacttcgttttgttttcacattactcaaaaaagaagaaaaacacccagcagatatttaaaagaaaacatttgtggtcactagaaataaaaaatacacaaatattaacaatgagatggtttaattttccttgttacaatagcaaaagtaaaaataatactccatgctgggaaggacatggttagattggcactttgaagtattatgagtgtaaatggctacagccttttgagaaagtttcaggcagtgcattccaagaagcttagaaacattaacaccatttgactcagtgattccacttacatgaatcaaatgtagaaaggtgttatgcataaaggtgttcctcaaagtcttacgtggaacagtagaaaaattggaaacgactatggaaataattatcagctctatattctttaattgcgtcttggccagaaaatgtaactgaagtaagaggctacaaaagccttaactgacagttagaagcaagaaccttgaaaagaacatgggaactgtacacacaaatgttttgagaagataaaacagtctgctagccattctacctggagagataagttaaaggtaactaaatatttacatatcagttattataaaaattaaaacttacagaaacccatcataaagttgagtttctgtataaaattgcttgctaagaagggcaaagttgttcctgtaattcggaaagtttacaaggatacttgccttgtcaccttgacaccatacatatttggtaaagaaaattttatccattaagatatttgtggtagaaaactattgatttaaattcatagctatatttttcataggataaatgttacttatcaactttctgataactgactgtctgtttttgaccacactgactttattctgtaacatcacttatacataagtagcttgttggacagaaggtattataacactttacttggctttcttctcagaagcttgttagtaataagcctccagattcttaaagatttccttccataaattcaacacgaatttgacttttctttgtcacaattttcaaaaattgggaaatatttttttacaaaagtggtaccccaataaactgcaactagcgaaaaataacatctctgaggaactaagaataagagaagacttatgattacagtaggatacaacactttaaacattctattatctcaaacaactatataaaaatgcataggaaagaagaccggaagcaatcttttaaaatgtaaatagtggctatttctgggtactgagatgtgaggtgattttcattttgtttttgcacttcaccttctaaaatttctagaatgaacatccatgttttaatgttcaataaaagtaagatcataaaaacttctataccctcagtaaacgtttttctccttgatatttttagcctgttgccctaaagtttgaaaatacatggcacgctcttaaatgtttactgaagcaggaaaccaatgaacgaacgaggccatcagcacatcaaattgtgttcagtgtttcctttctttgtcatataaattctgaatccatagtgacactttttacgggtcttatttctccttatcaattaattattccttttagggcaaaattaattccagaatagcagttcacttggttttgctaagataacaaattgccaataaaatctacaacttaactgatattccctattttaattactttgaggctttatcttctactttctggaaagaactccatctctccagagttccatcttgccagtttaataatccgccttagaaaaccctcatctgtatctttccatcttcttgagtggtatttgttttcctcccgagcaaaatcactctcccttgctctactgtgcttcattcaatgaacaattattttttcagaggctaccatgcaccaggcactggtgacaaagatgaggaagacagttcctgctttaaagaggctcattacaggctcatctcattaaattgcactttgctgtattgcactttgtgaaaattgcattgtttacaaactgaaggtttgtggcaatcctgtgttgagcatgtctatggacatttttccagcagcatgtgctcactttgggtctgtgtctcgttttgaaaattccctcaatatttcaaatttgtcattatttttatatctattatggtgaatcgtgatcagtaatcgttgatgttactactgaaattgttttggggtgcaactaaccacacccacataagatggcaaacttaattgatcaacgtcatacgtgttctgactgctccaccgaccagctgttcccccatctctttccctctcctctggccttcctgttctgagacacaacaatattaaaatcagggtaattaataaccctacaatggcctctaagtgttcaagggaagaaagagccatacctctgtcactttacatcagaagctattaatgattgagcttagtgaggaaagcatgttgaaagatgagacagactgaaagctaggcctctcatgccaaacagtcaagttgtgaatgcaaaggaaaagttaatgaaggaaattaaaagtactaccctgcgagcacacaaatgataagaaagtaaaacagccttattcctgatatggagaaagtttgagtgctctgaatagaagatcaaactagccacaacatttctttaagccaaagcctaatccagagcaaaaccttaactcccttcaattctatgaaggctaaaagagatgaggaagctgcagaagaaaagttggaagctagtagaggttgcttcaagaagcttaaggaaacaagccatatccataacattaaggtgcaagatgaagcagcaagcattgatgcagaagctgcagccaagttttccagatgaagctaaggtcatggatgaaggtggctacaacgaacaacagattttcaacatagatgaaacagccttctatttaaaggtgatactatctaggactttcatagctctagaggagaaatcaatgactgccttcaaagcttcaatggacaggctgtatctcttagtagggcctaatgcagctggtgactaagttgaagccaatgctcatctaccattctgaaatcacagggcccttaagaattatgtgaaatcaggccgggcacagtggctcatgcctgtaatcccagcactttgggaggctgaggcgggcagatcacgaggtcaggagttggagaccagcctggccaacatggtgaaaccccgtctccactaaaaatacaaaaattaaccaggtgtggtggcagacgcctgtaatcccagctactcaggaggctgaggcaggagaattgcttgaacccgggaggtggaggttgcagtgagccaagatcgtaccactgcactccagcctgggtgacagagcaagactccgtcttggaaggaaaaaaaaaaaaggaattatgtgaaatctactttgcctgtgctgtataaatggaaaaacaaagcttggatgacagcgtatctgtttacggcatggtttactgaatatttcaagctcactgtaagacctagtgttcaaaataggtttcctttcaaaatataactgctcactgacaatgcaccttgtcacccaaaagcttggatggagatgtacaaagagattcacgttttcatgcccgcttacacaacatccattctgtagcccaaggattaagaaaaaattgtgactttcaactcttattagttgagaaatattttgtaaggctatagcttgacatagacagtgattcctctgatggatctgggcaaagtaaatggaaaatctctggaagtcaggtgtggtggctcacggctgtaatcccagcactttgggaggccgaggcaggtggatcatgaggtcaggagtttgagaccagcctggccaaaatggtgaaaccccgtctctactaaaaatacaaaaattagccgggcgtagtggcacacgcctgtagtcccagctactcgggaagctgaggcagaagaatcacttgaacccaggaaggcagaggttgcagtgagcctagatcacgccactgcactccagcctggacaacatagcaagactgtgtctcaaaaaaaaaaaaaaaaaaaatctctggaagtgattcttgatgccattaagaacatttgtgattgataggaggtcgtcaaaatatcaacattaccaggagtttggaagacgttgattccaaccctcatggatgactgtcaggggttcaagacttcagtggaggatgtaactgcagatgtagtggaaacaggaagaaaattgaaatcacaagtggggcgtgaagatatggctgaattgctgcaatttcatgatcaaactttaatggatagggagttgctacttatggatgagcaaagtaagtggtttcatgagatagtatcacattctacagagaaatctttcacaaaaggaagagtcaactgagtggcagtcttcattgttgtcttattttaagaaattgccacagccaccccaaccttcagcaaccaccatgctgtgcagccatcaacatcgaggcaagaccctccaccagcaaaaggatcattactggctgaaggctcaggtgatcgttagcttttttaacaataaagtattttaaattaaggtatgtacattgttttttaagacataatgctgttgcacacttactagactacattatagagtaaacataacttatatgtactagaaaaccaaaacacttgtgtgacttactttattgtgatatttgctttactgaagtgttctggaactgaacctgcaaaatctccaaggtatgtctgtatttagtcttgagagtcatgagcataaacacctgtaaacgtcgcaagtactttcatcaaatgcatggaagcttatccttagtgtttggacttctctgcagataatttgttttaattgctacctcctctcctttaagatcagtttcctttgaacccaggatgtccttctggtatcttatctatgtcacctcaaactcctatgaaagctttttagtttttttatgtttcttgttcccgaaatatctgcatagagggttggttgccttactgtccatgggatctcctgtacttcaatcatttgcttgttggtttttgatactttctctgccttttctctgctctgctgtttattacagtacattttcctgctcccttaccaattggcttccaagtaagtttggccaataggagtcactggcagaagcctagagggcaggcggaaaggagaagccgggcgtacttcctttttcattctacctccggcaataggtctggctaactgtgtctccttcctggctccagctccctcggagcccctccctcattggtcccagctggccaaaggttccaactccgccttgatgcccatgacatctggggctctggtgataccacctcttgtcattgtccctccagccctaggtataacagaaacttcatgctgtgtgtgtggcttctcagcacttccattcttgagtaaccaatttcccgcattaaattccctttgtttgaaataactagagggtttatgttttctgaccaggcagaccctgattgatacatcttccaaatcaaaaaccttagtataaaaaaccttcaacataccatataaggcttttcacagttttagccctcctcatctctacagccattctgtgatacctccactaccacagactagtaccaccatcatttattagatatttatgctcttttttgagacagagtctcactctgttgcccaggctgaagtgcagtggtgcgatcttggctcactgcaacccgtgcctcccaggttcaagcaattctcctgcctcagcttcccgagtatctggtactacaggcagacgccaccacttctggcttttttaaatttttattttagtagagatggggtttcaccgtgttgcccaggctggtctcgaactcctgacctcaggtgatccacctgcctcggcctcccaaagtgtagtcttttttatcctgaatgatatattattttagaattgggggagggcaaacaacacagtacaaaatgtattattttaatttgcatgtcaaattaaagtacgtgtatgctttccaaaagttaggataaattgtgatcaggtgatctttatcaccttggttaagaagtaaaatacttcagaaaaatttagtggctccttgagtgtcaaatgtgaagacctaaacctaggtgtctctcactatctgaattcttggtatctcaattcaggaacccaatagattattaaataaggagagacactggtatatgataataataactaataataataatgcatatcactaatagcaattataattccttgagcagttactacatcagacattctgttaccttacatatgtcattctaatcctcacaacacaagataagtctcatcataactatttaatacatcacataactgaggtttaaaattattagtggcttcctttttgaccacagagaactggtgacagaatcagaatttaaatccagcctcaaagtcaatgaacaattttgttgctgcaaaacattgcctccaaacctaaactcataaagtgacaataggaaagtcacagtataatcaattagttcccccactgaatgcaccccataaagagtgcatatatcacagtttatattctagataaaagcaaacctgtattttaaacttatcacattatatacattatatttaattatagggggtgcgagagacattaaactaggcagcagtggctctgccgcttaatctctggttccttcctgtaacacaatgatttctatgctttgtcttctaaaacaattgctaaggagagctaccaagtgggaaagaaaatagatccctcctctgcctgaacttgactcaactggcaaaacattaaaccgcataaataacattttcaggtgttcctgtttggttaattatcctcccccgacctgagtcacttgatttgagtttacatttatactttcaaaaattaagtgctctagaacagtgctactcaaaatatggtctttcacaagcatagatatggacagtgtgttaagtaacttctatagcaatttgacattgccatgacatccaaattcatgatcaatgaattcatctcatggagcagggtacagacgaggtcaagtgttgttgaacttgactgttgagttacatgtggtgtgaatgcatacttgtcagtttcattagcaccacctaaaaatctgtgatgtgtagtatgttaaaaaccaccaccgcggctgggtgcagtggttcacgcctgtaatcccagcagtttgggaggcggaggctggcagatcatgaggtcaagagatcgagaccatcctagccaacatggtgaaaccccgtctctactaaaaatgcaaaaattagctgggtgtggtggtgcacacctgtaatcccagctactcgggaggctgaggcaggaaaatcgcttgaacccgggaggcagagtttgcagtgagctaaaatcgcaccactgcactccagcctggcaacagagcaagactctgtctcaaaaaaacaaaaaaaaaaacccaccaccaacaaaaacctggcccttcaccagtttgagaagcactgctcttcagtgatagcttctttttttttttttctaagacaacgtcttgctatattgcccaggctggactcaaattcctgggctcaagggatccttctgcctcagcctctggaagcgctgggactacaggtgcgtgccaccatgcctggccttaaagtgatagcctctttacagaccaagaaagtaaaatataaaaacaatcactttcttaccaaaattaatgcttggtaaagaaatctgtatgtaaatatatcaatataagcaacatttgtctccgttatataagcttctatttatgagggggtgtaatgactttcctggagttatgcaagcgatgaacgctttgtggaatagcaaattttgaaacattcccacagaatatcaccaattcataaataagctaatgattcatccactatgtcataagagagactttcagaatatttttaggtcattttattactaccgtagagggtacagactttaaaaactatctattttatgtgagtgctctgactgttctgaatctctttccagcaaaattgcagctcccaagagacatacagaggtaatcagacttgtgggcttaaaaaagaaatattggaaatgtctgaataagagcagacacgtttttagatgcctttactctgtgtgcaaaaatcatcttctgcagatccagctacataaaattgtacatatccagcacttttcttctagctgcaggtgtaaccttaatgttcctcttatttagatcagtaaactacaatttggcagctcttttaaaactgtaaaccagtcaaagtctaaggaacaattctttttgagtttccttctgaaataagcttggagagatgcaattcagaaatatctattatgttcttcaattagaagctttaaatcaagttatttgaacaagaaaaaatattataatatttagaacagtccattaaaatgccataaattttgatttggaagttacatttctattttacaaatggggaaagtcaatggatcctaatcaaagttaaaagagcagattatttttcttttttcttttataagctgaatagtaaaggaagaacatttataacagccttaataacaaatttgagtaaatctcctgtgctaattttgtcagctagggaataaagaatgtcatatggattccagtttaattatgccgataaagcagttttataaatcatgctaagagtaatggatgttcctttgagaacagagaactcggagtttgtaaaatgtgtgttctggacttggttccttatcttctaccatagtgagtataaatcaaatcaagtcttgagtctcagtctgctcaagtccaaatggaaagaagggaaaagttgccccatccaccggtatggtagcattatttcccaaatcaaaaactggaaggacactcaaagggatgacaggacaaaaaatctgaaactgaaattgatagaaaatccaggtcatatgccacctactctatagctgtgtgaggattaaatatggttatttctgaaaactcttcgccattgtaaagtgctacacaaataaagtacaattattacaaatatgattataggctaggagcggtggctcacgcctgtaatctcagcactctgggaggccgaggcgggtggatcatgaggtcaagagatcgagaccatcctggccaacatggtgaaaccccgtctctactaaaaatacaaaaattagctgagcatggtggcgggaggctgctgaggcaggagaatcgcttgaacgcgggcggtggaggttgcagtgagatgagatcgtgcaactgcactccagcctggcgacagagtgagactccgtctcaaaaaaaaaaaattaaattaataaatatgattatcctattattcatatcctttaggttggtggtgacaaagaggaactgggggtttagggctgacaacattcatacaaccaagctttactctagccaggggttaaaacaaaaccagtcatttaatgatgaaagatcactggccaacatgacatataagaaaatgaagaccaatagaaagcaagggacttgcccgaggtcacaccaaagctggcatctgaatctagctatcctttccagttcaaagcgttatggcagtaaaaagtcaaaaggcagaggttttaacactgagcaatatattaaggaactagaagcaagagccaaggaaagctaaatattgagtagcttagtggagaacagtttagttcacaaaatatgctgagaaaagcattaggacaagctcctaatgcaaaaggaaggaattcatagtcattcagaatcctgcagtttctaacccaagagcatcctcaggagggaatacttaatggaatgtagaaagcctatcaaaagaggagagtgaacaaataactacaatatcccttcctcttgggcaagctgaggaaagaggtacaaggattttgatagcagtgtttttaactctcttgcaaattgctgatttataatgatattgatgtatctttaaaaagcttttagccccattgacttaactaggacttaactagttctcctaactagaactgctgaagaatcacacccctaacctcaggcccagcagaccctaaaattaaaccctcattttaacattctgaagctctctgcaaaccatagacatgaagctaagggctacgtgctgatagactgccttcaaatcttatggtttttaaagaccacttttcctaagaattccaaaaacactcagaagtccatttttgaaaattgagagctttcgcatcattcaggtgagcatcatgctggatagtaggatccaaaaattgggcaacagattaaaaagggctagatccttctgaagaacgctataacttaagaaaaggaaaaccagtaccccttgagaaaacacttgtggttaagagggcttcaatgaaggaaaaggaaattggaataagtaacaccagaacatacggtgcatctagattttaataaactgcttgaaataaaatcagctttctgaagtgcagcgattctctcttcacattatcctatttttacctacatgtctccttcataaactggtcttcttgtactatactgacagtatcacaaatgcaaaaaaactcacattgtaatttaaaaaggaaccattggggaaccacatattttattgtatttataattaagagacccccccccaataagacaggctaagaaataatgtttttaaacagggtctcgttctgttgcccaggctggagtgcagtgatgtaacctcggctcactgcagtctcgtcctcccgggctcaagcgaccctcccacctcagcctcctgagtatctgggactacaggcacatgccaccatgctcggctaatttttgtattttttgtagagatggggagacggggtttcaccacgttgcccaggctggtcttgaactcctgagctcaagtgagctgctcgcctcggcctccaaaagtgctaggattacaaatgtgagccactgtgcccagcctaaattctactctgttggtcagtatatctgtccatatgtaaatactcttgattacttaaatttgtagtaagatttgacattggaaattgtgaaggccaggtgcagtggctcacccttgggatctcagagctgtgggaggccaaggtgggaggatcgcttgagcccaagagtttgagaccaggctgggcaacatggtaagacctccatctctacaaaaaatttaaaaaaagattagccagacacggtggcacacggctatagtcccagctacttggaaggctgaggtgggagggtcacttgagcctgggtgttcaaagctgcagtgagccatgatcaggccactgcactccagtctatgtgacagagcaagatgctgtcaaaaaaaaaaaaaaaaaccccaataaaagtatctctaagcagcatatattatgtgtgtgggggcagggtgagctttttaaaaaatattttcttaaaatttcagtaatgaacttagggacctagacataaattgtgagaaaaggacaggcttttaaccacataattgcacttcatgtaaatcaatattatattagtatttcaaaataaattccagagcatattactatctaacatctactgatgttgtaaatgctttctggagccttgaagagctcagagttttaaatcaccaagctaacctattggaacagtctttccattacatttgtaaaaatgctaatagaaatctaaaactcacctcatgaatcaaacatattattacttctagggagtgacgaagaatgtaccctctcaataacaaatgaatgacccagaggagtctaatgggaaatatctcaagagcctctctatttgacaacagcttgcctcactcagcctgtaagacacggatgggtggcataatcttctcctgttgtttgttttctcagaatgtacattttaaaacataggaatgattacatttttagaaatccacttgtctgcagagttagccgaaaggtacctcttgaaaaataatgatcacagcaagtttagaaacagcctgccccaccctcagcccaaagtaaaagaaaaacaaaaatcttagacacttgtccaatatcgttactttttttttttttttttttttttgagatggagtttcactcttgttgcccaggagggagtgctacagcgtgatctcagctcattgcaacctccgactcctgggttcaagtgattcttcagcctcggcctcttgagtagctgggattacaggcatgtgccaccacacctggctaattttttgtttttttagtaaagatggggtttcaccatgttagccaggaaggtcttgatctcctgactcaggtgatccgcccacctcgacctcccaaagtgctgggattacaggcgtgagccaccgtgcccagccccaatatcctcacattttaaagataaagcaccaaggtctacaaaaaatagacatgagacacttggtctcttatatcccacttactccactactattctctactaccattctatgactattgggggtagtcacagacaaatgctgaaagaaaactgatttccagttgcttttagtgatttattccctgtgaaaatccaagacaatgcttttgtcaaaccattaatgtgatgtaaaaaattttctggggactcaaattcctaatgactgttcagtcatcatagtgaacctttaaattatttctttactatgtcttgctttgtttgtgtaggactctggcaatattttctctcaattttttgtgtaggtacacagccgataaatgagggaaacacaatatttctaacacttgatggaaacctcctctgcaaagccattttagatctgttggaaataatctaaaattaattatcttatattgttttttatctattttttaatcaaaaaagttctattttctctaccactaaaatgtctacatctgcatttttcacaactggacatacagactaaaaatacatgagatgatctctttgagtttaaagttacctgacaaagtccatgagaatcagggtccttaagtataaattatctacatatatgtggggcgtgtgtgtgtgtgtgtgtgtgtgtgtgtgtggctactgctgcttttctgtcataagttctcattagttaatgaattgtagctatagagacactaagtaagaaatggaatgggggtatcgacgaagaaacttttttaccaaacatctaactgtaaataatataaattcattgtagaaaatcagtggaaaaggaatgaaaaagaaaaccacccagaatgtattagagagctccaatggtaatatctcaagcaatattatagcttttcatcagtaaatacttgctactttttcagttctaacaaaatgttttcaccttctaatcctattgtgttcaaaccctgggtgcaggggaacacctgaatgcttttgagggcaaggcaggtaacataaacatgtgttgaacaggctgcttgggaactttggcaaattagagaatggaaatctccttagaagtgggcgtctctaggaatgtgtaacctaccatgcatactgtgaaccactgtagcttccacggtagagtatgcctggagtgggggtacagagggaaaaagcaacatcttgatattttcagcacctcaccagagacatgaggttcaggttcgattaggagagggggctagatgtggtcttaaacatttgacacgccagaccacaacaccatttctgctttcaagatacctttcaccaactgactgtagttgaaggcttccgaccatttcatccagctcaaagagcaatttggacctaaagggatacctcttgaagaagaaaaatataaactaataagtaaaaactaaaatcaatgaaaagtttcttttcagtattttatgcttatgtttcgactctgaaacactgtaattttggagagggggaaaggcagtgctggtagttaatcttatatgggatctcaaggatgtaggcaggctgggcgctgtggcttacgcttgtaatcctaacaatttgggaggccaaggtgggaggatcacctgaggtcaggagttcgagaccagcctagccaacatggcaaaaccccgtccctagtaaaaatacaaaaattagctgggtatggtggcgggtgcctagtaatcccagctactcgggaggctgaagcaggagaatcacttcatcctggggaggcggaggttgccgtgagccaagatcgtgccactgcattccagcctgggtgacagagtgagaatctgtctcaaaaaacaaacaaacaaaaaaggatgtagccatataacaatcattctatatgtgccaggcaacagtgaaaggagtgcccattgtttaggacccaccataccatttccagaaataccactcaagtaacttactattcataggtaaaactatcaattcctatatacgtgtagcaggtatgtagtaaccaacataaatatactttacctagtaaataaaatcaatgagaacagtgaaagtactaacagaaaactgaggacaaatccaggtgtagccccacatagctgtgtagccctgatcaattcctccctgagcctggcttcgctgtcctgtgaaatgtggatgttgataccatccaccatgcaggttggttgctggcacatcccatgtggaaaacatacaataggcccgcaataaatgggagatgttatctgatgaatcaccacttggataaaagcccaacgaatgtttgattgttacaaaactattggaaatattaactctgaaaggtgaaaagcaaacttcaacacttagttcacttgcaagtggtttgttattgggctagcaagaaacagaatttcaaagggggctggaattgatcacacacttacgatgacttccttttattatataaaaattatacctgaaagttgatttcataaaagagaaagtttgcaataaatgagttctaaaatcccctgcaactgtaaaattctgttataattcaaaattgagtgatgtcacaagcccaatgtcacaagtcatgagagattatcagttttgagtttatcaccacatctaaagtatggagaaaattttagaaatataatgattaaatgtatatttaatttgtattaaaggagcaaacatgtattcattgatagtccataattagcttttcatcaaacatgtttgcaatttctcattacagagtaattgaaagtggtagagaatactatacaacaaaatggaaatatggccatggtaatacattactttccagtggaaaaaaaaaaagcaagttataagacagaatgattcaacttctataaaaatatatgtatagaaagacatttttgaagatcctagactattaaacaccagctaactctaagaagtggggttacgaatgatttgtctcttctttattgttagcctgtctatatttttaaacttcaaaaatatgaataggtattaattctataataataatgattttaaaataagagtgaattaaaatattacaactagaaattactgtaattagagtaggaaatgttagaagtgggctaaatctgtgtaaaccacaggttacgatcaggaggcccacagactaatttaaattagctctttgtggacagatttctagtttttctcttgtacaatcaggggtcctgggagtactgggatagaaagaccagcttgcccaggacagctgctgcccacttcagatgaagccttttcattctctcatttgccaaaagataagcattcacgttttccacctgtggtataaacagtccacaattataagccaaaaacattctgtaggggctggaaatgtagcacttgaaaattagctgatcccaattttatttaaaattttaaacgtttacacacttataaccagactgaaatgacataatattactcgaaatgtattggatctctctggctagtataagtgactttgtttttcctttttcatgttttttatttacatttttcaggttttctagaagacatttaatcatttataattagaaaaatgtttaataaaaccattttttggctaatatctcttctctagtccttggtgtctctatagctgcaattcattttgtgagaatctatgacacaaaagcagtaatagctacgtaccccctgacacacacacaccccacttacgtatacctacacagaatttatgtttaagtaccctgattcccacagtgttcatcacataaccttaaatccaaagagatcgccttatgtgtttttctatcaatatgtccattcacagaaatgcaggcttgaaaaagtagaaaagacatgacgtttttatattaaaaaaatacataaaaacacagcctgggcaacatagtgagacccatctctacaaaaataaataaaaataaattttaaaaatgagctgggtgtggtggtgcattcctgttgtcccagctactcaggaggctgaggcagaagaaccgccatgagcccaggggttcgaggctgcaataagctataaccgcaccactgcactccagcctgggagacagagcaagaccctgtcccaaaacaaaacccaaaacaagctgcaacttaagataactcatttcagaatattccttgtagatctaaaacgacaaaccagacatctggacatttgtccagtgtaaaaagactggtgttttcaaacccttatttgtatgctctgtacccattcaaaataattcaagttatgaggggaaagaaaacagaactgtcaggctcttacataaacacaaaacaagccatactaaagaaatcatttaaatgttcacattaatgacccgccaggccttaggaattgtgagcaccggaaagacggcagaaaattcctttacacaacatttgtggtttggcaaaagggttgtcttggtttcacacggaagaaatcaacaagcacctgaaacagttttctatcttcgtgggaagaaaaaaaaaaatagccataaattgcaactgtttttccatcattttaggcaccaaagagaactacaaagacctataggccctctcaggtatattgaatttttaggaatcaatcaacttctaaaacttgtttttaaggaacctctgataaaaagaaagctgactgtcaattttggataggaaggtgccactgctttcacccttgaaacaatctagtgatgtatttatatagcaagtaactttcacactgcaaactactttatcctaaaggtcacctgtcatttaacttggaggaaacatggccatgtccttacctaaagactggtagagctctgtcattttgggatggtcccagcaagttgtttgagtctcgtggctaaaacacaaaacataaagaaagactttagcatttacaatgagtagtcaagaaaacaggaaaaaagaaaacaacaataacaacaacatgatttttgcttttgaaccattcggaatctttatttcaaagcgcttccatagtgtattgaagaaatgtttatcttacaagcagaaaggcccctttctgctttgtttccaaagagaaaagcaatataaacattattcggttccagaatttgtttcttctttgcacccacaaatcgatcgcacttcagttatgataaattgaccttgttatgtgatcaataatcgactatcaggacttcttcacccatccaatgtggaacactacagaaaggacaccgacaactgattattattcaactctgtcaaagagataccggacattagttcaataaatataaatcatctcacttctcatttgctttcactgcccctgacatttttccattactctttcctctacatatacagatctcatatccatgatacctgtatttcatttcagcttaaggtatatctactgcctgactaatatatcataacttccttcttcccattatttcagagtgttttttctttaaacgcagtacgctatacaccactacacctcttcctatatttacttgggcctgaatgaagcattcacagctgtcttccatttcttgaagtgtggttgctggctatcagctcctgccacaaaaagaacaaaacacctttgttcctcattcaattacatgaataaaccctggagaaataactacatatacttttccttactttggcccatctacataaatcaccatagcgtcatatttccagttttcagggattgcatgacaggctttgatacagtaaaatgcagttctgaatgatatttgggtactcatatgcagagcctattcataaacttttgaggggaaggggagggaaggaaaaaagagaaatcgcttaaactggggcatttccagaggaccagaaagtacaggggcctcacacagaaagaggagtctggagaggcaacaatgtcgaatggccttagcgtatgttttgaattttagggctctgcgccctactggcggtgaaatttaaagcaagcctgcctaccttggagggttaaaggattagttgaaataggtaagtgaccggcaccatttggtgctcaatatgtggtcgcttttggtatcatgtgcccctcaaattgtcatctattaaaagcaaatctgttattagttgattacaatatagatgtggatccaactgtaattaagtcaatcaaggcgaagaaagacccttcctagagagcaaaaccaacacactacatgttatcacctatgtttaaaaaaaataagttaaaacaaccgtttaagttggtttaagaaatggaacacaatcataaacctcataaagacatatggaaatcatccaaactgtacaacttcaaagaccatccctgtaatatttactagtcagtgattgaacagtgagggctactgaaatcaatttgcaagaaaatgttcacttgtgaagtgctgtttcactgtcttccaaatacgtttatttcagttttacttttccatagagacaactcacatttgaggactataacaagggcttatcagttgagggaatataacagagtgacattcaagtcttaaagagcaagaagagcaggagatatggtctctatgctttaaggggttttaggacaccccatgaccaagccggtttatgatctggagaaggggtaggcaggactggtactttacatgcacagcacaaggaggctgcagcttgcagcttcgtggaaaaagtgttgcttgttctcaggcatttctcagctcggaaagtgagtgtataccaattccatatataagtgcagagcaaggaaaggttaccttctattgagaccaccctgcattcaggcctcctctatttccaaaggtcatccagatgtgatataagcaccagggagaaaggaagagcgaagagaggaagcacacacatgtgtgcccacatgtacaagggctcacacaggcccttactagtcacactgtgtaacaacaatgtcccatctccaggatatttgtaaggaccgtagcatcttctataggtctgcagaaaaacatttagctgagctgataagcctgatcagacagagacagggaaccacggtgaaaagccaccatctggaatggacttcaaattagaggaacataggcaagaaataaacctgtaccaaacacagttctaaaaggaaagggaaacagtgtgtacaatttacaggagaatcccacatagaatgaatgagggcttcatggagctccccatcttctaaagaaatttcatgactgttggcatacatacattcctgcctttttaaagaatttattttgaaggttaaaattatgaaaagggttttagaaattatttttttttaatccatcagtcctcggcaaaactgaaaatctcctttactggaagaaggaggaaattctaagcccccaattccattgcccatttgtgagttaagatactagtccttgataggtactattctcccagttatctgtgattctgggggacttgaataacatagataaatgaactcctcaaacaattccagaagctaacctttctcaccttcaacacacaaaccttttatttctaagcaatgcaaaagaactagaaaaacagatttagatttcacctttgcagtcttagtttcacttcaattgcaaatcagttctaagcaaaagaagtgagcacaagtggaaagaagaaaagaataaagggtgtgactaattcttaaaacgagaaaaatagtcttttaatcatttaatgctaaaaatgcttggcaacgtagccaaaaaaccttcagattctttggtaactatatgacgaaccaaatattcacttcacggcttgttattttctacctgtgatgaatccagagccccactgggacacatttaaccctccaaaatagataggaactatgaatatggactggatgaaactgtaagcacaaatctgcataactcatatctatcttgtaccttgaaggacaaaccacatttttgtctgtgatcaataccgattttacagcttcgtttcttactctgtgcctgccttctaaaacagtagagaattctcagtaactccatgagaagagcccacatttacctggaatatgcagacgatatagaaaaacacggtgtgctagggaggagggagtggaagggtgggtggcactgttttggtaattgtctcttttctgcatttcactctccacatcggaaatacactccccatataccatgaacaaccaaaagggaaattctgaaacctgttcacatgttaatgggtacatctttgtttggcctttctgagaacaacaatgttcaacatagatcacaagtctgtacgtacattaacacagagatcagcttcataaataatccttaaaacgctctttacatctttaaaaaatgttattgattttggccctgctggttccaaagcctggcatcagatatgcctctctgagcagtatttatacgaagatttcccctctccttcttctttctacaaaccatgataatctttttcccttttatttgaggcggtgataggaccctgatgcaaattaaaatataaagtcatcgactatgacaaaagaccccagcaacacctacttgtcaataataagaaattaaagcattactctactgagcacaaggctgacctaatttcctaccatacaatttaaattttctctcacctgctttagtttcaagtagtgtgcaaggttattataactgcctcagagctgttcctgctgtcagtgctggaataatcagacttattggaattgcttttttagtttcttaaaaacaaacattaaacacttataaaaagtaacaaatatctactgctgtggctgggaaaatggcagttgcctaattaaaataagatttcttctgccaccattgttatttggtactgaaaatattccaaacagttgcctttttaaaaaactatctgtccactacttcccagggagaaaactaatcgctatgcagcaatataaaaagggagcgttctcttgcgatttgcagaggattagagtttggtttcatatataatctggagcccattgatccacacacacaaatgatttccctttaatctgaggatcagactctttttctagaggaaccttggcatttgcgtgctgaattgttgaacttggcttgcattgctggaatactggcagggtgtggatggtaaaatatattttaaagtttctgctaccgtggggcaggggtttggaggggtgggcatcaatataagcatcagaaatccattctagttccccatttcttgttccctgggatatttaccattttattctgtctggctaaagccagggcaaagatgattgcctcggtggctgttccagctgttagttgtcctccgttttatttgcttttcaaggtttaactcctacccaccctcaactttggtcaaagcaatttcttttcagggtcgtgtccaatcggagatcaaacaatgatgactgaaaccaattccacggtgttcaagggtcagagacctttcatataaccgtgttgcttcatttgctccactcgcttctccaacagcaaatgtatcctccaaagaggggcttgagtaaaaggcaataaaaaagctaggcaaaaaaagaaaggttgattgggggtgtggggggggggggggtgggtgacaaggagagatgacagggataaagcagaagaccaagaagagtttattgcccaaggaaaaatgtagatttcacttaaagacgccacttaaaagttcaccacttaaatcggatggatttttttcatgatgtaaaaacagtttataattaatattatgcctccctcgagcaactaaaccccttcaatttaaagcttcaaacttaacttcaaatttgactaatataagcaaagtgttctgccctttttattgccgtgctgggattgggagtgacaaactttgcttgaagatgagcacagacacctggagaaatgcgagagaacaccctagaaatgactccacacccaatcccgaagggcaaaaaaaaaaaaaaaaaaaaaaaagcccaaacaaacaaaaatccccaccccctgaaatctttgacttctgggctttagttgtttgttctttctttcctgatttctgcaggtcttggggcatggaatgagcacggtagaaaatgcagcgagggaaatgtcagttggaatcctcggaagaaatcaggcagaaagttgaccttttggcacttgcagtgcaatggaaggtagcgccgcgtgcgccccttccttctacgagtaagagcgacgatttaggaacagccagccttgctcacgtccacactggcagcctggaaaggagtgaaaagctcccccggccccaatccccgcgtgaggaacgcgttatcccctctggggacggggagaaatcagctttttctctccgagcccgtcccaaagccgagggaagaggttcccccactagcccggcgcctggggagaaaccccgggggcgcacctgcagccgcgccgcgggaacccgcgggagaggttcctagacgcccagccgcccggcgccccgggtccagccgccgcgcctgtccaagttttgaccgcctcagcttgccccctgctcgcgccacaagtgcacggattgcggccatcagacggggccggggccgcgatccacttaccctttgagctgttccctcatggctgcaagggctccgcggtcgagtgtgggtacgagtggaggagtgagcttcccagagccgccgggctccccgaaagtggagcgccgccgccgccgccgcccaagctcacagctgaaagcactgcggaggagccggcgcgggcgggccggggagggggcgctgcgggcagacggggcggggccgtgtcgggctccgcccccacctagggacctgggaacccggacacccagagactgggcagttggggctttcaaaacggaaaggaaaaagaaaagagaaagaaagaaagaaagaaagaaagaaagaggatggggatttaaggtagacccaggaacctggaagccacacaccgctctgctaacacctccttaaagcctctagcaagactacttgttgtctaaataaatgacccaggtgcaaatgacctcatcccagataattaagagtgtgggcttggagttttctttttaaaaaataaaagaaaaaaattatatacataattctcactctcccttcctcctcagttgaagattaaagtggccggcgataaggacgtgaaattgccgttaggctcatcctgggctaaaagggattgttaaaaagactttggatttggatttgtgacatagcagcggatctcaaaatgtagaccctgggaacagcagttatcagtatcacctgcgaacttcttagaaatgaaaattccctgggcccggcccagacctattgaaccagaaactctgagcatactaatgtttgagaatcactggtatggactctctaaattaagacaataccaccagtgctgttgcacggtttggtcctttagtattcttttaggaagatctagaaggaacttgtttctaatagaatattttattggaaaagttacagggcctgaacagttcaaataattctaattttagagtttgcagtatgatgatagaagttaactacacacaattatttcaagcttggaaatactcaaaagaagaagaaagccttcattagcacaagaattttctgcaaacttcacataacaccttagattagcatccaaagagcatcttacgataaactgttagtgatattttcactgcccttctttgtccatttattttgttggcttgcttttctttttattttctttcaaacatttgctttccactctcctttccgattgattcattccacttcggtctacagtttaaatgtggtcccctttttaaaatttatttcttaagggatgggggtctcactgtgttgcccaggctggtctcccaactcctgggctcaagcaatcctcccacttcagcctccaagtgcctgcgatgacaggtgcatgccaccatatccggcttcttttgaaataatccttttctgctcaacatttttccccctagaatgttttaggtggaagcacacccgttttgctttatctaatgctatagcatggcaaaagaggcaaaaataaagtatctggacaaaagcaaaagggaatgccaggattctttattacctttaacaaaccaaatataaaggtaaatgttatcactaaagatatgtgcatgtaagtatgatcggtattgctatttttaagcaaatatggcacttcttctggcattctggctcatacactgagattacttagtgttgccctttagcaattttaagctagtgagttgtggaggcagctgctattacggtctgaggggggcacactaagatttgctttggctgaagttgtcccttggtctaatagtatattctaggtctgctccgatccttggggaagagggattagtgtcctgtaatgaggaagtagtgccctttgcagtaaatcagagacaccaatctctgtgtcagtgtggcaaatcacttaactactgtttatgtttatttcaacgaaaagacagaagcctcagagcatggacatttgtaaatattacaaatcgataaactaaggatttgtaacacctggatagtaagacatttgtcactctcttcctttcctgttttttgtttgtttgttttacacttttaaattacctgctcaaaattcaggagttctgacacgcttctctataaatgcttaagtctcttttctcagtgtccaattagaaaactactaagaataatctgttgacaagaaaaaagaatggaataagaaatcactattcagactttttaaaaaaattgacagatggcaatcctcaaaaatacatctttaagttcttttttagactggagttataggcacttgaagacttgttcccaaatcttgacgtcatattataattaaatactgaaagtattaagaaatgacgcgggcatcacagagactgttttgttgttcaattgcagtcagattatgaattttgcttattagaggaaagcatttggaaaagaacataattgatataccttcgtgtcatatgtaaattatgtagtgatgccatgtatgataatatattgtttgtttatagtagatgtttcttcttctcctccttctgattatattattattattattattactgttttgatatgaaccacggacatgaaaagagcctgaagctctgctaccagaacaaacttcagctaaaattttgacttcagaatcagccatgacctacttgttcccagtaccactgtctagaatggtgcaaggattggaattggggaatccagctcgaagactcatgcgcttagctattctgctatgctgccatgaagagacatggcttcttttcctgtgagaaaggtctgtgttttttctagtatactcatagacaatctcactgatggctcagagcagagaagagtaaatttgctagaaatagagataaagaagaaatgaaatgggatgaggtcaaagaaggcgacccagtacattttcccgtagccaaaactctggtctttgaaccacttaaactttgagggtatctttagagaataagggcatctctgacctaagggactgtgcaggatgcttccccattctcccatccatctctattctttgtccttctccattctgctctgtggcccaggaggttggacctctgtggggacatcaatcaggctttcctgccgtttggcttccttttgctttcagccaattgggaggcagtgatgaaaggcctacagaaggagaggaaaggacaggaggaaggtgatgtttgggtatttattcttcaggttccctcctactgatctctggcctggcagctgctgagttccttgacctgcagccacaagtcttgttggccagtcctttcctacagcaatagcattccaccagttacgcaaaccattcctccctttatccctttgggcaaaagtttaccattccttgtttttttttttttctcctagcctgcctagagccttgtaaatagccttttcattatactctcttcaagtgttccgtttgaatgtaccatctgtttctcccaggaccctgaccaaactgagacccatccagccaaagccaccctctggggcaatagacttgatgctgagtggggactactgatagaggagaaagtcagatccccccactctggggctaaaaagcagatgagactcagtcattggataaatattcagagaagcctcctctgtaggcccacaaagagcttctggccttttgagggtaaaggcatatcaacaattatgatggtgacaacagcagatgtgagggtaaaaaggatgcaaccagcttgttctttacaagagcttcaacggtctgcttgatcttttggagagaatgtcaagataagggttagagaaatgggcaaactggaaagggcttagtgtgacaatctggagtttgacttgtatcctgaaaggtatgagggagctttttaaggaagaaagaattaaagcatgagtgtggctctgtccggtttgtcttttagaaaaatcactcaggcaatggtatgggggcttgatcagaagacaagagtctgaaattcagacatcaggtacaaggagattgcagtatgaggaggatctgaattacagcagtggcagaggaggtggagaaatgatacaataaggttccaactacaggagtcttgactgactggatgtatgaatggaagagagggaagaagtaaagcaatagtcctcaagcttggccgccctttggaatcactcagggattgttaataaatttagatgtttgggtctcaccaccctgagattctaatttaattggtcttggacattaggatttctaagactctccaagtgattctaatatgcagtgaaggttaaggaccattgtccttgagtgacaacaaagattggatgagtagcattctccgagctaggaatttcaggaggagggggcagaagagggttaggaaagagatgatgaatccagtcttgaacataatgaattggaggtggtgatgtaaaagtgcaggtatccaagagacagttggacatctgagtcttgagctcagagggaagatgtctgaattggagctatggatttgcagtgtactgttggaagggtcttgggttcgaatgagcccatctagtggaggctgtgaagggccaacagctgaaactaggctgttcctaccttccacaaacacatctttttcctttctgggttgcatgtggtttcaatgttggcctgatgctagctgtgtaaaaatgcagagtggcataggaaaggacaaagacaaggaatggtttgaactgggtacttgcctggagggatggtcccgagagacttcaccaactcctagggttcagcttctctctatctatagtgcgccctaagttttagtataacctgcatcactttataaaaattcatttagagtataggtatcacttcaattaactcgaatacatattctatagtaaaatgtcagcatttgggtatacaataaagacataagaattccatattcctctttgcatagtacaagtactaaccatgaacagtgactcagacatctaacaaatgggttggtgtatggtgaatcattgctggttagggcaaatattatagcatactaattgaaatatatatataacaatccccctagatcaatctgaaaccaacatcttctggatgtaagaatatccagccaggtcacattaaccagcaaatgaagaggcctctaagttcagacacagagcacttcacacccacacaaaagcctatttttccaggccctgtctctttagggaggcagagtaagccagactcaggaaagttctctgtgagccagctgccatctaaaccagagatttcaccagacaggttccagataaagtcgagctctgcttcactctcacacagttttcttttaataagatttctcaaagcttcacagagccacctatatcaagccgaacatctaaaaagatgtgaattttagcatcttcactaaaataaagccatacttcattaacctcacaggccgacggttgcttcatgggaaagaatttggagtacctattagcctgccagctatagcgataacccatgtatatgacccacaccacctcctgctaaaaatggatcactggttaatgtggttcaagtatatctgactacagcattcctggtctaccttaacagctcaaacttgtaactatttgtctgcctttccccaccgattgtgccaaataagcggaatttcaaaactgggcagaaattcttacactctgcataatctctcttcctcttcagctacaaataaggctttgtattcgattagactcacagcaggtgaaaaccccaattagtgaattcattctgaggcctctaccttcctcccacacaacacatttttgtaaaaaaatcagggaagtctgcgtctcttctcaaatcagaagtaaattaaccctttgatctacccaagcaaactatttactgcatgaagacttttcactgcaaaatgggaggatgttgaaagattcctccttcttgactccataagggaggttacagaaaattctattttatcagactttattgttttcttcaaatccataaatactcacattttctgatcaatctagaaattacagtttttctttctacctgacactcacaatgctaatattatctaacaaaagattaatggacagtctactacaagagagaattaatttttagttatgttcttattttggtgtatttgaggtgagaaaaaaaattaaattttagtttaaacagtatgctttggccttaggaaaggcacagagtctatatttcatactttgtaaatatttatttgtcaaagaaaattcatcattggacaaggatagatgtttggttgaacattaaaaaaaatcaacgcagctttagttcttagagtgatttactcatactttgtcaattgcttctctggaaacaattcacaacctagttttatttatgaacatatgattaaaaaacagcagctttgtcttttttaattgttttagtcctgtcacttttcttgaaacaagtcgtaggacttacccacaagaaaatactgagcatatatcaagtagtaatgcagcttttagaagtagtcatctgttactgtcagaggttcatttcattttgagtctttttaattaaaatgcaaagttctacatacatgcctgcctaaattacccctttctgaaatactcaaatttcaaaaaaaaattttaaatgctaatgtaaccattgttaatactctagacttgcttcttgagatttggaaaaaagtaaacaaaggaattaccagtcaattaagcgaacaaggaagtcatcctaagttgaaacagataaggaaaatgtaataatcaaatgctacagatgaagacaccagcgtttttctttttttttttcctgagatgaatatctacaagaatcacgctttatcaaaagcagcttccttaatcttcagcaagcgtagctgtgtattatagcaaaggcatgaagatagaggggcagagtgtccagaccaattctaccccttagaggtgggtcacttaaccctttacaggcaagtcacttaaccacttggaagcttttgttaactcatctatagaatgtggataatactgccatattgtgggtcaaaatgacacaacggctctgacagcaatttgaaggctggggaatgctgtgttcatgcaaagcagcctgtcaggcaggtatgatttcttaaaagagaactcagtatgttcaggaatagttaggtatacagaaccaaataaattcactttaacattctgttttagattgtcgtgtgagggaaaatgagaggtctgagtttagtaaactgctcttctgtaaactgctctttagcagtttacaaaaggcacctttcctctttttgctttttacacttaagaaggaagcaagtaggaaaagtaagattttttttgtgtgtgtgcaagataaggcactagctgtagcctgagataggcataaaattcacagcgtttgctatcattcagtggggccgagattaaaatatgaatagtattcacgcatgttaaaaggtatatccatgttcatattctcagacagcagaaacctggagtagtcagagagcaagtgaatattgatttggtgggggacagtgagggagaaatatcccctagcttgatggagaaagtctcctggtggcaagccttgaacagccagcaagtggcaggaattccacacaaagacagggatccataaaaggggaaataagataaaatccagtttaaccaattaatgatctaccaatgtctgaatcttgtactccagctctggcttacttttgtcaaggcatgttttcaagatgaaaggaaaatacagatgcaaggaacttttatttatccacaaatttccaagaatgttttttatgtgctctatctagactaagtttctctattaaatattatcctatattaagttctttaaataacttcaaacatagtgtatttatggaacacttacatatgtatttgcttatcatttaaactcttctcattttttctttatggttggtaaaaactggggagtgtttggagaatgacatggaaatatataaaaatttcaacattgtaatccagtttttttttaagtgggatcccaaggaaatatggccttttccttaaggagcttatgatctaatgagagaagatagacccatatatagctaaacacagtatcagacagattataataattacagaaatagagagaaaaaaagcagcaaaaagggaaaggtgattagtttggcctcttgggattagagaatatgcacttcaattaaaaactaagtaggctttaatcacctagttagttcttaaatcaggttttgtgtgtgtgtgtgtgtgtgtgtgtgtgtgtgtgtgtgtgtgttctttttgctagaatatgaagagttgaaacaagtttcttacattgactctgtgagctaatcgctcatattaataatttactaaggtacagagtttttatgttaatatacagctgtgttacgacatcagtttaggctttttaggaattcaaaaatgtatttggccaatattggatttgatatcttgggaaggctaactggcagaaaatactactttccccattaggacatcaaagcacattattgagttaatatgaacaagaccttcacgtgggaattgaagtcctcacagcttgacctactctcatcccttagaaacaggtcgacaaagaattggaagcctctttgcatatgatggatagagaagaaaaaattggcaccacctgtacttttgaatatctttctttttaaaatagaattaaatttgaggtgggaagaaacaagggtggaaaagagggtagggatcagaatggaaatgtatgccaagtagatgatgacaacagcccagttaagagtggatgaaagtctgaactaagaaaggagcactgggaatttgtggagaggctgaattcatgacaggttatagaataaaatcaatgctacttttgagccaattgaatgtgagggctagaggaaaaggaaaagtgtaggatttttgataatggccctattagctgtgcattcatggattcatatttgtgtatatactatgtacatatttatactgtgcattgttctgtaaaggctttagggcaacttataacaatgtataactcttaaaaattaataaaacccagcactaaggaaatataaatagcataaaactttaagaagcgaggaaaatttagaacacagatttgttttttgttttttgttttgagacggagtctcactctgtcacccaggtcggagagcagtggcacgatctcggctcactgcaaactctgcctcccagcttcaagcaattctcgtgcctcagcctcccaagtagctgggattacaggtgcctgccaccacgcccggctaatttttttgtatttttggtagagacggggtttcaccatgttggccgggctggtgtcgaactcctgacctctagtgatcagcccaccttggcctcccaaagtgtagggattacaggtgtgagccaccatgcccagccagaacacagctttgaagatcacagtgcatgatgtggttatgaaaattttgctatgcatacccaccagaatgagcaagacaaacaacacagggttagaaaggatgtggagcaactacaactctcatgctctgttagtaggagtgcaaactggtacaaccacattggaaaactgtttggaagaatgtacagaagctgaacacacacagaccctataacccagaaattctaccccttgatatagtcctcaaaggaatgcatacatatattcatcaaatggcatgtcttagaatgtttataacatcatttttttctaccaaatgcccatccacagtagagtatataatatactgcaggatattgacacaatgggatattacatagcaattagaatgaacaatccaccacttcatacaacagcatggatgaatccaggtttaaagaagtcagacacaaaagagtacatgctgtgcaatttcatttatataaaggacaagaacaggccagaatatttaatggtgttcaaaatcaagattgtggttacccttggaggacaggtaactatcagaagggcacacaaagggccttctaaaggttggtaatgttctgtttctttatttggatgctggttaaatgagtgtgttcagattgtgaaaattcactgaactgtataagtttaagccattttttctttttttttaattgacaaataaaaattgtatatctttatcatgtataacatgttttgaaatatgtatacactgtggaatggctaaaccaagctaagtaacatatgcattacctcatatacttatcatttcttatggtgataatacttaaatctactctcttagcaattttcaagactatactagattttcattacctatagtcaccatggtgtacaatagagctcttgaacttattcctcctaaccgaagtttcatatcctttaaccagcatctcccttattttctacatgcctaatatatttcagtaaaaaagtgttttaaaaggtgggtataatttggttgtggcctttgtagatgtcaaagcaaaagaaaaaatataaaaggaaatatgatcgattttattatttggattattgataaggaggaaagagtgtaagtgaaacaaaggaaaatccaagtctggaatgacttagattgaataaacagatctgcatgggatctaaggtgggagacactgcatggtgtcgactttcagaaaaatcccttcagcagttttcagtgcccctcgacataagccaggaacatgatgccgaggtacacctgagttgaggcaatcttatgggggccaaggcaaagtggtctaagaatgcagctttctgatgacctggcctgaggtggagataaaactaactacagtgtttttcaaactgcaggtcatgaacccttagtacgtcatgaaatctatatagtggatcattaccagtattgttcttaatgaaacagaaaagaatagaaaatatgacagtgtagaggttggagtggggaaaatgggttataaaactacctattgggtactatgctcacaatctgggtaacaggtcatgagccccacaccttagcatcatgcaatgttcccatgtaacaaacctgtacatgtacctcctgtatctaaaatagaagttgaaattaaaaaaaaaaaaaaaatatgaaagtgtactatttggtatgggtaagtaatgttttgtgaaacttttctttcaatcatacaagcatgaatagacagaaaaagatttacagatatagatgcgtgtgtgcgtgtgtgtgtgtaccaggatgacatataaaattaatttttatagtggattggcaaaaaagatgaaagctacaggctttactacataaagaaatggacaaactatacatgcccactggacaatcatgcatcattataatttctctagactaggatttggaaagaagttgacggaagacagtttgcagtcttattccctggtaagggctggaacattacaagagactggaggaggattaaaagattcaggagggggagcaagttggggaggcgttcatcaagtctgaagttctaaccacatgagatgctgcaggggctgagaatctgctccaagttttagggggtgtcttctctgccagctgttcgtttgggtggctgtttgggagtataccaggaatcactcagcctttttgttttcttccaaatggcatggtgatattgtcacattgcaggaggaaaaacattgctgctaaaagtattgttaaggggagtaacaggtagctcacactactatacacaactgcacgttgcctgtctgaacaaaacacttcaaaacataaactgagaaatgcccttctgcttccatcttgcagtgagacctaattcaaagtccttgctagtgtgctcaggtccacgccaacaaattggcaagtgtgtgcctgacagaatggtcacattttagggctggatggtccccattctatttaatgcttataaattcatcctattaagtgcttggggaaattaatctgaataagtgtccatgaagactgataattatcatgatttttaaaagtattctcatataattgtaggaacattttagacagtctgcagccatgggggtattaagcatattatgagtaaaaataacagctttaagaataaaattcctttcaaaagagtgaccagctttgaaagttaccagaaggaaacccacaatctttcttttttcagtatttaatcacagcagctttcattaaattcccagtactaataagtggttaactatgtttgtaatcagtatttcttatatttttaaaagcactagattatggatgctgtatgtctaccattggctgtgaagccacaaacagtttagcctagcaatgattactcacaaagcatgaattttaacagcacactccattttacctacatctaaattcagaagagaatttagtccacagaggaaccttcctgtaacttttcttgaatattttgtgatatcttgcaacatggccaaaagttctagccctctccttggtgtccagctcttgcagtgtgcctttgtatctcttcccaccaacaggtggagtctttccccactccttacatctgggatggccctatgacatgacttgcttcggctaatggacactaccaaacatgacacaagcagaaacctgagaagtttccatgtgaactagcctgaactagcatgttggatgatgagatacacacaaacctagttgcatctgttcctagatgacagcctgtcaaccatcagacatatgagtcaggtcacgatagcttatccagctgccagctgactacagatgcataagcatgcctggcaaacagtagtacaactggtcacaccacataaatggcccaatccacccatcaaatagtgagctaagtaaatggctggccattgtgttatagagtttatgaactattgttcaaatttggtctatggcctgcttctgtacagcctctcagctaagtatgactacatttttagagttgtaaaaagaaaaagaatgtgcaacaaagatgcaaagtgctccacaaagcctatagtgtttactatgttgtcctttacagaaaatgtttgctgacctcagtgttaagccagtaagttttggggttggtctgttatacagcaaaagtagctgttacacatctgctcccaagaaagaacgttagaaactaggcctttctcacaaattcagttagcacctagtcaatttatccttggtgcatgtcctccagttgcttgttaataagataatgctgaaatgaacagaaagaacaaatacacatataacctgggaagttattttagtaatatgcttctcaaaagtaagattttataaggggtatttagaaaaacaagtatacaatttttagcagtcttattcataatatcctcaagctggaaacaaaatcattatgctgaatataagagaccagatacatacaaaaatactgtatgattctatttatagaaaattcttgaaaatgcaaagtaatacacagtgagagaaagacgatcagtggttgcctagaatcaggggtgaaaggaaaaatgacctgcaaaggggcacaaggaggcttttgggggagtaagaacgttctgtcatttgactgcagtggtggtttcacaagtacacatctgccaaaaatcgctgaaccactttaaatggaggcagtttactgtgtgtaaatttttatttaataaagtttattttaaaatttttttaaaaaagcgtttgccctaaaatcaaatttaacattcaaaaatgcatacaactgcacaaagaatgaggtgcatcacacaggatgtttacataaatataggacagattcaggtcatgctgtcagttcccttctgattaattccgaaaatatcaaaacattagattcacaagtgaccttaaaggttaatgaattatatcctctcatccaatacagaaattgcctttaggggtgagacagtcatttcagtcttgaaaatctactgtacagggagtttaatgcttttcaaagtggcggattttattttttggagagctcgattacaaaagtttctttaatatttagttaaaatatgctttcccataacttccacatatctagctcaatccattctcagaataaaacaggaaaaaaataacaaaagagagttcacagtagtaatgaatgggcaaaactggccaaatgaggtcttcaggcagagggctgagttgagcttaagagatgactgaagaagaaacagccatgtgcaaaggcagggccaacgacagagactctattttgtgttgatctagatctattaattgacattctttagatgtcattatttaatcagcttcaaattcagcctattagccagccccactgttctttatcttgtacccaatattctcaaaagagaacttgaaaaatgtggtgtaaaatcctaagttatgctgtctctaacagtcttctcatctaaccatcaagcagccataaaaaaaatgaaaatgaggtgcatgtgacatggcagattttgagagtatcacgctgattcccagcagcatgttatcctatgtaatcattaataatcagtacgatgtcattttccaggattttgttgctcatcaacatcaaacttattggtttgtaaattttaaaattcatctctttactttttaaacgttaaaaaaatgttttctaatctccttatatgacatcaccaatcccttcccatgttttctctgagttttccactggcaactcttttcatgggaggaggagtgacttttagtggatactggataagaagaatgcactcctgttgagtagaatgagatcccatggcagcacttctaacaaattagacctagtctctgaacaaaaacaatatgagttaagatcgtccctaagattatctagaaaagaatcccgttcccataaagctgagtaacattttggtcagatttgtgtcattttaaaagccaaaatatttacctaaaaagcaagtgatttgaatgtctcagactaagttattttttactgatctatggccctcaaatgagttgatgaccttcagtagagaaatggttctttatttctgatttgtgagagtcatgcgacagcagtggatgggttaagaaggttagaggaaatttgttacattgctttttagctgttgttttttagtttggtgaacaaacgagataacatagctagtgccttttagtcataaagcaaaaataaaactacagtgttttctaatattgtaccctaaacctatgcaaatctccaatttacatcacccacaagccttctatatttttgcagattttaactagagctaaataataggcatatatttatacttaattgtaatcaaatgtaatgacgtgtgcaaaacaggctttgctcaaagtgctctttatagatgaaatatgattattgaacttgacagtagatcattcattggagggaaaagtgattaatcacttctctgtgcctctaccttcctaccctttgatgacaccggttatatttcaagattctcaatgctataaatgaacactttactgaagaagcatctttatccaatgcaaaatgaaatgtgttgcctaagactaataaagtcatttacaagtttcaatgaggagcaaatataaatagtaaaaaaaaaaaaatccattatttaacagcagtaaatccagtatgttttggtaaaacagttttcagagaagctctacttacgttagcttttcctaaaccttgctgcaaagtgtcagttctttctaatatacaatcaaaggaattttgtgttgggaagaacatttctcatctttgtaaaggacatttagaggagagatagggaaaaacaaagatcatgcatgaggattatgtgtgagggtatggattgactggatttcaatcattattttaaaaggcttatctaaaataaggtgttctttgaaccaagtggagtctgatttccaattttagaatgtttccacatttaacactgacattcattatcctgaaaatgaaggcagatacacataatatctatatgtattttaaataaaattggttcaataatttttctcaaatttcataactttttctatgaatcaatgtgtcaactcattttttcaacttttcaaactgaaagaaattccattgatctttaataataatgaatttaatcaaatattaggcaaaattctttagtgaaagaactcagagaatttgattaggtgcctaaaatgtcatttttaacataaaaattaacaaaagcacaaaaatatttccattttatcttaaaaattaacatgctatgttataatacaaaaaaagccctcccctaccccagaatcctgcataagaatgtgaatggttatgtttgtttgcgcagatggggtttatatttatgtgtttcttttccatctagcaaatttaaatctaggatacaaatgtagtcattatcgtgtctgaattggtgaagaaagcccaaaatatggccaaatctacttgccccctaccttaaattatgagtttttaaaaatatattttcaggttagaatatttctcttttttctgagtttagctctctgaagcaagtgctatcaattcatgaaaatattaattataaaagttttatactgacgatttggtcctcataactgcccctgcttggtctatatttcaccttcatcatgatttattttctaatatgagattaatgttaaggaccataaacgttatgttgagaatcataaaacatgtgtgctaaattttgggaacagctcacgtatacagagaaagaagaaaataaaaagatctagcagataaagaaaatactgtttttggtcccatttagaaatgttattaacggcaatgctgtaacaccttcctttccaacacaatggcaagccatgggatgaacaagctcaagacatgtgtggtagcataccaattaagcaaacagttgactcatggatgcattactagcaatacttctgctccaacccagatacagatgctcttcaacttacaatgaggttatgtaccaataaactcatcataagttgaaaatattctaagtcaaaaatgcatttaacatacctaatctactcaacatcatagctcagcctagcctaccttaaacttactcagaacacttacgttagcctacagttgggcaaaatcatctaacacaaagcctattttatactaaagcattgaatagctcatgtaatttattgaatactgtactgaaagtgaaaaacagaggggttgtgtggatacctgaagtatggtttctactgaatgtgtatcacttttgcagcattatcaagtaaaaaaatcctaaatccaaccattgtaagtcagggatcatctatgtttgattgacaggccccagcaagcatccgcaaatgaggaaagaatagagagaggagaaagaaagtactagatgaagacaaagaatccttggtgataggatcttcagacagagaggctctagggacttgaaacctggaagttcagcataggcatttagtatatgttgagccttagggaactcatttatcaatttgatatcactcctttgtatcactgccatggtgaatgatcagaaaggaaacacaaactccttctttaagaactgcaataacgaactgtttcttcttcttcttcttcttcttcttcttcttcttcttcttcttcttcttttttttggcagaggtggggtgtctcgctaccttgactaggcaggtcttgaactgctggcctcaagcaatgctcccacctcagcctcccaaagtgttcggataaccggcattagccacctcctctggccaagaactgtttcttttgattaaattttgttcttcctactccaactttccttaaagataatgcttccttaaagataaatctaatggcttaaacacacacacacacacacacacacacacacacacacacccacacccacacacgcaaagtatgtattcttttttatcactctcctcctgtccctcttacaccttgctttggaactgactggtgccttgcatctccagtcatttatcacacatcgtgtagaccgagattttcgatattaaaacattcagtctgccaatgtacgtaggaagcaccctcaatgtctttaaaatgctattctgaaacatttaaagagggccatctgcaataagaatgatcattagatgatgataaacagtactgggtcacagatggagaaagtaatagtatttgagagccattttcatgttaatgttatagattacatattaaagaaatgtgccagtaatgaagcaaacaacaaagagggccattggagaagaacagttatgctattgaaagcaatgatataataagcagaatggccccaagccatctgtttttaaagcttaccatatttaggctgttaggaccattccactgtccatggaggtgccattctgagataacagggaagtgggcaaaactaatacaaattaaaccattgtcagtaatttttatcataaattgatttttccctctacaaacatatctaatgctcccaaatctgactatttaaaaaaatgtttcttagtccttaatgtatgcatatcacaactctgaagacactagaagtatagactatagggttcacagtcttaaaatgaggattttagatattgattttcattaacgctctcctctaaaatagtttcagtcttttgtgcttccaaaattagaactttatccttaggttttgcaatttggatcttgtaaggagataaagagggaagaaaaaaagtttgtgattcaggggtgtaataaactccagctggcatatcatgagcctagttatgtcaaaataaataaatgatcaaaaatcttattaaaaaacaaaaacatactggaactttggaaaataaatttaggtaaaacaagtgaaatgaaaataggaagaatattaatattcagaagctgattgattatgtattagccagatcaaagcctctgggtgataatgagccactgaacagggattaccacctgtcctgttcaactagcagctggacttaccaagaacagctggacaagaacacttatataaaattagcctttagaagcataagctaagttttttcacctgcttctcagatcggcatctttatcactcatgccagaagtaaaaagcttttcatattttgatgctgtttttgccttcaggaaagcacagctttgaacaccaatattcccagccgcttgctaccaagtaatggaggttgtcttctagacctaataagctaagatgtcagatgcacttggtttttcctgtcactggctcatcttgtgctcttatgtttaagccactacaaattctttcaaaagaaagtagaaatataaattataaagaaagattttaatgtcatttattcctatattcttactcacgaatcttcattttattgaaacctatttaaaatgacaatatatatgcacacttgggaagtttatcagataattttgatataagacgataggttaaaaataaggcatatgacaatctttatttggtgctctgaattgtattaaagtcaccagtctgttttaagagttatcatggaacaagtgaatgagtaaatataatagtctacttccttccttctcaaagtgtggttggtccacagattagcagcattagcatcacctgttagaaatgcagaacatcatgtctcattttagacccactggctcataatctggattttaacaagattcccagacaatttgtatgcacattaaaatttgagaagcaatgttcctgtgagcttaatcagatcctctctttctttctacacgttttttctttcttttttttgagacagagtctcactctgttaccgaggcttaccaaagctggagtgcagcggcgtgatctcggctcactgcaacctccgcctcccatgttcaagtgattctcataactcagcctgggattacagctgggattacaggcatgtgccgccatgcccggctaagttttgtatttttagtagagacaggtttcgccatgttggccaggctggtctaaacctcctgggattaagcgatctgccctcctcggcctcccaaagcctgttgggattacaggcttaagccaccatgcctgtccctgtttctccactttgtattggaatgcttttatttgaatatgatgttttagtacaaaccacagcctaggaggcctgggttttaaagtaactaatattgatggctactatgcctgctatgtataagtgtaacgtacacaggttgaacataaagaggaggtttcacataagaatattataggaggtatcgtgaccttagaacatctgtacatctgtataatggaacctatttctttcattagaccccaatctgaaaatttctctgtctgccaaaagaaacagagaatccttctactcccacaacgcaagagaggaaaagaaaaacacattctaagtggcaagtaactggcagcaggcactttgtataaataccaaaagtagcacgcgttagcacattgatgacgactccttatttcaaacctgcacttggaacaactgcagatagagactaataattcttgtcaatgtgtattaaaagctctgacaggagaaaacaacttgtgcagctcaagattgaaagaaagcacaatgaggagattcaattaaaactggatgatgggagaagaaagcataatctataggaggacaggtataaatcctctttttctgatttgtccagtctctactaaaagagattgaaagctgatatcagaatcctttgccatgctagttataggcatttatttatttaggtatttatttacattttttaattatatgcttttatgtataatcatgcttcaattacgtgtacagcaaatggtaaatatttctcatttatataacatgaggtcagtcattcctaatgaatcttttctggtgccttaaaacctcccaattaaagactccttcaaatactccagtcaaagacaccaattaaggattcctcttaatagataaatatccaaaccaggctgtcctcaaaatgataaccagtgtcaagattccagtgttcaaaaaagacagatcagtaagcagtctcccaagccaattgactgtgtgccaattccacccttggttgaagggagagaaaatgattgcttcagagcagaagcaacggtggaagcagaagaaacagacaaaaaaaaagtgggggcgggagaggagagagggttaagatgcaatgggacagtaagatgttgtggagtagtgtgaacccggaaatcaattgggaaatagaacatcaaaagaacacgccagtatttttgggtttttgtttgctcctctctaaagaaaaaattctgtctaccttagacaagcacttcaccagttaagtctgtgggaagcatctacttagggcaggtaggccaattggtatcttcaatctttttcaaaggcttaaatttaggcacatccaggagtaagaaagtccttcccttcactacgtgcaagataaagctggtcaatcgttgagccccagctgactaaattttatgtcaggtaaaggaagcaatgtgggtatgttcccgacaatttatcagataaccaagtacaatcccattaagataacggctatagtccttgaattgaagacttatagggccatgtagaggtggcttttgtctaaaaaggacaaaggaactgaataatgtggtcagttctctgccacagagacatgaagacgaaccaagagattttatgtgtgtttgctcattttgtcagaaacaacaggtgacttaattacatagacttcagttcaaaatgctaagaataactgacaactgacaactttggaggacagattcctaccaaagtaatcacattagtgctgctctcagtcattcaattagtttatgattttcaataaatgaataatcatataatagaataatccaaaatcttatttttaggttttttgtatatataactagtattaaccctctctgtcaacatttttgctttccttaaagaaatataagaacataaaattttagtctaggtgtggcggctcacatctgtaatcctggcacgttgggaggtcgaggcgggtggatcatctaaggccaggagtttgagaccaacctggccaacatggtgaaactctatctctataaaaatacaaaaattagctgggcatgatggcgggtgcctgtaatcccagccactcgagaggctgaggcgggagaatcacttgaacccagcaggtggaggttgcagtccactgcactccagcctgggtgacagagcaaaaaaaaaaaaaataaaaaataaaataaaatccatctcaaaaaaaaaaaaatcaaaatttaacactctgatataccattataattatttattgtaattgacaacgcaaatacaattttgcttatttggttgttctgttcgttgtaaatggagtacaaattctaatttttgttagctctaaatcaaattttaaaagtaaacagaatgtttaaagttatgttttatttgcttaacataacacttaaaacaagatgaacagcaaaatataagaccaggcctgaatccactgagctgtctcctctatgaacttcataaggcatcttacatagagtaagcagacagacttccagacttacagttagaaaatgctggtttgaacctgggctctaacactgtgatactgggggaaaaaaaatcacataatgtattgaaataataagtattgttgactataaaatggaaatctatcctacatattttacgatattcttttaaaattaaatgaagtaatatatgcaactttatgtaagtaggtactttataaactagaaaattaaataactgctaatttattttttagtttagtaaagtctacaaaaacatcacttaactatatatcaaatatagtcacttaggttattattctgtttattattattattattattattattattattattatttgagacagagtctcactctgtcgcccaggctggagtgcagtggcatgatctctgctcactgcaacctccgcctcctgggttcaagcaattctcatgcctcagcctcccgagtagctgggattacaggtgcacgccaccatgcctggctgatttttatatttttagtagagatggggtttagccatgttggccaggctggtcttgaactcctggcatcaagcaatctacccgcctcggcctcccaaagtgctaggactacaggcatgagccaccatgcccagtcttatttactattattttattattttaaaaatcctaatttcctgaatttttcctggaaatgcagataagtaggtaatgcatttggtgatggtagtattaatagtaatgagctaatacctcatcctgaaaatagctcaaagattaccttaagtacatattgactccctaaatatgtgaataacaaatataattgtcacataaatacaattatgcaatcatgtcaactaaatacaatttgcaaatattttgattgtttaaggttgtattttcagtgtactatttaacagttatacatatcttattagtctacaagactttagactacaaggacagtagtcttcatggtccctacctgcctagtatggcagctatgattatttgctgaatgaataaaaataatactctaaaaagtgtgttcatatgaataatttttcattcatgatgcctctatcctaagcatcttatatataggatcttaatccacagcaatctgaattccctgcaaaaattaaaagaagtctgatattccttcactctatataaccttgaaaagaaacaaggcaaaagcaaacaaacaaacaaacaaaaaatccagtaacttgaaatgagactaccaggtttgctttaggcaaggtaggctatgaactaagcaattttaaagcttggagtgaggacaatttaagtcaaatcagttttttggaatgtccacaagacactaagtatatcatgaaaataacatttaaggaaaaataagtacacaaacatgagagtaaatgaaaatattctagttatttgcagacttggatgtcttaaaatctaaacttttttaatatggtaaattaaatgacaaattcatatttaagtgtaaattaaataaatgtcaactataaatgaattatattatttgaaaatggaattatatctgtgctattacgcttttcattagttgaaagtacaagttgcaaactagcagactttgggctaaatttggcatgcacaaatgttttgattagcccacacagtttttttttttttaatctgaattactcaacatttaaatattcagagatattttacagaataatccaaccttctgacttctcatttaaaaggaatgatttgtccatgctgggctcctattcttgcatgacaataactttccggagccaccattctataacggcacatgtattctatagtccctaccagctcccattaacttacgcttcgctagccttgcccagttacagtagcaggctagcccctctgttggcatttcagtttgcaacctctggtttagaccagcaaaggctgaccatagcaatcttagagtatcttagtgtgctttaagtcaactgacactgacaaaagaagaaatagaaaattggaatagccctgtactatttaagaaataaacactgtaattataaattttcccactaggaaaattccaaggccaaatcatatcactggcagaaataccaatcttaaagaaactcttccagagactagaagaggcaatgcttccctacttgcctttatgaaaccagaataatccacataccaaaccttgacaagaatggcagaccaatataactaataaacacagatgcaataactctaaaggaaatactatcaaatgaattctaaatgaatgtttagcatcaagtactgggccaactagatatccatattatgaaaaataaaactcaatctctatctcacatattacacaaaaggtcaattccaggtgtactatatatctaaatggaaaagttaaaaaatagtaagtttctagaagataataaaagaggatacattcattatcttgtattaggaaagatttcttaaagaggacacaaaagaattaaccctaaggaaaaatttacatattggactatattaaagttaagaactatcaatcaaaaaaacaatttaattaaaaggaaagctataaaatgggagaagatatttgcaacacatacaatttacaaagggctacaaactagaatatgtaaaaaaaactcctacagatcaataagaaaaagaaggatgaatcaataaaaaaaataggcaagagactgaatagatacttcacacaacaggatatccaaaatggtcaataaatacacgtaaaaatattcaacctcataagtaatcagacaattgcaaattaaaataacaatgagattctactcacacactcactgcaatggcgaaaattttaaagactaacaagtatcaagtattgttgagatgtggagctactagaactttcatatactgctaatgatggtgtaaactggtacaaccactttggaaaaccaggagtatctactaaagctcagcatatgcctaccctcaacataggcaattttactgcaaagtatataccaaacacagttgtacacacgtgtgtgccaaaaaacgcattaaagaatgttcataggaggccttattcataatgtcttcaaactggaaagaaccaaaatgttccccaacaatagaatggataaattatagtatacattttaaatgggatatcaaattgcaatgaaaatgtatgacagattcatgcaacaacatgagttaatctcataaacacaatgttgagtcctagatacaaaaggttatatactgtacaattccatttttatagagttcaaataaacaggcaaaactcaaccatagtgttataaggcagagtagcagttacctttaagatgagggaggaatagtgattgggagagggaatgtgggtgaggtagggtggtgatttctgaggtagtggttatattctatgtttctcctcaagcttttcattttgaaaattttaaaccaattgaaatgttaaaagaacacccataaaccattcacttagactccccaactgttaacataatattcgctttctctctctctctctcaccactcccccaacccggtgtgtgtgtgtgtgtgtgtgtgtgtgtgtagtctggtttagtgtgtgtgtgtgtgtgtgtgtgtgtgtgtgtgtgtgtgtgtaatctggtttagggctactgataatgttttatttactgtcctagatggcgaacataggtgtattcattttgtgataattgcattgagctgaacatgtttcatctgtatactttctgaatgtgggtcattcttcaagcaaaaaaaagagattcaatcaacttattttttgaaaacgccctcgaaaacaatgcattcaatacaacacattactgaaatactatgggtaatgattttttgttgttgctgtttagacagcgttagggaaaaactacaccatattttctgatctatttattgaacaaggatacctcaatgtggcagtgaggcttgggttaaaattgttatgtcacagcctcacctgctggttgttttccgtagccatactctacacttgcttctgtattatatggagataagaaatctccccatacttgctgcttttaaaatgtttttaagacaaggttgttcagggcacagaatgagacacagagcggggctatgggggttactgccagtgcagggtagatattaaattgtcctatcagttaatcgactaagtaaaacacagttctgactccccctgccaaacaaatggttaaacgagcaagctaaagaaaggacataataggccaggtgtggtggctcacgcctgtaatcccagcactttgggatgccaaggcaggaggatcgcttgagccaaggagttcgaggtcagcctgggcaacatggtgagactaccccctgctgccatctctacgaaaagaaaatacaaaaaaaaggaaagcacataatattttccaaagcttagataaaaagtaggatagatgacctgaggatgaaaaagaaacataattatagaagtttttcctttgtgttgtttaccaacagaaatgaattaacaatacggcacaacagaacaaacacacagcttagacaaaagcaacttagtcccagattctagtccatagcaaatgatctaagatagatccagacatctcaaagcctcagtttccaagtctgtgggaataagaataatcatatatgatactcaaacattccatgggatattgtaagaatcaagtgtgataatagaggtgaaagtgttcgataaagtgctatacaaacacatggggctatctataagttatctacctgaatatatcctctacccgaacatccatggcattagaaagaccatgggatcaggtatcagaagatctggttttctagaccagtttagccatgttactaaaattactttccccttttggacttccattttcctatctgtaagatgaagagtttgggttggattatctttgacattctttcttcctcttacatttcacaattttatctcctcacatttgagtaaacgtacttctgcagtctaattagctgactgaatactgatgacccgttatagaggtgtgctttcagagataagttaaaggacaagcttgtaatcttagggtaacagttttgggagaaggagatccattcccttaaatgataatggcagaaatgaccactaaaggaaggcaagaagtatctggtttatggcattctgaatctatttccccaaatggaaatcagatgtaaaattcttgtgctcagagacgtagtgttgattgaagagtgcagatccacgtgattctcttagtgtcatattcatgtgtgtttcagtagtgtaaactcggaattgaatagttgcctgtgtttgtaagagacattgtaggtttgcttttttatttttattttttcttttgagatggagtctcactctgttgcccaggctgtagtgcagtagcgcgatctcggctcactgcaagctccagccccgggttcacgccattctcctgcctcagcctcccgagtatctgggactacaggcgtccaccaccacacctggctaattttttgtatttttagtagagactgggtttcaccgtgttagccaggatgatctcgatctcccgaccttgtgatccgcccacctcggcctcacaaagtgctgggattacaggtgtgagccaccgcgcccggccgtaggtttgcttttaatatactttcagaatgtgtgtgttagcatttttttttcatataacagctttattgacatttagtatacataccatacgattcgcccatttaaggtgtacaattcaatatttttgtttgtttgtttgttgagactcgctctgtcacccaggctagagtgcaatggcatgatcttggctcactgcaacctccacctcccaagtccaagcgattctcctgcctcagcctcccaagtagctgggattacaagcgctcgctatgaacgcctggctaatgtttgtatttttagtagagatggggtttcaccatgttggtcaggctggtctcgaactcctgacatcaagtgatctgcccgccttggcctcccaaagtgcttgcattacaggcgtagccaccacacccggccttgacttagtactttgtattggtgatatatggaattgatttcaacattttttgccattctagggtgaaagtgctacaataaattaaaaccttataccagccaaagaagaggcagctctcaattgtgaatgttgagaatatacttacaagaaaaatttaactttggtgatgtaatagcttcatttgcattacctaaagcttgaagtcaaaagctaaagtattaagcgtacagaagcatggactctatgaaagaaacaatccaaaaagtgacttttttttttttttttttttacaatgggagacattaagaactttggtaactaactcttcaatatgtccctgatgacagaccaaggatttatgaccagaagaagctattaagaaaatcttcctgaggtgttaaacattgaacatggattattcatgaaaagataggaaatctcttttctgaatcagaagagagtagattcttgttgatctggagtggtttccatttacttctgccatgggaataaactgaatgattgctctataattgaatagtcttttaaaccatactctataaattctataactatcttataagtatggtatctaaaaataagactgatagcttgaggactcatagttgtgaaaaactattgaaagtatcattgaaaaggctcaacgttttctattttcaaaaagctaatggtaagctattttttaatccaatggatgatggtttcagtaaaggcaattttgtcacaaagatttttatgggaatctgcagtatgtagaaagattctcctgaggaaacgtgcttactgctccctttacagtaggtcaagagtctctgatttctagcacagaactattttctaggcatcttttaaaaccctacctaaaggcagatgagtgggccctaatgttacaaagaactactctgagctaagtgaaagaattacagttggacaagtgggaacaaataacatggttcatagctgcaattactgctcacatgaattttacttataatattcctgatgccaagtcataaatgctctcaacatctcatctgactggtagaactttcttactggcatgagattcctaggatttttgttatcctttagcttttatattctacaccatggattggtaccactctaaattggatcaaattttggaacaatagacatcaagtaagatgtttctaaacaattagctattcttagtcatttgaatttctatgtcataacacatgctttggcatttatagagtaacctactcttaagaaaaaataatctcttctaaagcccgtatttaattttacaattgtgtatacacaattgtgtatgtatatagtaagcatggtcactgacaaatgctaatgtctcagccagggaaattgattgacaggaaactggagaagagcccctgaaaactcaagtctgtaattatatactacatctgtgagtggactacctgtatcagtttatacaccatcttccaaatcccaaagtttagtggtaaactaaaccttgtctgatgccctgtatggtctaaaaaagaggagaggggttgaaaagagcaagaggtagagtagagatgcaatctgaagaccgctattcccagagtgatagagcaagtgactagtagtgaatgtgagggacctcctgtttgtgtggtttgtctgtcatataaatcttgaaacttacatagatttttataagggaaaacatcagcatatcgagaagaaagatataatgtttaaggggatcattgccactggactttatttagattttggcttgcacattctatcagaatgaaaagccaacattgaaatcttttcatcatataagagaaaaaggaagatagtaggtgctggtatcacaaggctagaagcggttttcatagtagtcagccattaatctttcccttatgagtttgagttatcctaacattgtgcatattataaatacagacacctgcttggcttgtactgcctctcaacaaagtgatggcagacagaaaacctaaaaaagttcttttctggactagctgtggattaggcctagattggatcgccattagaaaagtggggaatgcatatgcatgtgtgcatacatacaagttctatgggcctacagtcctggagtgcacactgagacatgtggcttctgggggttgctgcctttcaataccacagaatcactgggttacagcccattggctgagtagttcaagttatctatagactcatttattatgtgacagagctgatgatagcatagatgcatccctgattgaaagccagatagatcctttgcttcattttgctttgttagtgtgggctagcacaggcttgcctttaggtacctgagtggaatgtacaacttctagtccttacatgtaatggagaagactgctatgattcatcttgaaaagtaaaatgtacacacatacctgtctatatccaagcttgggggtaacacttctgggtttgagctatgacatttttgtataataaatgaaaattaaacttcatttgaatttcataattacctactactggtgtgatttagaagcagctggtaggtcaatatggtgctcttttatgcattttagtactgagaaaaacataagtgctagatatgccacttttaaagtttcccagaatattagaattcaaacacacacacacacacacatacacacacacacacacacacatacacacacacacatacagagtaatagtggtaataccactgccagagactcagttaagataatattgttctctatttgactcctctttaattccgtctaaacatgaatgagaataatcattgacctatatctacaacatgactaaatgagttcaccagaggatctaacagcataaatctattttccatgaattaaattaaaaactcatgaatacacataatacttttagattgaaccaaatattttcatgaatacagactctcttcatccacgtaggaaaccctattggtgagcagcaggttggcaatgagtaaatgctgctcagcaggtcagacgtgtacagctggagaaagatcatgaaatttagctagtatactaggcaaaacacaaatctggaaaggagatgatccacattgcaatttttaaaaaaaattctatgtagacttagaggtctagtacagtacacatacacacaaggaacataaatatcttctgagagagtttctgtaggctttacctttgaagtttttttctttttctttttttgggaaacaaaacacaacaaaacacctcctgttgccctgaatgctaatgatggaagactgttgctatggtgatgctaatttcaacaccgttgcctgtggacttcacatgaactcgctgttttaacttctgcaaatgtcatttacaaaatgaaaacccattaatgattagcgagggcacaatgttccactttaattagaataataaggaatgctgatgcacaaaatacaggtttgtgaatcactactgagcctacactgtcaaaattaattactacggatgaggatttggtacttttctttttttaaagaaagctttagagtagaacagttgtattttgacttaaaaggaattgaaaactctctcttttaaatttgaaggtaaaaaaaaagcacatctccctaacagtacacataaaaactaactgcaaagagcaaaacaaaagttggaacctagggtcagatatttctgagtaagaactgaagaaaagtcaactaattgttcgtttagaaaatagggtaggctgggtgtgatggctcacgcctgtaatcccagcactttgggacgctgaggtgggtggatcatgaggtcaagagatcaagaccatcctggccaaattggtgaaaccctgtctctactaaaaatacaaaaattagctgggtatggtggcatgcaactgtagtcccagctacttgggaggctgaggcaggagaatcgcttgaacctgggaggtggaggttgcagtgagccgagatcgcaccactgcactccagcctggtgacagaggaagactccgtcttaaaaaaaaaaaaaaaaaaaaaaaaggatgggggggatgatacaggtaagctatttgaatatttcaaaaaataactatctgaggaaaaagtgctgcatatggtaaataccttgatattagatatatttggatttatgtgtccacacaaggaaacagagaacatttaaacaactgggaatatacaagaggaaacaaaaataattctattctctccaatggtaaaagattgagttaccttaaaataaagatttttttttcacctgcacaaattttaaagcaacatctgaagatgagttggaaagagtatgttccatatttaaatttgtttccacatggtttgctgcaaagactgcgtcggttgattttattttcgatgctctacatttccattctgggtcaccccctattcagtgaaatcattttatgtcattggtgcagccaacaaaaaaccgatggtgtatttgctggatatggaaggtgcaacacgcatttttcatgttacaaaaatcttcctacagaagttccaaacctgttggatttggcaagatatgatgaagggagatgataccaatactttatatagtttctagagtaatccttgaaagacttgtattctgggtcttcagtcaagtaatattatagggtctgtagaactatcaaattacctgtgttattgaggtgaaaggtgaatttgtggtggccttatttgtctacctgatattaagccaagggtactgcacttgggaagacagctgacatctgccgtcaaaaatgtaaagtaggaagttagagtatcttcgtatttaggtttaaacttgcattgctcaagaaaaggtaggatacaaagttatataaacaatatcttttgtattttatcagcagattttaaaaaactggaagaagacattaccaacatgttcattgcagttgtctaggtggtgatgggcacttaaatatttttaatctttttctatgttttccacagtgaacatttattatttttgttatgacacggaaaacttacaaatattaatttctaaaatgtattgctcagacttccagtttcaacttggagatggagatggagagctgcaaagaggttgctcccatacttgtagcaagaaaactgctggacagataaattaatgacttttcatcagtccatcagagaaatgacattatagaacaacctgaaatctggagagagattggcctttagccagaagcagtgcctgagcatttggatccctggagcagatgccatataaactagtagggagattaaattgttgggggacatgtgggagctagcctgagagtgtgaagatcctgggggctactgccataggtggagtcccaaccttttgcaagcttcttccttcaggaactgtaccttgccttcacaaggaggatgcgaagaatctggagaaagcctccccaacaccctctgtgttgctgattggggaagggtcacagtagctagtcaccatgaatctgcttatacccttctcttcagaggaaaagacatcacattgctataaagaactacccgtgactgggtagtttataaagcaaagaggtttaattgactcacagttctgcaggctgtataggaggcatggctggggagccctcaggaagcttaaaatcatggcagaaggcaaaggggaagcaagcacatcttcacacagcagcaggatagacacagtgaaggggaaagtcctacatactctcaaataactagatctcttgagaactcactcactatcacaagtacagcaacggagaaatctgcccccatgattcattcacctcccatcaggcccctcctccaacatgtggggattacaatttgacatgacatttgggtggagacacagaaccaaaccatatcaggcactgaggaaataccactgcattttaggggaagggaacaccagatctcatctatgtgtggttttgttttgttctttttttgtttgtttttttttgtttgtttgttgttgttgttgtttttcagccttatgcaggagaaagggccttggggccatagactgagaacactggtggatatccactgcagctccaggaagggaatgggaggttgaagttactctacctctggaggaagggaaagaaataattgtaaagaccacatccccaagacccaggccaactgtgtattaattcaaacattagagaatgcctctgcccgacactcaaccactacactaacaagcttccaatgaggaaacaaagttaccagaggaatttgaagtctctggtggccacagcagcaacaaaactcaacaatgacaaccaaagcaactaccaacatcaaacacagcccaattcccagtcagattaagataaattaccatgtcaaaggtttatttacctcagtatctattacgctatctaagatgcctgacttttacccctgagatacaaagcatgcctaagcaagaaaaatcacagtctaaggagacaaagcaagaatcagaaccagacttagatatgtaacagttgttggaactatcagacaggaaatttaaaataaccataattaatattttaaagactcttgagggaaaagaaagacaatatgcaagattagatagaaaatatgtaagattagaagacaatatgcaagattagatttgattcactcttatagtttccagctctatatttcagtatatttcagtatagagctggaaactataagtgaatcaaatggaaatgctagaaattaaaagcagtaacagaaaagaaaaataccttagatgggctcatctgtagattcaacaaagacaaggaaagaaccagtgaacttgaatatagggtaacagaaattatacaaactgaaaagcagggggaaaagtaaaaaaaaaaatgcaattgcaatacaaacacagtaggttttcagtattaagtagggctctaggaaacagctatttttcagattaagtaacagtttggtgcaattatgctgatcaagcataaagaactataaattaaagacttcactcaaagaagacctctgacaagcaaccaagttgctacaaagtatttaaaaagctagtgaccaaccagttgtttacagtgatatattttgcaatatttgatttagattaagagttctaggaaatacaaaaagatccacagtacaaaaaaacaaatgtgttccttctaatgctcagaattaacattttatctttgctcaaagcttcttttgaaataaaatacaccattcaagatgaaattccgatcctctctgatgccccctctcccatactacaactagtatcataactttggtgtttatctttccaggcttttcattttaatttaatttttaaaaattagtcttttttatttttagtattgcacctgtacttcaaaaagcaaaacactttaaaaagtgaccttccagaatttagcatcagaatctcattcacactcatggtttcagttactagctatatacaagtaatatgtaaattagtgactccaacccagatgcgcctccttctttctttaggtgcacactatctgtctatttacagtgctttttggatgtcaccaatcatttgaaatccaaacatttacaatcaaattgccaccctaaatctgatctttctttagagttccctaactcactgtaaagaattaccaactgtgcattgcccagaaatctaggtgtgattccttgacatgttttgctttctctttgcgcccttcctcctatgatatctatcctcaaatcttaaggatttttacctcctaaaaatctctcaaatctatgcctttctcaccatatccaaactatcatcatcttggtccaaatcccatcttctctcacctggctttcatcagtaaccttcaaacgtttgtattcataggctcctcatccaattcatttgcatcagccagaggactttttgagttttctcctcacctcctccagccctagtcatgctgtccttttaatcccttgtattgacaagttccctcctgctaaattgccttgacacatgactctctctctctttttgtgttaatatgtattcattcttagtgtcatttccattatctattccctggctatactttggaggtatcatgcatgttgctcaccaaatgtaccctttacatctagcaatgtatctggtgcacatattctgataaataaacatctattgacaaatgaatcaatgaatgaatcagtcaagagtatatctttagataaatgtttttcttaggtaaggagaatcaaaccatttaagtgcattagaattaaaaagcattttagcatttgtgagaaattctgaaagcagtaacaagtagcagtttctacttttacaaatataactgaggttaaacaaaatatacccagtaaaaaataacttcttactaacttggctaattatgggtgaaattggtcatttatgctgtgacaatgatcagagacacccttggaaactatgcttctttaaggaataatgatgccattttatagttttatgctttcattttagcatttgagaacagttcacaaacacactaattaatctctgcaatgatattgtactcctatattacaggccaattcaagaaagtaaatcacacagatttcaaaagcataggaaaaatttttagatgcctaagaatatactctttacctcctgtaccttgttatatatgtctttatagtcttagatagatctttaataaagaattgaaacagaaacagagatccttattttagctcctttatgtaaatcatatgcatatttatgacttagttcctttattttgtgagcattttatatatatatatatataatataaaatataaaatttacaatagctggtacaatagcccccaataaatatagtttgcttaattaatgtaatgaattcattaatacatttgccttttgcaaaacagaaactagctcgatattgtgaagtcccagggtttcctccctcatcccaatatgatggcatcccaccccatgactctaagaaggatgtatatattgatgattacaaaagttaaagctcttgtcctgacgtcttcccctagcttcagatccaaattttgaactgcacagctagatacccaataagtacctcaaacttaaacatgtctaaacccaggcagctctagggtttctacacggaagagtagctatctagttgacaagcaatttttttttgtttagattaaatgttttcctgttgttgctggaagcaaagtatggctaatgggcaggtattattggagcacagaagctcttcaagccaccctttaagacatctctttaaaaaattatttatttcatttatttgtaattgacaaataatagtttgtatatttatgggatacgatgtgatgttttgatcttggtatatattgtagaaagagttgatcaagctaattaacgtatccattacctcaccaacatatcatttattttttgcggtgagaacattaaaaatctattcttttagcaattttgaaatatatgagacattattattagccatggttaccatgtactgcaatggaacactaaaacttgattttccctaccaaatttgttcctctttaagtacctgttcctgctgaaagccgaggagacacctggattgccctctttctgtccctcctgacctccaatgcatcagcaagacctgtgattgtttctaaaccatattccctgattccaaccacctcttgtgatctccactgctacctttatctagatcttatctaacaccagtgcttcccacactactatctggtctccctgcttccactctggctcttcatatttcctcacccctaactcacgtgttccaccaaatgcattctccacacagcagccaattatgtcttgccaatctagtctactttcaaactgcattataacaaagcaccagcaaaaaaccaaacacctccaacaaacttcacctaggctttgataaaggtcaaggtttgcatttcaaaaattttcctctttggagttgcagaaaagaaatattcagggctgaatttcagcaaccttcttattagtatttacaaactagttatacttggctaatttgtaacaccattgaaagtgaggtttggcaataagtgtactttacattgtgaacattaaaaacaaacaagacatattgtctggcaaaatattttttgctgttgttgttgttgtttgaaattgtatatatttgaactaccttaaaagataatcagaggaagtcccaggtagctggacatttaaaagtttgtcttttttctttgaaaataatacatgaaacttggaaattgggaaaacatatttactataatattcaagtcaaagaatggagaattgcccaattagggtttatataaaattagttttcaaatttaaaaaaaaatccagactaaattatatctttataatgtataacccttaagagttgtttatatatcttctggttggttcataagcggaagagctgctgcactgttcagtatcatttccccatatttcactgagaaatgaagttcagagagtaatgaaattatgtaagggcatacatattattttataacatctatagaatttacatctttggactctcatgcctaaatttaatttcctattggtttattatttcatctccgcctgacttctgtgttttatatcccaaattaaatttcccacagatttccttaggtatattattactctataaaatggcaataatctgttcactatagccaacactattgcttaatcatctttgtaattattttatcatttctctattttttgttttgtaatacacatatttaggaaaggacaagtaaaccaaattcctaaattgacaaagtactacgtataaattaaacagaagttggtacagtcaagcatgaatctctgaataaagccaccaactttgagaagtgtttccaacaacctcaagtactttttttcttcactccactctttataaaacttggtgataaaggtgttcacgatggaactaaaagttatttggattaaaatattgctggtctgggattcatgcttccccaagcaatattgatttgctaggggatttttttctgttcttattcagtctttttaatttaaaatattttatatttatgttgctttttttctgatgttttactgaattaattctatagtttccaggccacggcaactactgtaagggtatggcccatactgtcagattatattattcagtgttcctctgctcatctcagatccttcagaggctgctatttttacacgttctattacacatcaggacttttaggttttaattttaaagaagtgttccacatttgagccctctgatataccctgagttatagttacagttacagttacagtcagataacttctcagaaaaaatgactttgtagtttgaacatgttttctccatccctccatgttaattttttccagttcacaagtgaaaacaagattagtatgctctgaatctaccagtcagtatgtttcatcttccacctcaacattgaactgcttcctttcaccttatacatctttttaaacaatacattcaaggacttggaatataattggcaattttgttgatgatgaatgaggctgagcaatataatgatgccttttgctactctatagtgctttcagtaaaaagaaatggcttgaggactaagagtatatgaaatatgagtgagagaaaaagctctaaggtccttgataataaagcacctttaaaacgatatcatgagatgatgtttctccctaccaaaaaaaccccaaaaaactatgtgtgaaaaaaaaatcggctctcttgtatcaacatcgggcattcatgcaattaaaatcttttgtatgtgtctggtaatgatatctaatatttaacagagaaaggcaaaaactggttgagtataactgaattctaaacttgaagtcttttcttccctactggataccactgcagctctgcctcaatgtatgtcttaggatttaccacttaccttactccaacttttttcaagatctattaagacagtggtccccagcctttttggcaccaggcatgagttttctggaagacaatttttccacagactgggaggcaggggcgggggtatggtttcgagatgaaaccgttccacctcagatcatcaggcattagtttctcataaagaggtcacaacctagatccctcgcatacatagttcacaatagggcttgtgcacctacgataatctaatgccacgactgatctgacaggaggcagagctcaggcagtaatgttcacttgctcaccactcacctcctgctgttccagtccatggtccagaggttagggatccctctattaagacataggcttacatgcattcactgaacaatgctggctcctgaagaaagcttgggagttttgatagaagaggattttaaggtgttttcctaagatattctcacaacagttttggtaataggagctactgaaggaatatattcacttaaagatgctttcttcaaaacagtaactttcaaagatttatagtttatagcataatctagccaggcaatcaaccccatcaacactcaaccccatctgctctcaacaaactgaaatatacaaaataaatggactgctaaaaaatcgcttccaaatgtaatttaataaactgtaacaccagtggggctatctagaatttaaaaaaataacatggaacttctttatctgttattgtctattttttaaaaattatttatttatttatttatttctagatggagtcttgctatattgctcagcctggtctcaaactcctggactcaagtgatcttcctgcttcggcttcccaaagtgttgggactgcaggcataagctgctgtgccgtgccatctatttttttgtgtgtgattttttttttctttggagatggagtctcaactctgtcgccctggctgaagtgcaatggtgcgatctcggctcactgcaacctctgcctccagggttcaagtgattctcctgcctcagcctcctgagtagtggggattacaggcatctgccaccacaccagactaatttttgtatttttagtagagacggggttcaccatcttggacaggctggtcttgaactcctgacctcaggtgatttgcccacctcagcctcccaaagtgctaggattacaggtgtgagccaccacgcctggactgccatctatttttctttaaataagcatacctattgggatcatagctcagcttccagtgcttaatcatcaaaatcaaaacaaatgatcaagtatttattattatttttacatgtgagatatataatacatgctagggatgatgcaaagatgcataaggcacaagcgttgtcagagagtttacagctgaactgaggagacaagggatctgaaaattaacaaaatatttcaagagttaaacaagaaagaaaacttggggtcttagctgggacgttatagaggctcttgctatttctaggatctgcttaaaataaggttaaaaattaattattacttatataattttaaaggtagacatgtataactgttatatcacttcctagtcctgaccctggccttttcttagacttgtgatttcctaaaacttgggacaagatgttaaggaaaaatatgtaggcccgctcatcctcctttttttcccctcttgctcatggcaaagataatttttaaactaaaataaacacaaattgtgtaagtataacatttggatctcacatcagactcacacaaatctcagattcttatctagtaccaatctttattaatgactgaaagaattatagggaagtgctgggcacagatagaacattatttccctggggaacctgaaataatcacacatgcgtttccaaaacatccatgttatttcccattatgatgtgctttggtttcatattaacagatacgtttttaaaaatttacacagaaacattgaaaggaaatcatttcagtctcaaaagttttccattttataatctgtcaattacaaaaatagaaaaacgttcatgtagctatgccctattctccagccagccacgactcataaatccaaacattccaggtttatttacaataagctatctagccaggccaggtataccctactaaaatcattttatagatagggatttgcaggtatctttcctctagttaaccactattaacaagataaacaagaaggtctgggaggtcattaacatgtttatgaagtggtctattaaggtcatttattcccttcacatcccccagggaataagtcacagacctgctgttaataccctttattctctttagtttcctcttcgttgtcctctctctctctctctctctctctctctccatatatatatatatatatatgtgtgtgtgtctgtgtatgtatgtatgtgtacatatagatatatgagtaaaatgtacacaaattacttttaattggatgcataaagatatttccaccttgaacttttgctgtgcctgctcagcccctcctgctctatctaggattcattcttttctattatttgatttttttttttggcagaaaagttcttgtagtattgatataagtaagagcgagaaaaaacaattaatctagcctttatttgataaagcacttgtatttacatattaacacagggtgcctacatttttcggatagagatttttcttttctttcttcttttttttttattcctagagacagagtcttgctgtgttgcccaagctggagtgcagtggcacaaacacggttcactatagcctcaactttcggccccctgggctcaagcaatcctcctgcctcagcatcctgtgtgcctgggaccacaagcacatgccaccatgccaaggatttttttttttttttttttgtagagaccaggtatcattttgttgctcaggctggcttcgaactcctgggcttaagtgttccttctgctttgaccccccaaagtgctgggattacacgcttgagacactgtgcccagctatattcagacagagatttttcttaatcttcagaaaacataagccattatttatcttcaaaaacatattaattgcccagattgcttttgtaattttgagtcattatgagaaaaagtatgagaaatacttcttttgcaccatgtagttataatgataaaaaataaagactaaagaatatcactctgcaataatgaatatcattctgcaataagaataaagtatcattctgcaataagatgaaatgttctgcatgtaatacatgggcagactcagtattcccccagctcaaggcttgggagaaattgtgacttatagccacagaccatatatatttgcctagtaaagctagaaccataggcctctggcttaagggaaggatgagacgatctgttctggaatggggggcggggggtggtgtcaaaatcaaggacatgcacaaatgttgcaaaggctcctgcagagcacttcttgtccatctaaattgaccacgcgctacctttcagaaagacttacaattgagggtatgaagagaaacacattccatgacatttattaagtatggtcttggccatactctctatcttagggaagccctgatggaggtggtggaatatgacttagaaatcctttgcttttctgctccattggtctatatgtctgttttggtaccagtaccatgctgttttggttactgtagccttgtagtatagtttgaattcaggtggtgtgatgcctctagctttgttctttttgcttagaattgtcttggctatacggggtcttctttgattccacatgaaatttaaaacagttttttttttaattctgtgaagaaggtcatggtagtttgatgggaatagcattgaatctataaattactttgggcagtataaccattttcacgatattgattcttcctatccatgaaagacctcagaaataataccacacatctacaaacatctgatctttgataaacctgacaaaaacaagcaatggggaaaggatctcctattcagtaaacggtgctgggaaaactctctagccatatgcagaaaacagaaactggacccctcccttacagcttacacaaaaattaactcaagatggattaaagacttaaatgtaaaaccccaaatcctaaaaaccctagaaggaaacctaggcaataccatttaagacataggcatgggcaaagacttcatgacaaaaacgccaaaagcaactgcaacaaaagacaaaattgagaaatggaatctaattaaactaaagagcttctgcacagcaaaagaaactatcatcaaagtgaataggcaacctacagaatgggaaaacattttttcaatctacccatctgacaaaggtctaatatccagaatttacaaggaacttaaacatattcacaagaaaaagacaaacaaccctatcaaaaagtgggcaaaggatatgaacagacacttctcaaaagaagacatttacatggccaacaaacatatgaaaaaaagctcaacatcactgatcatcagagaaatgcaaatgaaaaccacaatgagataccatctcacaccagtcagaatggtgattattaaaaagtcaggaaacaacagatgctggctaggctgtggagaaatgggaacgcttttgaactgttgatgggaatgtaaattagttcaaccattgtggaaaacagtatggcaattcctcaaggatctagaaccagaaataccatttggcccagccatcccattactgggtatacacccaaaggaatataaatcattctactataaagacacatgcatatgtatgtttattgcagcactatttacaatagcaaagacatggaaccaacccaaatgcccatcaatgatagactggataaagaaaatgtggtacatataaaccatggaatactacgcagccataaaaaggaatgagatcacgtcctttgcagggacatgaaactggaagccatcatcctcagcaaactaacacaggaacagaaaaccaaacgctgcatgttctcactcacaagtgagagttgaacattaagaacacatggacacagagagggaaacaatgcacaccagggcctgttggggtttgggggttgaagggagggaacttagacgatgggtcattaggtgcagcagaccaccatggcatacatatacctatgtaacaaacctgcacgttctgcacatgtatctcggttttttggtgtgttttttttttttagaagaaaaaaagaaaaaagaaggggggagatctcattttaattgatttagaccagaatcaaacattttaaaaattaaaaaaaaaaaaaagaaatactttgttttctcagcctgcagggaggtagaagagtgcttacatcagggctggccaagtttttgtttcattttgttttttgttcccctttattgcccaaagcagcaaagagtaacttaggtctctgcaacttgattgcgaagatacgccaaggaaaatccacctaacagtgcagggaaggactactagagtagttttggtgatgcccaagatggcagcctcacagtggtggattggccacatttggttatacaaatggccagttttcaatcaaaaacattagaaagttgaaacagctagaagcaatagctgagatgatgatgattattttatttgatttatttatttttattcgtataaatttctgaggtacaagtgcagttttgttacagggatgtattgcatagtggtgaacctgggcttttagtgtatccatcaccaaagtagtgcaccttgtacccattaagtaatgtctcattatccacccctcacccagcattctgcccttctgaatctccaatgtctatccttcttatcatgatgattttaagtatcaattctcccccctcccctttattagaatgacttggataagcctccaacttttttgaatctcagctgtttcttccttttttttttttttaacttttatttatttatttattttgagatggggtctcactctgtcacccaggctggagtgcagtggtgtgatctcggctcactgcaacctccgcctccctggttcaagggattcccctgccccagcctcctgagtagctgggaccacaggtgcatgccactacattcagctactgttttgtatctttggtagagatggggtttcgccatgttgcccaggctggtcttgaactgctgagctcaagtgatccacccaccttggcctgccaaagtgctgggattacaggcatgagccaccacgcccgactgatagccgtttttttctttattggataataagtggagtgttacaaggattaaatgggaagatacagatgaaacactttgtcatttagcacatagtaggcacacattaaactttgcttttcttcctgtctagcagattacatggacttatctatgagacacactgtttacagaaaactcatgaacaagaaatagtgaccaaaaggaaagaaaacaacaaaacgattccttctaaagcaacaaagaagcaagttaaaaattacacattgcactgaccatctgacatgcaatggctttggggaccaagatggatgtggataagctgagaaagaaaaacagaaaaaagcagttgagagtttcaggaagagcagcgaggcttttcagtttcatccccccaggagttaatggtatcacagaaaacgtgatcatttgccgaatgccgacagtgagctaagtctcatctaggacctgctcttagaagctttccagagtcaatatccagagatactgtttttctatcttgtacaacggtttaaaaaatttgcaacgtgacagcactgatttatacaatgcactcacagtctatttctttaaaaaagaatacatacacagagagagagagagagagagagagagagagagagagagtgttttaccgtgttaacatttttcctgaagaaagtatttaataccctctccctaccccctactcccccaccctatcccctggaaggaaggaggggaagactgaatgggatttggagttttcccactgagaaaggggcattttctgcaaccaggtcagtgttcaaaggactaatgctctaaggaaattatcccaaagaagagagaggcagttcagggttattaagttattttaaaacattgcctgggctgttgctgctgacctttgtgaagggaacaggatgctgcttcccaggggaacagaataagaagcaattagagaagcctaggagaggcccgggaatgtttgggaattcacacataccccaaattacgtgggaacgctaagaatgaaaataaactaactttgattagggacatatttgggttctagaaaatattctaaaaatgcagctcacactggggctatatctctatgagtgttttcctaaaaacctgaacactcagtatctaatagaggtcaataagacttcaatccagtttcagaggagaaaaggaaagccaattaacatttcttaagcaatattccttatgtgtcataaagtagaatgggtgtcacgttaagcaaatggctcaaacgaacagagttgggatatgatacagttgtttcaaatgcagatttatttgatgtgactactggtttttttctaacacgtgattatgtaagaaagtgcatgtttaagaaagttagaaaaagaaaatggggaaatagctgaaataatttactcctcttcttttggataaaccaacttgaatatgttctatgctcattctcacatttccaaaagtgccacgaatgaggcagggaatgctataccatgtgtattataatacaggattattttccccatacacacattaaattttagctgccacatgtataggtgtatgtatatatgttgccacctttccacatgacatatgccatatagaatgttacaacatttttctgtaaaataaaaatgtatcattgatgacattctgttaagactcagtggctactatatcctggcccaaaaagtaggtcctgtccacaatgctcagtgaaaaacagtagttgatcaatttaaagctctattgaccactagaaaaccagaagaagcctcatgaatgatatttaggaaaaacagactctagttctactgaaacaaagctagagctgagagtggtcccaggcattatctagttcaaccttctcattgaggttgagctaagttatactccttatcatattgttagattaagatagaacggaatctagaactcatgttttggtatgtaccattcatacatccatgccaaggactgtcccttaagcaccaaactgtaggagctatgagaaactctatcaaacactcggcatgcttcctaacactaaagttcatgtctagagggcatgagagatggatttgagtggtaaatctaaattgacacacaaatactacaagattgttttgaaggtgaaatgagtcagcaaactgaaaagcacatagaattactgacatatgttcatgaattcattccaatatttaccaagtacctgttatctgtgaggcactatgctagaaaaagagataacaacagctatcctcctggagtctgttatttcagtcaaggtgatacaaatcagcttatgaaactacaaaaaaggatgtgagggtttttttcatgaacctatgagacacagatgatatcaacatctacatctcccaacaagatctataaaaccaaaaccagactcagcactctgcacaacactatggcacccctttcactctctttcagttaatatcttaacctgaattgttttcatgattatatcatcaataatgtattaccaactattccttcattgtggttccagagcttactgagactcaggtaacgtgacctttgaaaccatcaaatggcagaggagaaaacacagcagagaagattgacctctgggttatctttgtgtactaaagccttttgaaaagtcagagcatcaggcttttggcagtgatttcaaaaatttaattaccccgaatcattcaccagcatcctcaaagactgacagatcaaattagacagctgattctctgttgcatccacttcttatcatcaatagtgctaaatagttaagtgaaacatttaatattatttgtcctttctatcccgataagattgatggtgcaataagaatcctcaagggcaatatgaagattcattttcacttctctggaaaatgatcacaaacaatttctatttcgaagtcaacattcacaaaatcagaaaatgttagtactggaaatgacctatgatatcatgtcattctgcttccttaaatgacagagggagaaactgaggcccacagaaaataagcaatttcccattggtcaagtattaatagctaggtgacagtaaagctggaactagaattcaagtcttgcgatgcctagcctatttaaaatttcccctatttaatgttgtcttagctgctaaaaggtatattttgaagaaaaatatacataagaaggatcttaccagaaatagcacaaaattatatactacatgatgtgttcacattgtatgaaagattatgacaaaattcaactgattttcaaacccaatgtcagaagacttgtatcattcttagaagagtgaggtgtctggaataagaaatgaggaaatttttttttttttttttttttgaggcagagtcttgctctgtcacccaggctggagtgcagtggcgcgatctcgtccactgcatgctccgcttcccgggtttacgccattctcctgcctcagcctcccaagtagctgggactacaggcgcccgccaccacgcccagctaattttttgtatttttagtagagacggggtttcaccatgttagccaggatggtctccatctcctgacctcgtgatctgcctgcctcagcctcccaaagtgctgggattacaggcgtgagccaccgcacccggcctgaggaaatgttttctatgttgatatcatactccagtttctttataataagagcccatctcattgtcagaagacgtgtctactgcaaaccagccaacacagggatatttaacacgttgattgctgttaaggctaagatgtagttaggcactgctccctctgtatataaatacaggtactgaaatagcaatcaatattatgaaggaagaaatcaaccaaccaaaacttgaattggagcaatgcctggtaccaacaggggctagaacaagaatgagagcaagatatgctttaagcatgggacatatttggaatccgaaaaaattgccatgaaagtagtaatagaggcaatacagtagggggcaggggaaggtggtgtcaagattcagatgctactggagttaggggaacactggtactaaaaaccagaccaagatccgtgagttcaaaccagaatgtagaccaacaggatacagagagccacatataccaaaaggtaaatctagacagatggccacagttccaggcagagagtcaaatactcgtacaaatagagctataggaatggtaggccataagaagacaggacagtcagaacccaaatcagcaattttgtcagcacaaacagcaacagtaacaagaaatgttgactgaagcaactgttaacttcatccaataaggttttatatcgcattttgctaagcaggaagcagcagaaagttgtgagcaaaactcagatgcaataaatggttgtggaaacatgcctgagattgagagtgaagagaagggtcgatcaaggtcatcaggcaacatatacagcaatgtatatacaacattcaaaattaccagcaggaaaagataaacactcctttggacatgagttgcttcttgagcattgcatgtaaaaaaagctgagcagttagcaagttcccaagaaccccatctttcactcttctgtgaagggcttcagagatatttcgaaagggaacctgatgaaatgcattactgctgatggagtcagcaggtttactcctgagtttcattagtgaattcttcccaatatttagcaaccacagcgtctttgaaggaggaaaggaccagcttgtctaaaaatcaaatccttcctaagggacagctggcagaaatataaggtcaaacacttttgctggtattacagaaaagtagcagaaaaccaaccttcggctagaactaatatatgcagaagaggttatgacctcaattgatctctccatttctgcaccaatgggagacagcaaataacatttactttcttcatgagtgagtggaaactagagacaatgctaacaaatttcataaccaatatttgggccaccctagtcacgacatcccaaagaagatataacagagctggaaaagatccagggaaaaacaactaagataatcaaggggaaagcttatctttccgtcaaggacagactaaaagactaaaaaggattagaatttctcagactgggaagatgaaaatgaaaagcattagtaggggaatgtgaggctaaagtcgactctggataaatataaatgtttttactgaatttcaaagaatttaattaaggccattccttgaggttaaaggatgcagattcaagagaaattaaaatgcctatatttatatagaagtcggtacatttatggaacatattattattaagacaaagctgaagtggggaataggaaaagtttgacaccattggataaactcactgccagttgatttacaatgcattattaagaagtggtcatgatgtatccgaatttttaaggtaaaatgtactaggttacctgacaaaacaaccattggtatcttcatctgggacagagttccgggctagttgccctgttggtctgacccagtgtgatatttcttatgcttttattatgacatctatactggaacatcctgcatgcatgtttgggattcctaaattcttttgacagtccagaatacagaagaacaattttctaactcattaagaaagcaagagagtcccagctcttggctctgtttggtttacccatatgggagcatgcaacataaaaaggtgaaagaaatcctaacagaatgcagcagctggttaaaggctattatattgaaattttcatgagtttgacagtaggccaaaaaactacaaaatggcagagagtagaaaaggcagttgtaacaggttgaacattgttggtgattattttttcagtggcaatgaaagctgtaatcaaataacctgaaagagatgctggcaggaataagggagccccaagggagagggaatatgaaaactgtaacaatgatgtatgctgtggacaaataaactagacaaacacgtagtttgaagtatcaaaatcaaggttcttagcctcatatgaaaagctgatgtcaggatgcaggcataaacactgcctgatttgcaaactagagcaaaagatgttaatgacttaaaatctcaagaatgagtgcacaattcaacaaccaacaggaactgtgccactggtatagaaacctcttgttatgtgggcgatccctttatcccagcattgaaaagaaaaagttacaaagcattaaaaacatagccagagaagacacctggttttgcagctgggcatctgtggtaaaaactcttgactggaagtcaagacaaacaagataaaaaagaggaaaaatgaggactggttgaagcactgtcactgtaaacgtatttttgttctttttagaccaagacggcatctcagattatgaacggcattaagctgtgcataaagtccaccgaaccttgtacatcaaattaatttggtttccatagaacattttagataatagtaatggctaataagacacaagtgccattaatcatctgcttactgacaatgttcattttataaacatgtatgttttccctatattacagtttaacattttacactcatatttgagaaattataccatccctaatttcaaagagattataattgtagagagaattgctctccataaggtttcagagatatttttgagaaattacgtaatttcctcatttcaaggaactgattatttcagaggcttttaaggtctccatactcaccttttggcaaattttcctgcctattgttctctctctcttatcatgagccaggaagcataataatcctaaattatataccaagatttgagctctttaaagaggtgtgtggtgaaattggagtgggttgatagggcatatctaaagctaattaaacagtggaaaaataaaattcctgttttttaaagtaagaatttacattatgttcattaaaataatgaattttaaaaataaagatattatcgaacaaaagctgagatcttcggtttttaagtttggacaggacaactgaatgagtcatgctcattacgtcttagagctaaaaaggatcttagatatcatctagtccaactctttattttataaattagaaaccaaggtttggctgggcatggtggctcaagcctgtaatcccagcactttgggaggccgaggcgggtggatcacctgaggtcaggagttcgagacgagcctgaccaatatggtgaaacctcgtctctactaaaaatacaaaaattagccaagcatggtggcaggtgcctgtagtctcagctactcgggagctaagacgaaagaattgcttgaacccgggaggcaggggttgcagtgagccgagatcgggccactgcactccagcctgggcaacagagtgaaactccatctcaaaaaaaaaaaaaaaaaaaaaaaaaaagaaagaaaccaagatttttataggttaagtgacttgcctaaagccatacagtcgcctaatgacagagcctctaagactagactggaggactaaaattgaagttttcttattcatagatctgtgcccttatcaataccatcaccatggtctttaggtacatgaaggagcattggacaaataggatatgtagctgctctctaattccactgagaaacagcaagagactaatacacagaagggaattacagcttttctggaatttgtctctttattattttttggacggagttcatttccattccctcacagcaatgtactgggatctcttgtagtagaagtaacatcagggagaagatgaatatatagggaaaggacaatgggaccggggagaccctagcaatccatgtgagacctctagtgagccccaaacaagtagtcatttggagaataatagcttaaaggtgtcttgaattctccagtgatcctaaaacctcatctatgaaaggagaaaaagagtctttatttcagctcataaaggaattggataaaagtgagagctttatgaattggttgaagaagtagcaggtctcaaacatcttagtcggaaataaaaatttgtgaggacaaagacactgatgtaggaaatcactgtctagagtttgaagaaaattgttccataaaatatacagtggatgtaaggtaatatacagtgcatgtctacagcaatatattatttaataaagcatgtgatttaaataggtatttaaaatgtacagttttgagtgactaatgaattaaatataacaataataaaattaaattcataaaatatgaaaactaaaaagcagaatcaaacatactaaaaaagaattttcaagttaagagatacctcatctggaaaaatgtaataagacaaatggtaaaccgtttcctaaagtatgtatttctcctgaaagagtcaaaagactaccttcactcccatttttctgagttaacaaaatagaggcataaaatcaaatttcttgaggactgtagtaatgaagatctaggactgctgttattgctttagaaccgaattaagaagaattgatggacagtgaaagaataaaaacagattcgataaaagatggcaggcggaaaaaaatgggaaaacatctaatatttttagtcagactcatggcagaagcaagttcaaagacttcggttggtatcgaggactattttatgaacccagtaaattgtaattgttgttgaggtttccaattcaaagttaaatttaagttagactctagtgcacaatggatgagagactgtgaaggtatcgtaatcactcaatatcctctctcctctctcttccacgttgacccaatgtattgtcatttatatttcatgcaaaatactacagaaggtgcttccaagcactcgtattcttttgactggcacaaatgtttccagaaaacagtatctttctgttgttaggtgacaaatactgagtgttatgtatcaagaatgaacaactaagccctacgagtcgaggactgctgctttctgccttttggaaacatgtagtattcattcacccaaaacagttgtgtacatataactgcggaaatcttctatctttgacggaagaagaaatgtgagaaaacccctaaataaaagaaattgttctcgcaaagattgactcccactatcaataaaattatctggagcttttggttctattgtgaaaaatccgccccctctgtcacaaaacacaccatatatcctgcattaaataaacttttcttaaaagtcgttccccattgcatcagcaaatttacaatggtaattttagaataagttttttatccaagcttcctcaggaaaaaaaagacacaggtattgtaggccaggctaatgtcgcattttaaaaataaactcacttgtgaatatacaggttagtcacaataaatgctcttttaaaaatgtgatacttccaacttacttgatatagtagggcactttgtttggcgagatggctctctcccagggaccctggacagacgctgaaaagaagggaggaaaaaaagaaaggcaaggaggtcaaattcatcgcaaacaggaaagacaacattaatctccagaattacaattttacactgatattggtctgtttgctcagctgcccatgaagacaggatggattaacctgctgttctgaaatttctgtcctaatctaagcgaaactgaactcattcaggcacaaagataaatgcgaagaaaaaaaaaacccacaaacatttccactgctaaacctatagaacagataagaaactgaatgagtagactgacggggtttcttgtatgtgtctcccttgagtgcttttttttataatacttcctgttgctggttctcaatattttttactatttgactgactggattttattatttcagtagctgaaatatccctctgtgatatatttacattctaagttattgaagctaaagtaatatgcttatcactctgatatggttgtttttatctttattggtttaaagagaatccaaattcacttaccaaatagatgcttaatttggtgcctcaaaatgtcagctgaccagtgtgatcttattagaaaaggtgaccaaaagtgagggaatgtctactgatatcagagcgtaataagacttttgttatgagtgatgaatcctatacgtgaaatttcatttcacatactaggaatttgttttattatgacttcactgtgtattggtcaaatgaatgatctttgcattgtttttttttttttcaggcttaagttgtaggatttcttccctaaagctgaacctctacaaatatattttatatactgtttgatctgatggttttttttctttctttaagacaaaataatcttgttgaggaggcactataacatttcctcaacaatataatcttcctcctgaatatagttttaagacactggagctttaagaaacacagaatattatcagaaacagaaataaaagacgcattcttattaatatctagcaactttatgtgtctatactttttcccctgaattttcattctgctaataatttgaagcacagctgatgctgaccattatttcctcctatgaaaaactcccttttaaattagtctcacagtaaattcactccgcagtgtattgagatgtaagaaaacgtcaaagctaatatatcctcgactacactgtataatatgaaagaacagcttctaataaaagttaacttcacccactgccagacaatttaagcgtaatgaaactccagcttctttgttttatatagagtaatagagggatcaaatcacccaacctttaaccagacatgctgttttgtaccttggagatatgtcatttaaacgatataggaaatggatttgtatttggccggtaattatgctttttcattttggcagacggaaatttttaatacagagaaaaaagacatttagctgctgttttgaagtagtctctgactttccatttctttctgtccttctttctctattcctttcttttcccttcctcctgccttccctgcttccctttccatctttgcctttctcattctcttcccaactcttctcttgtccttttttcttctgtaggatgcagctctcctgtccaaataagttcacagagtaaataagatctgatttaaaaacatgggctaaggccaggcgtggtggctcacgcctgtaatcccaacactttgggaggctgaggcaggcagatcatctgagttcaggagttcaagaccagcctggccaacatgaggaaacgctatctctactaaaaataccaaaaaaaaaaaaaaaaaaaaagccgggcatggtggcaggtgcctgtaatcccagctactcgggagactgaggcaggaaaatcacttgaacccaggaggcaaaggatgcagtgagctgaaatcgcaccactgcactccagcctgggcgacaagagcaaaactccaactgaaaaacaaacaaacaaacaaacaaaccatgggctagacttcctgacctatctggtcagagtctgttgttatggaaatattaaaaagctagccctctatagcaggaaacatggtggagagccagaaattatagctcctggctgctcagtgtaccttcttcttaaaataccagcatcataaaaggaagaagagaactccagagagctcttggtccagccctcactggctgtgaatgccaagcctgtgaatacctaaactgagaaaagaatggctattctttccttaaaggtatctatgggctgaggcctcacaatttctcttattatacctttctagtttttttttttttttatcattctagtggtccagaaattctttctaatttggaggatgctagaccatcctctgatagcagaagaatcactttggatttcctacactattcttaggcgtctctcagaaagaagtgtgctggagagggctgctggctgcctggcctggcttaggggctttcggcctgaaagaaacaacctctaagcagcgagagacagaggaaaattggcgttgcctggctgagctaatgggaagacctacgtagggtatctagagttgactttttatgtttacattaaaaggggaaaattttcaattaaatgtcagagaagttatcagaatatgcttgaactaaatagctgaaaatatttttaaagaattttaaaaatattataaattctagatcaatatgaaatttcaagcttttgtaattgcagttcttaagtgttcatttattttccttaaaaaagctttttgtcttatgtgtagccatcaaataggtccaatggtgagattcagtgtattttttttctgaaagatgtttttcccctttgattcacagtttataaattcacctaagcaactgctttgcagtcattgtttgaaaccttacaattttatgctcaaaaatgtccttgacacaataaaaaaaaaaaaaaaaaggaaaataacaacagcctcccctcattccttccctgccccatcataatcacatacacacacactggaactacttgctttagaaataacacacaattggatgatagttctacggaattgggttcagtgctccttctcaagagattcttaagggttgtcgacaatttcatttggggctgccagatgattctggtcttccatctattcaaaagttgatcaaatatgtggcagtgctcacaagtgtgccacagaattttttcatttcttgtagcagtactgatgccaacaacagctgtttcttatctcagtgtaccagtggaagcttgtcattcttcataaagctagcctacgtaatagacacacacatcttttatgcctgatgtgtccatttttagtagcccatcaaaagcaaatttatcggcaaatagtttctatatgacaccgggttgtcctttggtattttcttatacagatgtgcttataaccactacgtgtaattccagggcagctttgtgattcagattcttgaatgtacaaatcaaccattatcatacggcaccagcatcatggggtattgtccactgaatttagatagcaaactacacatgcatttatttattgcaaaaccaacctctgaatttccttttgtgttacagacacagtatgttattaagagcaagaaagggtagcaattctatcttcaaatgcttttccttccttgaggtgacaggattcaatattgtgcccaaggtagttttgaaaatcacaagcacaggccacattatttaggggaagttgttatttcagccgtttttaaatgcatgatgaacagaatgttccaagtgatgcaccctggtgttaagtcatattttaatcaacataggggcctaaccagaaaattaaaaagaatgctaatgttattttaagacatgccaaaagagcactttctggaattccaacacaaataccttcattcatctctctacttttctcatacttggtggatttggagtttgataacataggtgggtcaaaaaagtggggacagtttagataaataaccgatacagcaatcactggaggtaaaatagaaaactcacctctggggttgaacaaaaggcattagggaggatctactagacttgttttgtcttttccagaatgtcatataaatacagtatgtaaccttttgatactggtttatttcactcagcataatgcataatccatattgctgtatcaacgatttgtttcttttcattgctaagtagtatgccattatatgggtgtactacagcttagttatccattcacctgttcaaagacattaggttgcttttagcatttggcaatcatgaataaagctggtatcaacatttgtgtacaggtgtttgcataagcataagttttcatttctctaagatgaatgcttaagagtgggcttgtagggttacaacagatttttcattgctaaaaaattcccacttatggatgtaccatgatttattgaataaattccctctttgggaacatataagttgtctccagtttttcactgttctaagtaaggccacagtgaacatctttgtagataaatctttgcacatattttagttacttttttaaagcaaaattcctagaagtatatttacttgattaaaggctatgaatgttttaaaaacattttacataaattacacttatggcagcagaagcctctctttattgatataagtgtaaagagaaaaatcaattttctgcaggtcaatagtatttagttggcataattctcaaagcaagttagatatactgcttgatacagtagattatttgggaacattcctctcacactctcctcttcccctgatagactgtaaaactcagagtttagaaaggcactcaggatgttggctttctatttcaaagcccaatccagcatcttgagagggagctggatatagcagaaaatgtccagagtacagattcagaagaactggatttgagtcctgactcccctatcacttcatgatcttaagctagtctttttcctgcctaagccttattttccttatattccaatgggaataatgatatctccctcaccaaaatgttgtcaggataaaatgaggaaatcaatatgaaattgctttgtaaaatgttaatcaccacacaaataatgtttgtaatcacatagctatgatgtgttgtctgaatgatggttaattgtggaaccaattctttctctctcacctgggcagcatttatctgcagccttgaatccactcctaactactgttaatgtgccacatgtagtataaagtatggcagagagaaatgcctttgaatagtatctaactgcctgggcttatggtacttctttctacatctctgtcttcctagaccaatgacatctatacaacagatctttcattcttagctagaccatttatccaccattcatcagcatgaatgataaacagattagtctatattttatgcagtgaaaatcagaggcccatagactgattagcatttggcaatcatgaataaagctggtatcaacatttgtgtacaggtatttgcatcagcataagtttggttcttttcactgaaatgcaagtgaaaggacaagaccataagtactagaatcatagcagatgctatgagaatggctggactctttaaggaaggaagatcgtacaaagagaactgcatgtatacaccacattttcatacaatggaataccattcagcattaaaaaaaagaaggttcctaccattggtgacaatgtggatgggccttgcagacatgctcagtgaaataagccagtcatagaaggataaatgctgtatgactccacttttatgaagtgtctgaaatagtcaacctcatagaagcagtaaatagaaaagtggttgccagaagacagggcaggggaaacgagaaattgttattcaatgagtataaagtttcacttatgcaagatgagtaagttctagagatctgctgtacaacatagtgcctatagttaacaatactgtgtagtgcacttaaaacttaaggggattaagagggtccacctcggccgggcgcggtggctcacccctgtaatcccagcactttgggaggccaaggtgagcagatcacgaggtcaagagatcgagaccatcctggccgatgtggtgaaaccccatctctactaaaaatacaaaaattagctgggcgaggtggcgcgcacctatagtcccagctactcgggaggctgaggcaggagaatcgcttgaacctgggaggtggaggttgcagtcagctgagatcgtgccactgcactccagcctggcgacagagcaagattccatctcaaaaaaaaaaaaaaaaaaaaaaaaaaaaaagagggtccatctcatgttgtgttcttgccatgcacagacacacacaaaagcaaagggacacaaaacttttgtaggtaatgaatatgttcgttatctttagtttgactgtggcaatagtatcttgggtgtatacatatgtccaaacttaccaaattacatatattaaatatgcatatttttgcatataattataccccaagaaagctataaaagtacaaaaaaaaaaaaagatgagtacagtggaggaaaacaaaagggaatgtaccctggcaaatgcccccaaatggcggtggcagtagaactgctgtcaaagaaaaataatacagaagctagaataaagtgggatgaaacacaagaacagcctagctggtgaagtataagcaattcttgagcctgacagactaagggtgtagaagaagaagatgtatttgatcccacgatcactggtgacctcaaaagggcaatttcacactagtgatcagaggctgaaggagggagtagacggaggggaagcaagcatttgagaagttgtgtataaaaagaggaaaacagaaatggaaaggggcaacatctgattgttggtcatccctctcttgtgctctgtaacccagcctattcagttcacttcattactgaatttgcttagggtttctttataacgttaaattatatgcaaaatgtatttctatcgttttcatttcctaaagtcataatcaggattataatacagtatttaagctttcatgtagttattagtgttgaatatatatgtatatatgtgtaatttttcccattccaatttttttctgtatgatttctattttcttttgatgtgacgcatatagttcctgtagcaagagtaagttttctgtcatttaaatgaaaggccaagttaaatttaacacttttcaaaacgttaaattaaaataaggatagtgctttatatgtctatatcgtatatcaaaagtaaagattcaatgaaaactttaagatcacttactaaactttcaaagatgggcagactttccataaagatttcaacagcagagacagatgggctacattccagagaggaaggtcacaagagtgatgaatgagacctctaatgtctgccatagctgtgaaaatctttatggctaactaaaattcctaacgaataacaacctgtaaatattatatgagctgtcagacagataatgctgagctctgagaccattgcacatggtgaacagaataccacaccatgggatttgtcagtagattgccaagtcatttagagtatcaggctcacatttgatctgggaagtcaagagttcatactaaaattcttggcaaggtgactgagttgcagagataaaactatatctaatatccagtgctgatggctgcacagtcacacaaagtctaatagccaaagttgggcggcattactcatgaaaaaaaaaaagaaaaaaaagctgcttctaaccgacttatagaaaacttcaaaaacatcacggtgattattagaagagtaagaaagcaatcaagcttcctaaggtcagatataggaagatagatacctacataaatagagccatgaataatttatgctcaaggaattttcgagtaaattcgaacataattggctgactgcattaccagggaactttcctccaggtaatggtggttacagtctttgggccatctgggttaagtcaggttactaacaagtcaatgcaatatcgccaggtgcctttactgtctctgcagatgtacttttaaaagacgacaggcagtccacaccatttgctgaacgctctctgtgtgaaaggtattgtattaggcaccagggaaatttcaaggaaagtaaaatttgaaacctgagacagtagggagcaactcagatattaaaaaccaaatgatcatagatgggatgtacatccattagaaagcgagaagagtgagaaagaactagcaattaacgcaaaaagagtataggagagattgaatttggggcccatttttcactcagttgtgaaagaactaaacatgtataccttagccatggcctcatggtgagcgcagtgtgcttcctagctccttgaccttggcttgcttgaccatgtgacttgctttagcagatatgatgtgaacagaggcttgtcacactggcaatctgccatgagaacatgccccaggttgcttctgatcctttagtctggggctcacaacccaacacatttagaaaccatctaaactgaactcacagcctagaggcgaacccaggcatgcttcagtatgaagtagagctttccagtcaagttttatccagatcacccgaattacagttgacctgtagacccataagcatgagaacagaagctttatattcttgtatagtagttatattgtggcattattgtggatacagctgacagagagaggagtagagagagaaggggagaggggaaacagtatcataaagattaaagaataaaaaatatcctccagccaaagtctctcccatttgttactagccactgcctctactaacatgcaaagattaatggggattatcatcctctttggtctgtgcagttgagacgtgtgggttgctattcactggtgtctggaaccccttttctaaggctgataatccataatagttacaagtatgaacttgaatatgttagtaaattgttctagtctcagttttctcttctgtgaaatggagacaataacagtccttattttaaaggttggtgtgaggattaaacgggttaatctatgcaaaatgcttcctctgtgttaagagcacagagcgctcgatactttttaaaaattccaactcctacgtttataattattttcatcattaatgtagctagttatcaggatatttatctcattcacgaacttactgccaatgtgaggaatcccagggtaaccaggaaagtgacagagactttccatggttctagagttaaactgactgttaaccaccaaagcatgggaccagggaactagttaaggaaataatctttcttcctctttttctagccattttctgactctttaaaaaatgttacgcggttctcagagtaataaaacatgaacggagacaaatcttcctcttggcattctgatgctgatgtttactatgaaaatcaactgtgttttatcattatatactatattagtattgcttcagaattcaaaataaatagctaaatatttttagaaataaataaaacattcttgtttaatttcaattgttggttctgatttttaaactaaatttttacataaccaagcttactattttttttcctatttaaattggtgtgggtgattcatgttaatggaattctctgacctgaagttatgtgctgtcttgtttaagacataagccttgctgcccccgccttttttttttttttttttttttttttgcctgaagataacaaggttgtcatgagcttttgtgttgggttccaggaataactgaagatgcagttcaaaactgaatcttcctctaatagatgtatctgctccagatctcctggaccaagtcttttgaattactttctttcccttgatagctggtctaggtcgaattctataacatgaactccttcacttttcacctcctgagaataaatcccttctgtccctaactcacaccataaatgagctcatttcattccattcctcttcgattttttttttccacagacatttcctgctcagactttttctttccctatcaaattgccctcatgttgactaatccttcaattattctctctcgtctgcctatttctatctcattaaaacattagtgctctctaaaacctatatttatattcattatacatacgtaagaaatcccttttctgaacagaagggcggtaaggagactacacacgaaactggaaagggagatattcatctttttttttttttttggatacagagtcttgctccgtcacccaggctggagcgcaatggcgcgatctcggctcactgcaacctccgcctcctgggttcaagcaattctcctgcctcagcctcccaagtagctgggattacaggtgcctgtcaccatgcccagctaacttttgtatttttcagtagagacggggtttcaccatgttggtcaggctggtcttgaactcctgacctcaggtgatccacccaccttggcctcccaaagtgctgggatcacaggcgtgagccaccgcgcccggcccgagatattcatcttatcagaatggctaagtagaagggagaaactgatttttcatcactgaatgcatcttgtgactcttgctaggtgagatcagggaccaagcaattataaacattctttgctaagttcctatcaaaaggaataccctctactttggatttgcatgtagcctcagggacaatatgcgttaatactcaactagatagaacatctcctttctctcactgtggaatggattcctcccttccattctactcccattgcacccactatttactaccactgtaggaggtcattttttataggtctgtcttttgtgattggtatttaaatgtcccaaggcaataattctctttttatcttcatatttcaggtgactcgtttttgttaataaatataggaatgaatgaatgaatactacaggcacagtaagtaacaatgctacaggcaccatgtcacttcttagctcagaattctatgacttcccttctcacaaagcatatatgccaaaggcttttaacgatagccaaccatagttgataagacccttcctcgtctggcccttggtcactcactgacctcctatcattcaccatctttcttccttggcttcagtcatactggcttccttgctattaatatttctcaaaccctctaagcatgctccatcttggatcctttacttttactgtttcctccacctggaacactttgtcccccaatatctgactggtgtacttcctcacatctctactgaaatgtcaccattcctgaccactccactaaaagggtccccttctcccatcctctagcccctttagcctgctttattctttgtttttaaatcaaacttatcatgacctgattgtccatcttctcttgttaaaatgtaagctccacaataaataaactttgttttatttactgccgtttccccagttcctagatcagagtttgatttacattggtcattcaacagacatttgttgagtaacaaagtgaatcaattcttaactgactgaagataaagtgaagttcattaactctttctggacattagactaagcaccaggctaagttctttcattttattagactgggaacaatcttttaagtgcccagttattcattcaatcaaggcatatcctgcatctaatatgcaagatgttgtgttagatgcaaaattatttttaataaaaaagtaatgcaggccctatgcccttaaagtgctcacactccaacatatttcctttcaagatctatgttactgaccatcttacgttctaactcttgcctgtcatgggcatgtatgctgctgagcttaaggtttaaggtaagagattcatgtaattttatgctgtccccaaagtccttacctattaatggagatcatgaggttggacaccttaaataataataatcactacttatcctgaacaaaataatcaacctcattatgaaagcaagagtaaatcaaattacccagtgactgtaatgggcctattataatacctttttcttagatgcttctaaatgcctgtcaatttcattgccccctcacagattggcttcctccaggaagccaactctaaggcaatgattagagagcaggatagacaactgtggaagggaagtgaaagaaacaggaatagaaatagggagaagtcaaggtgaatgcagacccagtgacagtctcattcaaccccatgggagctcttgagctagaatgttaatgttctcctgagttgggccaaaatggccaggtcattattcccctacactgatcaggaagagctgcccctgtaaggggtatgatcttgggtgaggcagctgatgcaattcctgaagattgtctgctgaggacactccctttcatcgagagactaaagggtccctaaggatgcagaaaagcaacttcaaataattcctcaggcataggtcactgtatttagtgttccacatgactttcattaccacaaattgtgcaggcattggtataaaggagtgattctcaactaggggcaatttcacccaacaggggacatcagacagacaatgtctggagacatttttggttgtcacagctaagggaggggagtgctactggcatgtagtgagtagaggccagagataatgcacaggacagcccccaataatttttgcccacagaggtgtgatcccaccatttctgttgcgcaaagctttgtattctaggacagatgacaaaatgctaccccaggccaaactcacaaatgccttcattttctgagtagtgtaaaaatacacttttcagagccagcattccactaattatctggccccaaatgccaatagtgcccaggtcaagaaagcctagtttacagtctggcctgtggcctgtgagatggcattacccttagatggataataaataactaatccaatcagatgctttgtcttggagagcttgaatgtaatacacagagataaacagagatgacagatgggtggggaagtttaaaaagtcggataacaaaggaagaaaatggaagtcataagaaagtagaaactataagtagaaggtgttaggtggagagaagagagaagatatgatactgtaatagtctgaagtctatggcagcaaatgcatatacagaaagaagcaaacatgtttcgtggtgtctgttgttccatgttattcttttctttctttctttttttttttttttgagatggagtctcgccctgttgcctaggctggtgtgcaatggtgtgatcttggctcactgcaacctccgtctcctgggttcaagcgattctcctgcctcagcctcctgagtagctgggattacaggtgtgcgccaccatgcctggctaattttttgtgtctttagtagagacagggtttcaccatgttggccaggttggtctccaactcctgacctcgtgatccgcccgcctcagcctcccaaagtgctgggattataggtgtgagccaccgcgcccggcccatgttattcttcatgcctctctgtatcctgaaaatgttccttatcacctaagcctatccctgtcccttacagccttaaggagacatagcacataacagagcagtacctgcagtcgcctgaaatcaagatgatttttactgcagatatctgaaagtctatttaaaaatctagaatggtttttaaaccaggaacagtttatgtaagtctactaaagaacaaaatgccttttgtcctcacttcaaagttctcaccagaaagtactttgtaatcccaaactggttgtgttctgaaaatggaaaacatccaaatggaaaaacgaaagtaatgattcttgcccacagggatgtgatcccactatttctgttgtgcaaagctttgtattttggacagatgacaaaatgctaccccaggccaaattcacaaatgccttcattttctgggtagtgtaaaaatacacccttcagagccagcattccaccaaaatagtgcccatgttataaaactgattcagaactctggtgctggtctcttggccctagctcctcatgaggcccagaagaatctgtcacaatgaggaagatgaaataagaaagaaacagacatttgtctcatctcttccatgccaccgggctaatttccatgtaagtccgtgacgaaggagtggtggttagtgatccagctaaatgcgcccattcagctctaaagccagattatgcatggggtatgatagcagcttcataaagtctaggagaggttaatactattgttgttccactcagatcccttttactgagctggttcacccagccgcagttgttgtgagtgttggttgctaaggcctcattggtcctttcaccagaaatcctcccttggccaaatgggaactgctttgctatctcctactccccagaaatccacagccaatgactaattcacacgggaaaataaaagcccagccctggctgggcgcggtggctcacgcctgtaatcccagcacttttggagaccgaggcaggcggatcaggagatcaggagttcgagaccagcctggccaacctagtgaaaccccgtctctagtaaaaatacaaaaaaaaaaaaaaaaaaaaaaatccaggcgcggtagtcccagctactcgggaggctgaggcaggagaatagcttgaacctgggaggcggaggttgcagtgagccaagatcacgccattgcactccagtttgggtgacagaacaagactccatctcaaaacaaacaaacaaaaagcccaggccccttatctcaaagtagggacaatttgttctccagagctccctgtgggatcaagctgaagtgagtctcttccttcccacttaactccttgaccagcatccttcttactttatcctgcttccctcactccctttcacctgaacaaattacttctacaagaagccccatctatctaaatagggctctacttctagggattttacctaaggctagggtgagcaactatcttggtttgcctgggactacagagatttcctggaaaatgggaattccagtgctaaatccgggaaagtcccagacaaaccaggatgagtggtcactctgcaacgcacataaatatttggatcctgagcatccttcctgctaagtttatgaagattctttgcctacagggacttgagtgatccaaataacatagataaattagtcatttctgggaaaccatctatgcacaaaaaaaaaaaaaaaaaaaaaacaaagtgccccaatttgtagtatttgccaatttccatggagtaaatcttcccactatgcctgatttcaagctaccaaaggtaggcttaataactagctcacaattcctgtatattttacaattggctctcttgagccattgtaagccagccccagcacagaaattcccatagcagaaacaaaaacgttctgtttcctcatgtgttcaaattgatgggatatatagggccaacgatgcaaaatctggttgctaatgatactgtaaagcaaataaatctgagagcttattggggagtatacatttgagctaaaggagaaaagggccatgacaacacattttaagaagagaatataattattactgctgtagctgctttttatgggcattggaaaggctgtctttgaatttataggggcattatcagcatcactggtaggtcacatggcatttgtcccaaattcctaacacttgggacaacatgtgactgctgaagaaactggctcaaatcatttcaccctgagattttacttgaaagagaattttagcctgcaaatcatctcacattggacctgcaaaattctttctgacttttatcatgatggcttattttgatgtttttatttttttgagatgcagtttcactcttgttgcccaggctggagtgcaatggcgcaatctcggctcactgcaacctctgcctcctgggttcaagtgattctcctgcctcagcctctcgagtagctgggattacagatgcatgccaccacgcccagctaattttgtatttttagtagagacagggtttctccatgttggtcaggctggtcttgaactcctgacctcaggtgatctgcccgcctcggcctcccaaagtgctgggattactggcgtgagccaccgcacccggcctcatgatggcttatttaagccaatctgaagctttaaattattgccccactcatatttcaaattgtctgtcccctgaggacactggtagcataggttggagcactgttaagtgaaatgtcagcaattattagatgtgcttaaaggtttcccctattttttaaaattaagtgtgtatgtgtagtggggaatgtccaggatgaaagcttggcaactctcaagatagaaacaaactgctaggccctatgtatcaaggagaaactgtaaaagcttgagtcactttgacaagagagaaaaagacttaaccagggatatgattaaggcagttaagattgtaaagcctgcaagaaataatggatcagttatttctttttacagtgtctcataatctgagaaggtcactcaatgaaacagcttttaaattcagaataaatagtaaaaaggaaatttgtctttcagagtcccattgccactgcaagaggtcactggttaaaagctggagtataaaatgttacctttattgttttttttccattacaaaggtagtacatgctattaccagaaaatttgtaaaagtaaaaagaaagaaatgatgcaataactgtttgtcttttggtatctttttattttccatttttcctttatgtgtacatttctgttatttttattttattttgtaatatagttgtgatcatgctgtaattttgaagtcagccttttcccttaatgtattacatggtacagtcgactttgataaaaacgaccatataaagttatgaatgctattagtctttgctgagaagcaacagaaaaggtcacattatttattgagtgtctactatgtgatagccactatgctaaatctcatgcctctgtgtattatcaatgtcaagagtgaatttacctcttcttcttttgggtataagacataattcattctgtaaatatttactgaacatctaccaagtaccacataccacattaggtactgtagaatataactgtcaacaagactaatactatcctgacattttagagattaaggtctatctttttgattatttatcactcgttagttatacaaacaactattgagccgttctaatgtgcaaaacactggactttcagattagatccttggaaatcatcttcagaaaggagaggaactacttatactgaccattaaatgcaagagaatgaatgaaactttcatgactagtttgactctaacaggcatgcattaagttatactatcaagctgatagtaataatgatactaatgctaaagctaatagcaaacacttgaatagcacttactatgttccaggcactactctaagggttttacaaatattaactgtttgatcttcactgtaaccctatgaaataatacagccatatttcaccgaattcaatatcccattggtcgtatggtgcattctgatttcagaactgttgaaacgtgggtggaaaagtgtgtcttacaattgaccaaatatgttactattatccctattttaaagatgaagaataaagagaaagaaaaaagcataaagtgtctgagtcaatatttgaacccagtcagtttcattttacagcttttactcttaaccgctatcgataccattttgataaggcagtttttagcccagaggtgttgagagaaaaatttaggttatgtaaatcaacttaggatggccaaacgaagaggaatatacgagagaataatcgttggcaatagcagatagactagacagttattggcctgggcatttcttcttaacgggtaaggcagtgtgatgtgtggcttggatgtccagaaactgggttccagtcccagtattataactatctttgtgaccttggttatgtcatttgatcgttctgcacctatttcattatctgtaaaataaggaaagggctcgaatgattcaatgtttctcaaactatttcgactgcaacccacagaagaaaaacgttttacactgtgatctggcgtgcgcgcgtgcgtgcgcgcgcgcacacacacacacacacacacacacacacgcatgtacacacatatctaacaaattaaccaccgccaaaacaacacttaaccttgcttaggtaatgcactctgatattttctaatctgttccattccattccattccataccagtcaaaaattgttggttgtaagtcattaaactgattttaggatttgctaatgagccacacctcagagtttggaaactactggtatagatactttctaagcttatctccagttaggaaactccacagcacaagagggctcctgggtgggagtggggctgggaacttcagtaaagagagggacttgacccttttgcctcataaatactcattttctttttaattggatcacgtttctacaacctttagcagaaattttttgtcattaaagcatctggcaaataccacattaaggcaaagattcactgtgatccatggcataaagtttagtgtgaaattaactggtgtgcctgaaaaaggcttccacagtcacctaaaactggagaactatagactccttatcctcttagagtctcagtgtataataaaaattccaagaattctaacaagaaataaacttgcttatctttgaaacctagtgtttttccaatcttattaatcagtactatttttttcaagggacagttatcaaaacctaatataacattaatgttttaaagaacctggcttggaaaatattcttttaagggacctctggaacttgtaaaatattaagaaaaccatggattctttttactgttatagaatgatttctccctttacccaaatatatagtgatctttcttggtgagaaaagtagaatttagaacagaagaccagagaattgaaataatggtcaggaaaaatctttaaattctttttttgagacagagtctctctctatcacccaggctggactgcagtggcatgatctcagctcactgcaacctccacctccagggttcaagccattctcctgcctcagcctcctaagcagctgggattacaggcgagtgccaccacgcccagctaatttttgtatttttagtacagatgggggtttcaccaggttggccaggctggtcttgaactcctgacctcaagtgatctgcccacctcagcctcccaaagtgatgggattacaggtgtgagccaccacgcccaacaaatctttaaactcttcaaaagaaaaggacaattttcagactactatgccaaccaatgaatactttagtactttcttaatcacagacatatgaagagactgacaatatacctaccaattatacatatataactataaattagtatataatttaaataatttaaatgataattttattgtaaattatatacatatttgaagtcacactattagaatttctcctttttcttggtttaagttgtagaagtcaattaggagtagcagtgtattaaaactagaagtaaggacaagttagtgtctatcagcggagaagggtcatatttcacaatgcttttctcttctcattttctcttagatctaagataaaagaaaaaatttctttaacatgtagagattgggccaccaggaagaaacagtgaattcttttttttagtaaaaggctgcctctgtcttctgataaacaacagacagctggtaatgtaatttccaaataatttccaaaggggagtgtgtgtgtgtgtgtgtgtgtgtgtgtgtgtgtgtgagagagagagagagagagagtgcacacacgtgcgagacagagagagagagagaataagataaacagagacagtaagcatgtttacgctggcgggtgcaattagtagttcctccttatttttcttttctttgtaatttctaagctttaggagccaccctattattatttatagtaacctgaaagcacattactaaacatgtatcaactcaggcctgtctaaaaaaaagtatcaattcaaattcatttaatatgaccttagaggaatatttaaaacatatttttattcattggtggggggaagctgcttttatagtagcaaatacgtgacttcagagatgtcctgcttcaaatatggtgattttttttttttttttaaatttagggtcagggtcttgctctgtcacacagattggagtgcgggggggggtggattatggatcactgcagccttgacctcttgggctcaagtgatcctcctgcctcagtttcccaaagaattgggattataggcatgagccacaccatgcctagctcaaatacggtttggatggcacacccaatttctggtgcaattttctagaggtaagtttggcaatacacttgaaaaggcttacgaatgtaaacattctttaacatgacaattccacctttaggcatttatcctgtagaaagaatctgagatatttgtaaaggtataaaaaggatattagccataatgctcgatataataaagattgtgaaataatctttatattgagcaatttagaattgtgttggtaaatttggtacagccacagaagagagtattagccagtcattagaaaaattactctgaagaagaatatttaaacacacgaaaatattggaaagatagttttaagggaaaaaagcagctcataaaactgtagcatgtttttatctgcgcatggtttaaaagaaaagagagaggccgggcgtggtggctcatgcctgtaatctcaacactttgggaggcctcagtgggtggattacttgaggccacaagttcgagaccagcctggccaacatagtgaaaccccgtctctactaaaaatacaaaaaattagccaagcgtggtggcgtattcctgtaatcccagctactcgggaggctgagtcatgagaatcgctagaacccaggacgggggaggttgcagtgagctgagattgcactctgtctcaaaaaacaaaaaaataaaaaaataaaagatagaaccttgatacacacacacacacacacacgcaaccacaagagaaatacagaaagtatataaaccaaatttctgatagtgattatctctgagtcataggattatggatactttttcttttcttgtttgtactgtgggctttccaaatttttcttgatgtgtatagagtacctttgtaattttaaaaagtacaatgtaaagaaacaatccatccttagtctcaccgtcctatttcttaaatatcccttaaaccaagttggtattttctttatacctgcaagcaaagcttttaagcgtatattgatattccacatgggcatccaagagactgatgacttccggggctggctccattcaggcaggtagatcagtctctttatgaatacctgtgtctaacaggcctgacctttctggaagtgggcactgatgtgatatggtttgaaaggtgtgagaatgctccccttggcccctcaaagttccttcctcacagctcagagcttatggccgatgttctaccacctcaggcttatggattttcacactaataaaatgcaaataacccaggagaagtacacattaaactttacctatcacttgggttaaatgagtatatcattttctgaaaataggttttaatgggtaagacatgggaattcagagggggagtcagggagaagaaaatatgaatgaatatacctggtgtctgaggagtaattaatattcataatagtactattttttatttatggtttatgagtcgcttaggagtatgttatcacatttaatctcaattaaatcgaatagaatggctgtcaccaaggcaagttaagtagaccagagatttggaaagatgcagaagacgaaatctgtagcctttatcatttttctagagccgttcctaaaagccacgatcccactcatttagataaactgctttaacttatccctttttcttggcaactccaaagcattgtgaaactgtgtccaaataactagaccacatgcggataataaagttagagccagtccagaaaataagatacttcttcttaatctattatcgatgtatgacaaaaacacaggaccaacaccttccaggaaattttgttcaaaaagacaacagccaactggagacacacatgacaacatctactcaaatactttaaagtatttgtgagcgtggatctttttattaacccgtggagaatggaaaagaaaggaaatgatcagaaaatggcaatgaaagaatatggcagaagaatggagatcatacagaattacttcctctctataaaatatataaattaagtaaaattacagtgcgatgcttaaaaacacagactctggagccaacttcttgagtttcaatcctggctccctcatctactagctgtatgaatgtgtgcctcagtttcttcatcattgaaatgggtataataatggtacctaccttaagggattgaagggattgctataaggattaaactagttaaaatctgtaacatttctaggcacaaagtaattgcgttaaaatgatggataaaccctcatatatactcatatatgaccacaaggaaatacatcagaatgctaacagatgttaactccatgtggtaaagtatggctttttaaataccaaaaaactcaacacatatacttttataatcaaataaaaagtggtataaattaacattaatcagaggaaaacaggtgcttgccaatttaatatgcaatattgtataaataggattttctaatacttaaactttcagttaaccaaggttatttctcttagtattaattataaaaacataattaataaaatagcaaaaccagtaaataaaaagaatggctagaggtcaagaacaaaaggagaatacaaggctcacgaatgtaatcctagcactttgggaggccaaggcgagtggatcacttgaggtcaggagctcgagaccagcctgaccaatgtggtgaagcctcgtctctactaaaaaaatacaaaaattatctgggcctggtggtgtacacctgtagtcccagctactcgggaggctgaggcaggagaatagtttgaacccgggaggcggaggttgcagtgagccaagatcacgccactgcactcacagcctgggtgacagaatgaggctccctctcaaaaaaaaaaaaaaaaaaaaaaaaaaaaaaaaaaaggaaggatgcaaacagttagggaaaggaaatgcccataggctgaggtttcaacttggaggcatagtatttatttattattgatatataatattttacatatttatgaggtaatgtgatattttactggcatagaatgcataatgatcaagtcagggtatttgaggcatccattactttgagtatttgtcatttgtctatgtattgggaacaattcaagccctttcttcttggtactttgaaatatacaacacatcgttgttaactacagtcactctattctgctgtcaaatgatataacgtagtccttctatctaactggatgtttgtacccattaaccaccctctctttatctccccctctacccacacacctttcccagccactagtatctatcattctattctatgtttattatcaatttttttagctcccacaagagtaagaacatgcgatttttgtctttctgtgccagggttatttcacttaacataatgacctccagttccatccatgttgctgtgaatgacatggtttcattcttgcagtgtttcattgtgtacagataccacatattctttatccattcatctgttgatatacacttaggttgatttcacatctttgctgttttaaacagtgctgtgataagcatgcaagtgcaggtacccttttgatatactgatttcttagctttgggatggataaccagtagtgggattgccagatggtaaggtagttctatttacagtttgttgagaatcttcatactgttactaatttactgttacattttcatcaacactgtaaaagagttccctttcttcacattctcaccagaatctgttattttttgtcttttgaataatagccattctaattggggtaagacgatatatcatgtggtcttgatttgcatttccctggtgattagtgatgttgagcattttttcatatacctgttggccatttgtatgccttcttttgagaattgtcactcatttcataaggcagggatcatttaatgaattatttaaagaattatagagtcacagtaacatatattggatgatcatattataattacatgatatcataattattagctttatgaactgaactgataggcagaaattaaaaactcaaaagtatgtttttgcttcagcagcccatatactaacattggaataatgatacagagaatactagcatggctcctgagcaaagtgttccacatttttcaaaaagactcaaaaatattaatatggttaacatttgagaatatagtgcaggaaacaattatgcattagctgaagactggacaaaatgatccaattggccttcctcttcctaaccttctcaacttatcaaccaagttatatttcaggatgatttatgcttctactgcatctgataaaagattactataattcaactcttaattcttttgttttttcaactgttattcttattaatcaagatgcaataaagttaagtgataaaagctgaaaatgacttactggaaagaaagtgctgagatgctggaccaaagtccctgtgggcttcatgcagctgcctgactcggtcctcgacggccacctgggaggaaaaggagagaaatgatgttctctcattctatataatgaggaacaattaaaacaatgtatcctttctgataagatactttgagtctccaagactgagaacactaaagcaacatttcataactctagttttaatattcacttaccgtatatagtattccagactcgtttttatcaatccaaggccaaacacaaaggatttcctctctcgacaatgttaaaatgagattttggtttttttttacagtcaactcattggcagccacaaatgaactactgcttcaattagtaccataaaaaaatacaaatctttactttcacaaaaacattagggagggtgacatttggtataggtgactacagaatctcagaaatgacatgtcttgtctttaagtcttaggctattgtttttgacaaatttttaaagaagcaatattgattaatagataataaatcattgagtgatatttaattattgataattattaattaaccagtggttgattaatatttaattatgggctgggcacagtgactcatgcctgtaatcccagcactttgggaggccaagttggctggatcacttgaggtcataagttcgaggccagcctggccaacatggtgaaaacccgtctctactagaaatacaaaaattagtcaggtgtggtggcgcatgcctgtagtcccagctcctagggaggctgaggcaggagggaggctgcagtgagcagagatcacgccactgtactccagcctgggtgacagagtgaaactccacctcaaagaaaaaaatattaagtatcaaagaagtacaggcaaggcttaaatttgggataaaatagggtgggtagtaagataaaactaattttcggaattcagttttcagtggacttggaaattattaagaaatatacctttagggggcatgcagtgaaaactgccattcttttcttcctattaggtttttctataatatattgacacagtgtgctgtcaacttagtgagttctattcttggtggggaagaaaggaataattttacgggtgacatgctatacttacttatttggcattttgccaatccaatataagtggtggctccaggcatcctagctctctaactctggattttgatttagttgtgaacagtccatgctaaactaggggttgatcagagcttgcacagagcaatcagaactcagggggtagttcccgtggtgtgcagaattcccgagaggtaaaaatcgatgttaatctcatcagaaaagtggctcaggtagcctggtctcaaaccaactctggccttccaatatcaattaagtgcctagtgtatatccagaacaatctcattttttcactctctccctagacttgcccatttttgcttggcccaaatacgtggataaccaagtggggttcccctacaatgcaggatttactttattttatatacacaaaagcatgagggacatatcaaacctaccttcccaaccttatgaccctgcactcccaaactctacctgctaagcccaccaaaactacctgcctgtcctgcactattccatccaatataactcttgtgcgtggcttcttcatgctgctccttctctcggcaatgctcttaccccacttctctcccagatcaatgctgttagtgtttatatgtttacttcctcatctcccaggttagaattaatggcttcctcagcattctaacagtatatggtttatacctgaagcacttctatcatataattcattttagttatatggacatgagtgtgtcttgcaatagattggaaacttcttgatagcagggaccattttttgtttacctttctcttcgaatgtctccaaccctttctgcaggaggcacatagtatatggtagcaaatatttgtttaatgactagttgaccaaacaaatggatgagtaaatgagtaaatgtggtacgtgtgtgtgtgtgtgtgtgtgtgtgtgtgtgtgtgtgtgtgagagagagagagagagagagagagagaagagaagagaagcgatgcggaacaaacaagtatgcctactgacactgagtgcactgactgcaggtctgtaatggttaattctatgtgtcaagttgactggactatggggtgcccaggtaaaccactatttctgggtgtgtctgtgagggtgttttgcagacaagattagcatttggttcagtggattcagtagattgccctccccaatgtgggcgggcatcatcctgtcagttgaggtcctaaacagaacaaaaaggcatgttccttttttccctgcaggcctgcttgagctgggatgtcagtcttctcctgcacttgcactgggatttacatcatcaactcccctggttctcaggccttcagactgggactgaaatcacactaccaattttcctggctctctagcttgcagatagcaggtcatgggacttcttagtctccaactgcatgagataatacttaattttatatattcacacacacatagacatacatatatacacacacacacacacacacatatacatacatacatacatatgtatattgttgcttctatttctctggagaaccttgactaatcaatgtccctgggtaaattattcttaactttccttatcagtaaaatgtggaaaataatataacttatagggttttgtgggaattaaataagatgatacaatgtaaagcatttagcctagtttctgtcacgtggtaattgctcaataaatgttaccagctactgttcttgctactattatggttaataaaaggagaggaataggccaggcatggtgactcacacctgtaatcccagcactttgggaggccgaggcaggcggatcacttgaggtcaggagttcgagaccggtctggccaacatgatgaaacgcagtctctactaaaaatacaaaaattagcttggtgtggtggtgggcatctgtaatcccagctactcgggaagctgagacaggagaatcacttgaatctgagaggtggaggttgcagtgcgccgagatcgtgtcactacactccagcctaggtaacagaacaagactccatctcaaaaaaaaaaaaaaaaaaagcaaaaaaggagagcaatagactataatgtgcagggcaccacatacaatacaaaaatggctaatgtttattaagcaatatgtggcatgacaatatgaattatgttatttcatcttcacagtaactctgcaataggagttaatattattccccccgacttcattgacataaaaactgaggcatgagaggttaaaaaaaaaaaacttgcctaagcttcagtagttagtaaattggcagagctaggattcaaactcattcagtctgggtcttgctcttaactgctatcctgaagattaaagttgaaaaaaagtattttataaatatttaataagtaattggctttttaatttctttaatcagtttattgaatgcagaccaattctagtgtgcatatcgatgaaactgcagttgttcaacgtattttatggcccaatgcaaggtcaattcctggtcttgaagaatgtgataccataagattatagagaaaggttgtgggaaaacgcgtgcaaataaatgttgggcatatgtcattatttctaaatttagaatgggtcatttcatgaataaatcaatctagagataaatgtgagtgtttgggggtagagaggagaagatgaagatgccatatgggagtggacactgatcagaaatctttgcacatactgagaaagaaatcccaaggggaagatgtagatggtaaaggattatgactgtgccataggccactttctctagtaagaatgttagtttcatagggactgagccgatgcagcatcaaagttcattctagactcccaatcttctctctgaagaattttgccttcttatacaaggagcgctccagtggtagtttccagtgtacattcaatattgtcaagattttaaaatgagatcaaagtgaatttccatcttcataactcaaacttaagagaaggtatgacagcgagaagaattaagcataaaatatttctttccacaaattatcactggagaaaggttttgtgtggattgaatgcacaactggctaaataaagaaacaaatttatgaatgagaaaaacttgaaagcaaccaaagtcctcgaaagctttagcttgggacttaggaacaaagcactttattctttgagcaattatgcaaggaaatgaaatttgataatctattaaacgagagcctccatgcattagatctttctaactggctgtatgttaaatcaatataccgtggtatatacaaaacaggaagcaaaagccagaaatgatatacctgtgtcttatgttctggcacaatcagttctttccttggtggtttattcattttataagtatttgttaatattgaaagagataggcaaaaaacaaatgctatagtccctgatctctgcaagtgtaaaggtttggaggtaagaagtagtgacaagctgaagaaaggcttggggctgcagaacagtggtgttgaggacgacagtgagatacaattagttagtcatgttgaaagccgatgatgcaaagcaaggcgtcccagactctgaggctcaagatttaccctgcaggcaaagagaaccactgaaaatttctgtgacatgactcactattttagaggaaagttagggtttgggaagatcagtatagtgtaaaacagattcgaaagggcacctgagactgagatcagaaagaggctgttgtaacttactagacttgggttgatatgcattagaattaaggctgtattgtattcaatgtaaaagaaggtacatatgagaaggtattttgaaaggaggaagaactatccaatttggtgttggagattaatatctgaagaagcaaataaactcttggatttcgagtaaggaagactgggagaatgaagatattgctggtggcaatatgaaaatcagaaaaggaagaaatagcatatgtatgtatgaattcatttggaacataatgaatttgtcctaacagtgaaacatttaactggagatgtcatgtatagccagttagagatgaacaatttgtctcagcaattaaagaaaggaaagggaagtgagactaaaaggggtaagagtgagctttggaaggtgagccaagaaagaagagataaaggagtttaaatagaatgatttaaacagccaggaggaacccaatctcttctgaattaatagggcatgtctctgtttccttttataaaagtaatacaaatataacatctttttggaagcatacatcctgtttcaactattagatcatagatcacgaaagcttagaactggaagaaaccttgattgatacacgagggtctattcttcagaactatcccagatgggcagaaaactgccatctggtccatgagaactcataatctaggttgcagcaattcttcagtaaaagcatctcaggaaaaaaaggtccttttttatatgttccatgaggacagggacacatctttccctgctaaatcctcagtgagtagcacagtacctggcatataataggtgctaaattaatattagttgaatgaattaatgtactgtttattcacggatctttactattaacaactatattttgaatgaatcatttctttttcaagatccctgacacaagcttttgaaaaacttccctccctcccttcttcctttccttcttttcttccttcctccttttcttcctttcttccatttttgatgatgaaagtaaaaaaaagaaaagaagaaaaccatttagattcaattttgcctataatactagatttaaaaatgtaaaacggcaatttataaaacaaccctgaagtccaaatctcctccacatttgttttactctagtttttaaataatcatatttaagatttgagagttatgagggctatatattattctccttggtcttctcatttcagatgagttctgtagacagtatactgtttgcagagaccttcctttcttagcttcagtaagaaatatcactacattcattcaaaagatattgactagaatgtaagtttattgtccacaaagacagagatcttatctgtcttgttaagaatttatcacaatgcctagtacatagaagatgatcaagaaatactgaatggatgaatgaatgaaaggctttttgagttcctcttatttgtcaggcactgagataagtatgaatacggtagacttgaaagcgtaattctgggtataatgaatgagcaccaaatcatccaactaaattacgatacgacacacactcttaattccaagctgtgactgtttcccaaagctcagtccattcctctgtgtattgtgaaagataagctttatttcattttttcttcaacattgcttttaaataagccaaaagaataaaagaaagaaagaaaaaggaccgataacaacatcatggctcttagaaattatttcaaataaatttatctaaatgtaaatgttggttctttaactttgttttagattctcaagggcttccactttgtcttttgacctttctgttaattactctactttgagttttatcttcactagaagtttaggagagacaggcattacctccccatgtggaaatacactgctaggcaatgtggtttcttcctagtgtccaagctacatcttactgattactacatacataaatcatgtttactccagtctagagaaaatatgtaactaggaacgtatgttttgattttctggttctcagtttgtctagaccctagataaatatccatgggaatgcaagaaacagacatgacacttacacaaatgagcctattaaaacaaaaacaaaagcaaaagacagaaactcttgtgctgtgatgctagtaaataaaccacacatatgcacacaaatgactctccagtctattcacgagtttttgtcctgaagtttttcagtttgtacagtttctgtgtgcatgtgtctgtgttgggggaggaacttcctcgttcattcttactcccaaatcctcacaagtaacactcataaatacgtgcccaaacattatccgggaaacgctcctgagactgattacagtttcagttaaaatccttttaactaatggtaatccctttcagttaaaatccattattattctaattctgattcttttgagttgtaactgaaaaaataataaaaaaaaaaaaagtctgagataagttctggtcttgatttcaaactctcctgggcctcccagagtgctgggattacaggcatgagccacctctaccggccatcttctggaatgaagttttgtgataggtatagctctgcggcaaaacaacctgggcttgttgaatgcaaagattaactgaattgtctttcctttgagtttatttctgtgttttcctgacattagggcacttaggagttaaacagtgtttcttgcgtttgacttcaggatagatcacgggaaacaactagtgctaacatggcactcactctgagtaggagcataattcttaatagattttgtgtgacttatggcattgatactaatgccgtgccatctgagaccatccttaatctaccttttaaggttcctgcatcacagctttttttccttccattttatatttctgtgctgacttctttcttaatctgactcctttttttattccctcctttttctgtcctttctcctccagccctccccctttattatgttctatacaacctaccagaagagtacacagactctgctgaggcaaacagtgcctcaaatgaaggggctgtgcatgcttgcaagacaagcgaggcaggatatgaataggactcctagcctagtgccagcccaacgcttctccaagaacattcttcctctaattctgatgaactctgccatcaaactggaaggcaagagagaacaaaacagcaagctctttgtccgttgttaagcctttaatctttcacctcaccgatttctaaaatgcactttggatgtttgtttattggttttcttgcttatgcaactgcctcattctgtgataatggagtcaggttatatcaacattaaattgacttcatagacccaagtaccttaagggtatcattcattttaatttagaaaagcagcaatcaacctcctatcctgtttcatttgtcaaaatctttagttttaattacatctacagacttatgaaaattgtgacaggaagagaagagatcataggaagcatttcttctgcctttttttttttttttttttttggtctcagagagaaaagaggaaagttgaattactttgcctggaaggtgatgtaacttgatacagattttatcttaaaaaataggttcccttttaaaagttttcctaatgtatctcatgatttgcaacaggaactaaagtcaagtggctctcaccttacaacatcattacattaaatcatttacattccagccttagctatttattcttgagctttatttataccacatttggaagatatcgttctcacagaaattttctgaggccattggagcattcctttctaggggcattttggcccataagtagcataatgttcacatggtaattacataattatgcctcctggtatttgaacacaggagtatttccaaggaacaaaagtggcaatttgaaataatcatcagtgagataccatagaactggtattgtccgaaaaaaaaaaaaaagacggcatatattaggaaattcatattaacgaatgactgaaacaggtagataaatgcaaaaagataaagcactggaaatcaaacattttcatctcagtggcagaagcttttatattttgggtaacaatatacttgtagattttcagtttgttctactaaacacttctttaataaaggctggaagggggaatttgctgaagtctgcaacaacccttaaccgaggaaatcaaccctccttaaatcccgtaccatccttgcagcatttccaaagcttcctgaccttgactcccttcacagtcaatttgaccaccactcaaggaagcttgtccgccagaagaccctgtttccacttcccggctctcctcctctggcaagtgactgaaaagcgcctttcttttctctcactgatgcagaactgacaaaccagtatcaagccgttctttacaaatcaataaaccggaagatctcatctactgtacttccaaatcctacaacattctgtcttctctcttcttcgcatatcataagccacaagttatttacttcacgcttcttagtaaaggacaggggatggagcaatgtgcttccattgtttctctgtgtagatgtgtgagaaccagaattaaaactctgccatggactcacagtctctacggtctctctccctctgtcttctttgcacacttctgacctagccctcctcttctctccccctgcctccctcttccctcattccccctcaccccacccccaaggctgtttgtaagctccccaaatgctcataagactttcctgaactatttcagatattttcacttcaactctaaactaaaactattttgtttttccaaatgtggctttacatagtgcagaaaactacagggaaaacatccaaagtacaatgtgatcttttataggagaaacaaaagattgaatttctaggtcatcatggaagtaggtacacttccctgggcgataatctgaggtactttataagcttctttctttcacgaaagcaagaaatcctaaaatccatcaagatacgtgcactgtgcctcaactctctttttaatcctcaagtgaaatcaacacagtacagtgtaataaaaatgcatatagccccaggctttgtgccttagcaaagagagaaaaaataagcttcctgacttcatatgtctactgtgaataatcagtcactgcgtttttgggattttgctttataatcttaacgtatagcagtgaactccatgtttgtggtgtgacaagaataaaggattctttttctttctttaaaacaggttgttcccatattttccataagagagacatgtgtcggcttaaaagaaatgaaactacaatggtgtgagggaggaatctcctgattgttagcgtatattttctgcattttacctgaaattgtcaacgaagtgtaggtaaagttaaggcggggccctaggctgttcaataacgtggctaacatttggtttgagggccttctcagttctgttcccaaatagtcagcctttctttcccaactgcttgtccttagctgattagtaaataaccctaggaagataaatgattgttcataacaggcttccagtaccacagctgtgagtatttgcattttaagtgcaactttaaataattaagccattaattactcaaatacttattgagtgtttataaggcactttgctaggagaggaagcagaaaaaataaaaataaataagaaaacaaggggatggtctttagtgaatttgtagatttgatatttacaaataagcataataaagtattatgggaaagattttaatgtagtgcagtcattccccaatttgacagtgtatcacaactatttgagaacttttcaaaaaaatacagattcttagctcgtctaaataatttctgatttagttaatttgaggctgaggcttgagaatctttactttctttaagtctccacagatagttctgatgtacagcctggtatacatccatcagtgtagtggaaatgccacgaattttatgactcaggaagacctgagttggagtcccttactagctatttaaccagcatcttatctaacagcctgtgaaccttagtttctttatgtgttaatagaaataccacataacaacactaccaacaatgacagtaataatagcaaacatttatagagcatttactatatcccaagtgctatttcaagagcattataggtatatttcatttatgtctttcttatcagaaggtaaatttgatgagggcaggactcaatctattttattcattactgtacccccaggacccaggtcagtgcctgtctcatagtaggtacctaactaactacttgaaagaatgaacatcactatgaggaaagtacaccatagtgaccattttacagatgaggaaatggaggcacagagaatgagatgttgtaatgtgcacagttggagagaccactttctggcactcggtatgtactcatttttctgataactgcaaattgctagaacaagcctaaacagctatgggggttacagagtatctggatgaaattaatgaaggaggttgctttgaaactgggccttcacaattgggtaagcttttgatgggcaaaaacagaagaaacactctgggtgacaagagtagaatgagcaatttttttttttttggcactagtaaaggcccggatatgaaggataaacagaaaaagagttgaataatacaaggctagaaatgtagcttggagtcaaaccagagctgtacttgactgtcaggtttaagaatagagacttcatttagttgttcatgggaaggcattcaaatatttttttaataattattttaaaattgtatttctttcaaatgcattcacatgataataaaattcaagaaaaacaaaaaaagttatttaaaaatcaagtctctctttcaccatgtctctctagccattttcttccccattccctgatggcaagtatttccatactctacattaattttttaagtaagaaaaatattacgttggtgcaaatgtgatcgcagtttttgccattgaaggtaatggtaaaaccacaattacttatgtaccaacctaaatatcattgtcagaatggtgttttaggatgaatgaaagcatggagaaagcgaagagaggataagctgccagaaacgaaaacaagagatgttctgtgttaaatgtaacaatatcagaaagtagactcaaggaagcctcagactctcaccctaggtgaggaggagatggataaaaatcagaaggaaccactggtttgttgcagcatagtttgatgtaatagcaaatcagtaaatcatggacggttgaacaaagactggaggaatgatgggaaaattatgaaaggtgtggcagtgaattctccttaaagcccctcttatcattcattctcattgttagcaagatccctaccatagctggggcaaaaacaatgtatttaactaaaaatgagctaaggcgtgtaaagcgtttaacagcatctgttataaggtgagcactgagtaaatggtaactgttacttatttgtattaaaaggtggggctgggcatggtggtgcaagcctgtaatctctcacagtgacctgggaggctgaagtgggaggatcacttgaacccaggagttcaagaccagcctgggcaacatagtgagaccctgtctcttaaaaaaaaataacacaaacaaaaaacatggtgtcagagcagaatacaatggggtgagtttgacagacccatctttaggggaagttccatatctagcttcccttttttatagtaaatacttgagctggtttgttgagggtaacccatacgattttaatcatttaccaggacttaaatctggaaagtatgacagttgggttcaagaatcaatgattccaccagcattttcaagggctgctatgtacactgtactgtatgttcatcgtgtggtggatggcaaagatgggacatgaaaaatttcttttctcaagaaccttgtgtcttgctgggagatgactgcagctgagacgaattagagacttttgaactgatagtctctgtgttatgaccaataagggcaatatgtatttttggaagtgagacagcagtgaggccaggagcaatctgggaggcatcagaaaagaggtgacacagaacatcattgtcctaggtcagactcagtatcagcagcttagcatctcatgtccatgaggagtattttttgaacaggtattttgcatgccatttgtgatataatcttaatgattcagagattcctgagatttcaaacagtatcacttatagtgtcaatctttcctttattttagtaagcaacaagtcatcattctcttaccatcttttttttttttttttttttgagacgtcctgctctgttgcccagtctggagtgcagtggcatgatctcagctcattgcaacccctgcctcccaggttcaagcaattctcctgcctcagcctcccgagtacccgggattacaggcatgcgccaacccacccggctaatttttgtattttttagaagagatggggtttcaccctgttggccaggctggtctccatcctcctatcttttaaccatttcacggttgtttgcaaagaactttcaaaatacagtgattagaatgattcgttttcttgtcttttccttactgtattgaaattgattttttatggttaggtgaatatagatgattaaatataaaagcattgaatgattttgtgttgtttagataaaaactgtgaattttgcatgagtaaagggctagtatcgctattgttcctacttgaaaatgatttcagtgcactgatatcaaactttttctagacttttccaaagtaatcggaaatgctccaaattttgaaactttttgagtactgacatgacgtcacaagtggaaaatttcacacctgacctcatgtgacaggtcacagtcaaaacttttgtgtttcacgcacaaaagtatttaaaatattgtataaaatttccttcagggtatgtgtataaggtatatacgaaatataaatgaatttcatgtttaggcttgggtcccatcccaagatatctcatgaggaatatgcaaatattccaaaatccacaaaaataaaaaatccaaaacacttctggtcccaagcattttggataaggaatacttaacttgttttccgatctaacctggccctaacattcaactttgtaatatataatgaagaaataaaacaacagagtaaggccgggtgcggtggctcaggcctgtaatcccagcacttcgggaggccgaggctggtggatcacgaggtcaggagatcgagaccatcctggctaacacggtgaaaccccgtctctagtaaaaacacaaaaaaattaaattagccgggcatggtggcgggcacctgtagtcccagctgctcgggaggttgaggcaggagaatggcgtgaaccccggaggcggagcttgcagtgagccgagatcgtgccactgcactccagcctgggtgacagagtgagacaccgtctcaaaaaacaaaaacaaaaacaaacaaacaaacaacagagtaaacttccagagtaaacaaatctatacctcagggatatttaaatatcagaaataaactcatacttttgacttaccatcttcataaggcaatgcatatgctgaacacagatgattcttatctgttcaccaaactaaggtctttaaggactttaactactaagaatatttacgttaattcaagttaatatttgttttaaaaaacagaatcttttaaatattcaggatatagatgtttcaccaattcaatctaccctttctggtcaaaagttaaataaattggatggaatctcaagtattcataactacatataagaacaaaaactatcaagaatgtatcaacaaaaggtttccgtggcctctttcagtacacataagacatgtatctttttttttttttttttttttttttttgagacagagtcttgctctgtcaccaggctggagtgcagtggcgccatctcggctcactgcaacttccgcttcccgggttcaagcgattctcctgcctcggcctccccagtagctgggactacaggcatgcaccaccacgcctggctaatttttgtatttttagtagagatgagtttcaccatgttgcccaggatggtcttgatctcctgatctcgtgatccgcccacctcggcctcccaaagtactgggattacaggcgtgagccaccgtgcccggccaagacatgtatctttatagagcaaggtttctcaacttcagcattattgacattttggcctgggcaattttttgttgtgctatctatcccacgaattatagagaatgcctagcagcatccacaacttctacccactagatgccagtagcacctcctcaccagttgggacaactgaaaatgtctccagaaattgccatgtcccctgggggacagacttgctcttggttgagaaccactagtgtacagtaaactttcaccctctacttcatatacacagatattgatgtttgagataagagagtcctattctatgtctataactggttgaggaaggagaagttaacagtcccgagttatatacagactattgtcagatctgcccaattcagtattcctctaattggcagtctttgctctggcattccttgttgtgctgacacagagtctagaagatctgcattgtgatctgatggcttcccttgttcaattctgcttccacccctatttcttcacaggtgttattctgcaataaatctgccctggcatctgcttcttggaggactcaacctgcaacaataatcaatcaatcaattccacgattccattcccctagcctaggtgggcatgtgacccaatttgggccataaagagtcaagcccatacttgaccagtctttaagctctcgggtcagagtagctctctcttttctgcagggtatgttgagggtgttaagaggatggcaggtgggcctgcagcaatagtctgaaagccaccactgtcaccaacacccttttgtttcttaactaatctgagttgagttttctgtcacttacagccaagagtccagcctaatatactttataataaaggggaaactacagaaacatttaagaaaattagcattgatcctaaaagttgttacaaattacctcatcacaataactattcagagcaacgtatttaagttgctcaagaaccacaaagcacattgcctttttaaatttaaagagacttcataaaaatgtgggacagagcagaatggtacccattattatagaatgattttaccaactgcggcattaattctccaaagatttcccccagtctcattatgaagaaataatagacatagaatactaggctgggtgcggtggctcacgcatgtaatcccagcactttgggaggccgaggcgggcagatcacgagattaggagatcgaggccatcctggctaacggtgaaaccccgtctgtactaaaaatacaaaaaattagccaggcgtggtggcgggcgcctgtaatcccagctactcaggaggctgaggcaggagaatcacttgaacccgggaggtggaggttgcagtgagccgagatcacaccactgcactccagcctgggcgacagagcgagaccccatctcaaaaaaaaaaaaaaaaaaagaatactagatattagatgccacaaggttatcaatatacactagtttcgaggctttttgaaaattttggtgcacccctatccagcatatcccgcccctctctatttcacattccctgttgctaatattaggaaaagagaacgtttacgtgagtatgctatttgatttgaaccaacctctcagggtcaataatatttcagtattttgtgtgcagcatttaagattataaagtatgcccatttcagcactccttttaaacagaaagatttagttgaaaactcaaagccacatttgtccactgaaagcttttaaaaagcttcatttgtgaaaagacacattgaccagagctgctggggatcattaatgaaagctggatcttcaaaggagattctgtgttacaaaaaggtacttggacattttggctaagctgcagaccacctgtgatttggccatttgatagagggttggttgttgacaggtcctaagagataccccctatgtctcttctttttaaaattgtattaaaagatttgtatcatgggctccctatttaaaatgaaagtctgggcagctgccccttttactccgtctagaagaaggtaccttacattttctaacatgagttttccatcaataattgtctgctatgacaccaaagtattccccacctcctggctggagagcatgttgtcttggtcatctcctctgttatgttggagacagagtgacacacgtaggtgaatggggtctaaaccaattaaatccttgtctgggtctaaaccgattaaaaaggaactcaaatctattttctctcagattgggagagtccacgaaaataaaaaagccaaacaacagaaatgctgcccagttgcacaggatgttgctattatctagcatttgcacatcaatttatgttttcaaactcattgacagtcactagttaccggcaggcactctgttaagaagtagagaactctaagctgagttttgaccatagattcccggaagtgatttacaagatcattttcaaatttgtatgaccaaaaggcattttaaatatgattttaaattgcaaagggacgaaatcatgggcttcttgtgtttctttggatgccaatcacattacttcgagagctggcataggtcgtggatgtctcaggctacgcaccactgataacacaaactatgcgggcactggagcagaaagatatgagcagaggaagagagataagtggtgcctctaagaccccagaaagtggttttgaacccttgtggatctcactggaaagggattaggagaataccacctggcagaagaccattctcttattaaggctgatccactctctctctctctcaaaaaaaaaaaaaaaaaaaaaaaaaacataaaaaaaaaaataaataaataaaaaagataaaagaaaaaaaagaaaaaaaacttaagtaggagggaaagtctagagttgacagagctgaaaggctctcaaaattttaagacttttttttttaagtgtcttaaaatattttagggactttaactttgtcttagtaaagatgataaaattaagttcactacacactcattctttttagaagcttttcacctcccttttaactgtgtgcatttaatttgtgtaataatcactgtatgtccccttcaatgtccttttgtatctttttttttagcattttagtctatttctgtctgtctgatttttttcttctattcaaagacattttctcctctattatagctttatttaatgtttcccttatgctacagcataagtgcctttttttctccatccatatctctaaattagggggtccctcttccttttctatgcagcagtctgtcttcagcatgatgtcttcacttttctctattgtagtctcttttgtgattggccaatagcaaaatgaaacttactagaatccaatcccaaaagcactttagaaggatggaatcttatcatttactccctgaatcactatcatcagtacagttggtgtagaacggtattccattctggggctcattggataagtatgagttcaacctggcagctataaaataaccgggggaaaatcttgttcctttcctcctttatagctcggaaatttgtgagtgaccttgcttctttatttctaattatgccctatggaaaaataacgccttttttttcatttatattgtatagtgcctaagatttttgggggcctttaatgaacagcagtacaatttcattttcattttacaggatatgcaatataattttgaaaaattaaactacatgctcgaggaaggattcaacatttccggagaacctagcattttccctcagaagactaaaattagatcctgttttaatgactgtccctgcaacactgacttctatgtaatgagaatgtttccatgttcctgctgacagaccacctactattctttgctgatgtggggctgataattctgacaatcaataataataattgtataaacattaacatgtattgagtgcgtgctttgtgccaggcactgcacaaagtgctttataatgattatttcatttgatctttgtaataaccccatgagttaagaatacaaatgctctggcatatcagaattgttcacatttgatggttgactcaatatcgacttttaaaaactgtctagaaacctcccacgacacttactgcactgatggttctccatactcctccaatgacacaaagcctatcctgctttgaattcttgtattattattattcatatagggagaattcaacaaataaacaggtattctattgacaccaagaagactgacactgccgctgctctgctccactttgaggtttgtagcaaatatgtctggtgcttgcatcacatcttgtcagcccacctgtgattccagtgtcagcagtagtggacggttctgtgcaagttctaactcgtgctgtatagccagcatcccttctcaaaagggatccctgagcctttcagctttctgttctaggttcccctgacccccatgacatgggagcttcctgggtgggcaagcatagccagccacaggggttagtgctttggcagcaattctctttttcccctcccaacttctgcacagtgtttattgagcttactcatatcatatagttcacagctttgatagaaaaacttcttgtttcctttttgtatttatacttagattttctacattgttttgaatctttccgacgttgtgtgaagttcagagcagcggaaaaggcaggggtgcactggagaggatgtgtcccactcagatccaatgcttgcccatatcagatgaaaaaggaatcaattctcaaccagtgggagcaggagcaggtatacacatgctctggctttccatatttcaggctgtagctacctatatccagatttgttttcttctgtacacttctcaacagttccagagaattgctcatctttctttgtcgcttcattcttcttgttctcttattcctgcttcttagaattacttgcacccaggtccccccgcccttttttttttgagacagagtcttgctctgtcgcccaggctggagtgcagtggtgcaatctcggctcagtgcagcctctgcctcccgggttcaagagattctcctgtctcagcctcccaagtagctgggattacaggtgtgtgccaccaagcccagctaatttttgtatttttagtagagacagggtttcaccatgttggccaggctggtctggaactcctgacctcaggtgatctgcccacctcaacctcccaaagtactggtattacaggcatgagccaccatgcccggcccgaggtcccttcttgattctgtgatgaggtaacccctcactacaaagccaggtcttaggataggtctcaccatcattaaacctggactcttggagaaggcaaatgtgaataccattaaaaaccagaatctgtgatgttgacagtggaaagtctacatcactcattatttaagaccctctttgtcatcaataaatgttcatggaaattcaggcactatcttaggtcccactgctgaggccgggatttaatccagaatctgataacaagatttgttggaacttctgccttagggcaggagaaaacaataagaaagactttaaaataaggagagtcacctaatcagatctgcattttaggaggattactataggcgcattgtggaaaagggattcggaagcaagaacaatatcagggagataaattagaggctatgtagcatttgagtcaaaagatattggagtcaagggaggtgtaaataagggaatgaattaagagatggcttggggatagagctgacagaatttggcaatgcatcatgttagatttaaagataaaagtagattcagaaataataccctaatttttgacttgggcaattgggtgaagcgtagcgttcataagaacagcacaattagggagggaaaaatgttgagggtggattgggacaaaaggaggataataatgagctgctggggacatgttaagtctgaggtgtctgtgggacattcaggttgtggtggacaagaaacatagaaggtggctgggtctgaagcccaggagagaaataagtctgaccttacttcaataatcaagccagccatttcaaataattatgctagagcaattgaacatccatatgcaaaaaataaacctcaacttaaacctcatactttatataaaaatcaaatggatcacagacttaaacataaaatgtaaaactataagacatataaaacaggagagccaaaatggtgaaaccccgtctctactaaaaatacaaaaaattagctgggtgtggtggtggaggcctgtagtcccagctactcgggaggctgaggcaggagaatggcgtgaacccgggaggcggaacttgcagtgagccaagatcgggccactgcactccaagctgggcgacagagcgaggctccgtctcaaaaaaaaaaaaaaaaaagaacaggagaaaatctttgggatccagggctaggcaaagtattcttagactcaacacaaaagcatgatccataaaaggaaaaagcgataaattcaacctcgccaaaattaaaattctttttcatcccctgttaagaagatgaaaagatgagagagaaaacatttgaaaaccctatacacaagaaaggactagtatctgatacagaaagaactctcaaaaccgaactataaaaaaacttttgaattagaaaatagacaaaagacatgaacagacatttcaatgaggaggatatacatatggcaaacaagtacaggaaaagttgttcaacagcatttgccacgagggaaacgtaaattaaaagcacaatgagatattcctacacacatatcagaatggctaaaaataaaaaataatgacaacaccaaatgttggtgaagatgcagagaaactggatcactcatacattgctggtggaatataaaatagtacagacgcttcggaaaagtttggcagttttaaaactaaacattcaactaccatatgacctaacaattgcactcttcagcatttatctcagggaaataaaaacttatgttcacacaaaaacctgtacattaatgttggtagctttattcacaatagtccaaaactacagataactcagatgtcttcaaggggtgagtgattaaataaactagggtatatccaaaccatagcatacaactcacgataaaaaggaaacaagtcttgctgcatataaaaagagaaatctctagggaattatgttgagtgagtcaagtccatcccaaaatattacatactgtatggttccattcatataacattattgaaataacaaaattaaagaaatggaaaacagactagtagttgctggaagtaggaggtagggggggcagggaagtgggtgtggctataaaaggccaataggagggatctttgtagtgatgaaaatgttctgtatactgacaatattgacgtcaaaatcctggttgtgacattgaactagagttttgcaggtgtaccattagaggaaactcggtaaaaaggtatgtggagtccgtgtataatttcttacaactccatgtgaatctacaattaaaaatgctgagatctagtagttctcagtaatgtatcaatgactgaattttcatcagattagttatattgaatattaattctaaggttctgtcactatcccttttcaagaatctagaagcttagatttctttttgaagcaatataccaatagttttcttattaaaaattcagaaggcttcaatggcgaataattttttggtaataagaaaaaaaactaagaattattttttattaaaaaacaacaaaatcagctcttaagacacttacagttcagatggggaaataagatctagatatgtgaaaatgagtagtgtccggtgaaaggctcgtttctgggtggttagttcaaaggttccctggaggacgctgagcttgagctggatctgcaatcacatctggattgagggaatccttccagcactcagcaaatagcaggaaaaactgtccagacacagcaggtatcaagatttggagactttcctcatcaggagggaagcatttgttttgtttgtttggacatacaaggagacagaaagaatattgataatggatgtatttgaacccgatcttggtgacaatgttgagccaaagttgtaaacatgatgattaagaactcaggtactgaagttggactgcctggtgtgactacctcgtttctcaactgagagccactgggcaaagcacttaactcgctaagtttctgcttttgtatctaaaaatgatactactcatcagaggtacctcagaaagtagttgttagaattaagggagataacgtatgtcaagtccttagcacagtgactggcagagtctcatctggcatatattagctctgagcttaatgggggtgctggtggtgataatgacgttgtctctccaaaggttgcaaacggcttaggggcagagactatcgcttatcttagactacctgatgtctgggacactcctggcacacagcaggagttttgcgaaattaaactggcaaaagtagtgttcttgcaagattaacttgacagcaattggctgaccagatggaggaaggagagattttaggcatagagtacaagtagaaagctgctgcaatgatacaacttcactcctcatgacaagggtcagaaaaaatggttggtgtcagcgggaatgataaggaataggtaagtaatgaaagatgaattgaaggacatagttcctgggctttgactccacattttaactatgaatagattctaagcttgactgtagtgtgcaaattaggcctctttcggagagaaggcccagtatagcagaaagaacatgagttttgaagttaaacactgttctgtcccatatgtcatttgtgtgaccttaaaaaatgtatttacaaaaggcctttgacaaaattcaacaacccttcatgctaaaaactctcaataaattaggtattgatgggacatatctcaaaataataagagctatctatgacaaacccacagccaatatcatactgaatgggcaaaaactggaagcattccctctgaaaactggcacaagacagggatgccctctcttaccactcctattcaacatagtgttggaagttctggccagggcaatcaggcaggagaaggaaataaagggtattcaattaggaaaagaggaagtcaaattgtccctgtttgcagatgacatgattgtatatctagaaaaccccatcgtctcaaccccaaatctccttaagctgataagcaacttcagcaaagtctcaggatacaaaagcaatgtgcaaaaatcacaagcattcttatacaccaataacagacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaagaaatggaagaacattccatgctcatgggtaggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactacaaggctacaggaagcaaaacagcatggtactggtaccaaaacagagacatagatcaatggaacagaacagagccctcagaaataatgccgcatatctacaaccatctgatctttgacaaacctgagaaaaacaagcaatggggaaaggattccctatttaataaatggtgctgggaaaactggctagccatatgtagaaagctgaaactggatcccttccttacaccttatacgaaaattaattcaagatggattaaagacttaaatgttagacctaaaaccacaaaaactctagaagaaaacctaggcattaccattcaggacataggcatgggcaaggacttcatgtctacaacaccaaaagcaatggcaacaaaagccaaaattgacaaatgggatctaattaaactaaagagcttctgcacagcaaaagaaactaccatcagagtgaacaggcaacctacaaaatgggagaaaaattttcgcaacctgctcatctgacaaagggctaatatccagaatctacaatgaactcaaacaaatgtacaagaaaaaaacaaacaaccccatcaaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtacgtttattgtggcactattcacaacagcaaagacttggaaccaacccaaatgtccaacaatgataggctggattaagaaaatgtggcacatacgcaccatggaatactatgcagccataaaaaatgatgagttcatgtcctttgtagggacatggatgaaattggaaatcatcattctcagtaaactatcacatggacaaaagaccaaacaccgcatgttctcactcataggtgggaattgaacaatgagaacacatggacacaggaaggggaacatcacactctggggactgttgtggggtggggggaggggggagggatagcattaggagatatacctaatgctaaatgacgagttaatgggtgcagcacaccagcatggcacatgtatacacatgtaactaacctgcacattgtgcacatgtaccctaaaacttaaagtataataaaataaataaataaataaataaaatgtatttactctttcagcatctgtagtagacaccgtggcgctccaccctggacctcctctttagggcctttgcatgcatgggccacctgctgccttattggctgctggctcacagctggggccttcattggaatgtgccctcagggaactgcctcacacagctacatcccctccctcagggagagacctagggccaatgactggctgatgcagggattaactcatttatgcctagtgttccattattgggacgctaagcttgtgggagttttttatatcctactgctcaaggtcatcgccaaggtctgacttttcacaaaacatttttgcaacctccagcataaatgggttaaagtcttcacccatttgatttactggggacaactctgaaaggccaaacctactccagagcttccctgcatgctcctgctgcagccataattgcaactgcatggtgaaccagcttttcctctgcgcagtcatgcccctttcagtttcttagaggtgtaaatcctgagagcacttcccagtatgacaataatccttctgcaagcaactctccaactgcttctgcttctgagcctagtcttggagagccttttattcctaatctgtgaaagggaaaaaaggtacacagttgttattgagagttgtgctgggaataaaacgagatcatgtgcttggcagaaaaccgtgttcaagcaatgacagctaataggtgatacttgaggacattatgctacgtgaaataagccagtccaaaaaggaacaaatactgtataattccgcttacatgatgttcctagaatagtcaaatgcatagagacggaaagtagaaagatggctgccaggggctgggggaaaggaggaaatgagaagtggtttaatgggtacagtttcagatttgcaaggtgaaaaagttctgcaagtccactacatgacaacatgaatatacttaacattactgaactatactctaaaaaatggttaaaatggtaaattttacattatgtgtttttaccacaatttgaaaagaaagaaatgatggctaccataccattgattccatttaattgattttacccacaagcaggtaccttttctggcttctcctgtattttctcatcctgttgggtgggacctatagtttcaaacatgattgaagctccctgcctcctctgacaccctggatattacgtctccgtaatctgattttttacaccaatgtttctaatctccacacatctctttagactttagattctctcatgagctgaaatcaccctggcataggctctgaggaactgcatggaagcaaacagcactattttccttccttcctctaacaaaacagatctctttaaaatcaccaccataacctttcgaaaagcacatcaaactgcatcatgatacaaaagaaattatactctgtcggtgccaggttgttgaaaataagggattgagatcaggagtctggggaagttgacagatataatgatgtgcttagatatcctgatggattttgacacagattctctgcttgggggtgagtgtaattactatttgtacagagagcagagtcaaggtcagaaaatacaggagagggacccatcaagctaaagtagaggactttaaagtggttggggagtttttgttattcagaagctcaaactggtcagcaggacaaaagaatatacagagtcagggtatgggcaggggccaatatccaatatccagaaattcctgtctagcaagaatggagaggaaatgtcagagcatgggttggaatttggaatgaagttatatgaggaaacagacaaggtacaaaacgtgaccaagaagttggaggtgccactgcaaaatttggaataaaaggggtagtgccaaggcaggtctgaggactgatcctaagccagtggttgtttcttctgtcctagttttaagcagctttcctagtgagggtggatgagggccaagagcactgggcttctccccagagtcacacaggattctgcaggttttaatgattacagcagagagagcttggtcccctggaaagcccttgcggttctaacccagcaaaatgcattgaatctgacaggccagcatttaccacctctgatgccagtgcatggggaaaaacaaattgccccatttgcaaacttagtacatatatgcagttaggagttgctctactcgttacacaaaaagattttataagtaaaaaatacttaaagtctggcactaagtttctactccctgtttgttttgattttgatacctgtactctattctaaagacttggtagtgagagtagagcgggaggtggcggggggaattgaatgcctcccaagtatttgaagggctgtctttgccaagagggtttacacttactgtgtatatttccaaagcatacatatagacagaaaggcagaggttatgggaagatcaacttcagctcaatgcaagagataacagcctaattattagggtgtttgtgaactgaacaggctgctttacaaagtgaggagttccccatcactaagttttaagcctaggccaaagtgttttctagcagaaatgtggaagaactcctgaaaggatttagactagatcttgaaggcccctttcaacctaagattttattactcaaacttgttaagatgtgattaacactagcttaaataagttaactatcgagagtcagcctaatgtaatggttaggattaccaggtctgcagccatattacctgggtttgaatcttggcttcttactagctgtgggctttgggcaaattactcaatctctctataccttagtcttcttatttgtaaactgggaattacaacagtacctatctacaagatcgttgttgtcaggcctctgagcccaagctaagccatcatatcccctgtgacctgcacgtatacatccagaaggcctgaagtaactgaaaaatcacaaaagaagtgaaaatggcctgttcctgccttaactgatgacattccaccacaaaagaagtgaaaatggccggtccttgccttaactgatgacattaccttgtgaaattcctttccctggctcatcctggctcaaaaagcttccccactgagcaccttgtgactcccactcctgcccgccagaaaaccaccccccatttgactgtaattttcctttacctacccaaatcttataaaacggccccacccctgtctccctttgctgactctttttggactcagcccgcctgcatccaggtgattaaaaagttttattgctcacacaaagcctgtttggtggtctcttcacacggacgcgcatgaaatttggtgccatcactcggatcaggggacctcccttgggagatctatcccctgtcctcctgctccttgctctgtgagaaagatccacctacgacctctggtcctcagactaaccagcccaaggaacatcacaccaattttaaatcaggtaagcggcctctttttactctctcctccaacctctcactatccctcaacctctttctcctttcaatcttggcgccccacttcaatctctcccttctcttaacttcagttcctttccttttctggtagagacaggagatgcgttttatccgtggacccaaaactccggcaccggtcacggactcggaagagtcttcccttggtatttaatcacgcggggatgcctgcctgattattcacccacatttcagaggtgtctgaccacacggggacgcctgccttggtccttcacctttagcggcaagtaccgcttttctcgggggcaagaaccccccaacccttctctccatgtctctaccccttctccgcttttctgggggacaagaaccccccaccccttctctccgtgtctctactcccttttctctgggcttgcctccttcactatgggcaaccttccaccctccattcctcctttttctcccttagcctgtgctctcaagaacttaaaacctcttcaactcacacctgacctaaaacctaaatgccttattttcttctgcgatgccacttgaccccagtacaaacttgacagtagttccaaatagccagaaaacggcactttcaatttttccatcctacaagctctaaataattcttgtcataaaataggcaaacggtctgaggtgcctgatgtccaggcattcttttacacatctgcccctccccagtctctgttcccaatgcaactccttccaaatcttccttctttccctcccacctgtcccctcagtcccaaccccaagcatcgctcagtctttctaatcttccttttctacagacccatctgacctctcccctcctcgccaggcccaattattcctcagcctctgctcctccaccctataatccttttatcacctccgctcctcacacccggtccggcttacagtttccttccatgactagccctcccccacctgcccagcaatttcctcttaaaaaggtggctggagctaaaggcatagtcaaggttaatgctcctttttctttatcccaaatcagatagcgtttaggctctttttcatcaaataaaaaaacaagcccagttcatggctcgtttggcaacaaccctgagatgctttacagccctagaccctaaaaggtcaaaaggccgtcttattctcaatatatattttattacccaatctgctcccgacattaaactccaaaaattaaattccagccctcaaaccccacaagacttaattaacctcgccttcaaggtgtacaataataaagtagaggcagccaagtagcaatgtatttctgagttgcaattccttccctccactgtgagacaaaccccagccatatctccagcacagaagaactccaaatgcctgaactgcagctgcgaggggttcctccagaatggcctcccccaggagcttgctacaagtgccagaaatctggccactgggccaaggaatgcccgcagcccgggattcctcctaagccatgtcccatctgtggaggaccccactgaaaatcggactgttcaactcacctggcagccactcccagagcccctggaactctggcccaaggctctctgactccttcccagatcttctcggtttagtggctgaagactgacgctgcccgattgcctcagaagccccctagaccatcacagatgccgatcttcaggtaactctcacagtggagggtaagtccgtccccttcttaatcaatacggaggctacccactccacattaccttcttttcaagggcctgtttcccttacctccataactgttgtaggtattgacggccaggcttctaaacctcttaaaactcccaaactctggtgccaacttagacgatactcttttaagcactcctttttagttatccccacctgcccagttccctattaggccgagacactttaactaaatgatctgcttccctgactattcctaggctagagccacacctcattgccgccttttcccccagttcaaagcctccttcacatctccccttgtatctccccaccttaacccacaagcataagacacctctactccctccttagcgaccaatcatgcaccccttaccatcccattaaaacctaatcacccttactccgctcaatgccaacatcccatcccacagcacgctttaaaaggattacagtctgttatcactcgcctgctacagcatggccttttaaagcctataaactccccttacaattcccccattttacctgtcctaaaagcagacaaggtttacaggttagttcaggatctgcaccttatcaaccaaattgttttgcctatcaaccctgtggtgccaaacccatatactctcctgtcctcaatacctccctccacaacccattattctgttctggatctcaaacatgctttcttcactattcctttgcacccttcaccccagcctctcttcactttcacttggactgaccctgacacccatcaggctcagcaaattacctgggctgtactgcctcaaggcttcacagacagcccccattacttcagtcaagcccaaatttcttcctcacctgttacctatctcggcataattctcataaaaacacacgtgctctccctgctgatcatgtctgactaatctcccaaaccccaatcccttctagaaaacaacaagttttttcctcctaggcatggttagatactttcgactttagatacctggttttgccatcctaacaaaaccattatataaactcacaaaaggaaacctagctgaccccatagatcctaaatcctttccccactcctctttccattccttgaagacagctttagagactgctcccacccgagctctccctgactcatcccaacccttttcattacacaccgctgaagtgcagggctgtgcagtcaggattcttacataaggactgggatcacgtcctgtagcctttttatccaaacaacttgaccttactgttttgcctagccctcatgtctgcgtgcggcagccgccaccaccctaatacttttagaggccctcaaaatcacaaactatgctcaactcactctctacagttctcataacttccaaaatctattttcttcctcacacctgacgcatatgctttctgctccccggctccttcagctgtactcactctttgttgagtctcccacaattaccattgttcctggcccagacttcaatccggcctcccacattattcctgataccacgcctgacccccatgactgtatctctgatccaccagacattcaaccccatttccccatatttccttctttcctgttcctcaccctgatcacacttggtttattgatggcagttccaccaggcctaatggccacacaccagcaaaggcaggctatgctatagtacaagccactagcctgcctcttagaacttctcatttcctttccatcgtggaaatctatcctcaaagaaataacttctcagtgttccatctgctattctactactcctcagggattattcaggccccctcccttccccacacatcaagttcgaggatttgcccccgcccaggactggcaaattggctttactaaacatgccccgagtcaagaaactaaaatacctcttggtctaggtagacactttcactggataggtagaggcctttcccacagggaaacataattcctcggtttggccttcccacctctatacggtcctataacagactggactttattagtcaaatcacccaagcagtttctcaggctcttagtattcagtgaactaatggtcttttaaaaacacacctcaccaagctcagccaccaacttaaaaaggactggacaatacttttaccacttgcccttctcagaattcaggcctgtcctcagaatgctacaaggtacagcccatttaagctcctgtatggacgctcctttttattaggccccagtctcattccagacaccagaccaacttagactgcaccccaaaaaacttgtcatccctcctatcttctgtctagtcatactcctattcaccagtctcaactagtcataaatgccctgctcttgtttacactgctggtttacactgtttctccaagccatcacagctgatatctcttggtgctatccccaaaccaccactcttaactcttaaagtaaataatctttgctggcaaggctatgctgaacctccttaggcactctctaattagacgtcctaggtcctcccaattcttcgtcctttaatacctgtttttctccttctcttattccgtttagtttttcaattcatacaaaaccgtatccaggccatcaccaataattctacatgacaaatgtttcttctaacaaccccacaatatcaccccttaccacaaaatcttccttcagcttaatccctcccactctaggttcccacgccacccctgatccacctcgaagcagccctgagaaacatcacccattatctctccacaccaccccgaaaattttcgccgccccaacacttcaacactattttgttttatttttcttattaatataagaagacaggaatgtcaggcctctgagcccaagctaagccatcatatcccctgtgacctacacatatacatccagatggcctgaagtaactgaaaaatcacaaaagaagtgaaatttaaatggcctgttcctgccttaactgatgacattccaccacaaaagaagtgaaaatggccggtccttgccttaactgatgacattaccttgtgaaattccttctcctggctcttcctggctcaaaagctcccccactgagcaccttgtgatccccactcctgcccaccagaggacaacccccctttgactgtaattttccttaacctacccaaatcttatagaacggccctacccctatctcccttcgctgactcttttcggactcagctcgcctgcgcccaggtgattacaaagctttattgctcacacaaagactgtttggtggtctcttcacacggacgcgagtgaaagttgtaacaattaggttggtgaatagatatgaagtacgtagataatgcttggtatgtagtagttagtattacttctgttgctgctgctactactactactattactactgatagggacaggaggcagggaaattctggacagaagagggcgggtctctggcaagggccccacccttaagcctaaaagcctggaactgtggcccaaagtgagaacttacatccctgttttcctgctcaaatgttgccttttccaaaaccacccatagcccaccctgccctccatcctgtgcctgtaaaaatcccaggctcagccggcacagaggagaagcagctggatgttggaaactatggttgtgcattggagagaagtggcttgacttccgagggacagcctggcagcatagcttcagagaggagtctgattgcggacagctggactcgaggtgaagattaccttcctgctctgtccccttttcagctccttttcctgctgagagccactttcatcagcaataaaatcccccgcatttaccatctccaattagtttgtgtgacctcattcctcctggaaaatgggcaagatctgaggtgccacaagtgcgagtacagaaggctgtcacactgaccctccactgagctgttaacacttaagccatctgcagatggcaaagataaaagggccctgtaacactccttctggggattcaagggtcgcgggcaccctcctagacactgccatggggcccacacagagttttgttcctgctggcgcccaaaagcactcaccctggctcctgtacccactcacctgtgcttcctctcccatgaggggtggaactcagtgagactgagccagtggagtctgcccctgccagcaccgaagcggctatgcagtccagttcccgcccgcgaggggatcagggtaatatcctgcttcactactactactactactactactactactactactactactactactactactttagcttcatagatatcaattcttgctttttggttgtgattttgtactctgatgaccagagaagagaacagggacctgtggaatataaattcatggtgaagtacatgttatgttatcaattcttgaaaaaccctgaaatgtagactcatttcccccatgcaggtttgttgtttttgaggaaagaaatgacagctgtgaaacaagtctaaattgtgccctaatgtctgagtgtccaacagtatgctgctgttgaagcaatagcaaagcagagacaaaacctattgtttcctctccctgtataactgaaaccatggccggttgcccttttctgtccatgatgtggaaagctctgctctcatgacctcaaaaatgggcatgtttcaccattcactcagagaagatcctattacagaaaaacaatacccagctgcaatttaactcagagctgagaaaccctctacccaatgattatgggcccacttttgtgatctacctgtgaggcaaaaagaacattctttcaacgatgtgcgtaggatgtctgtattaggaaaactgataaatggaaacgtggaggacttcaaataattctcatcaagtctgttcttaaaatggcaaacttccaaagtcccttgagaatacacaggtctcaatgagaagaaaaagcggctgataaaacattaggctttccaaaaattgcccatttctcctcaaaattcctacatgaaggttcacaaggtttaacgtacaggttgttggaagcacaaacaaatctacctcaggagagttaattcacctcaggaccaatttctcctctgctggtacatctactattcatttagcagccctgcttggataaagcccagagccatttcaacggcagtaggaagggacgtttagagagttatcatcagtcatttatgcctgcgctgttaacaactgaatcaataacatcagtgctatggagagcaccttcagagcctagttaggatgtctgcagttgtcagattagacaggcaagatgttttggaaacatatttgtttcaggaaatgtttaagtggtaagcatccacagggttctgtggccatcctgttcacaaacatggatatattaatagatttaatttggttgactaatgaagatatttattgttgctttaaaaaaaattcttataatttttgtaggtacacattaagcgtatatatttatagagcatatgagatgttttgatacaggcatgcaatgtgaaatcagcacattatgctttttatattaagagatgatgttcagagaaatgcaaatcaaaaccacaatgaggtaccatctcacaccagttagaatggctatcattcaaaagtcaggaaacaacagatgccagagaggatgtggagaaatagcacttttacactgttggtgggactgtaaactagttcaaccattgtggaagacagtgtggcaattcctcaaggatctagaactagaaataccatttgacccagccatcccattactgggtatatacccaaaggattataaatcatgctgctatgaagacacatgcacacgtatgtttattgcggcactgttcacaatagcaaagatttggaaccaacccaaatgtccatcaatgatagactggattaagaaaatgtggcacatatacaccatggaatactatgcagccataaaaaaggatgaattcatatcctttgtagggacatggatgaagctggaaaccatcattctcagcaaactatcacaaggacagaaaaccaaacattgcatgttctcactcataagtgggaattgaacaatgagaacacatggacacaggaaggagaacatcacacaccagggactgttttggggtgaggggagggaggagggatagcattaggagatatacctaatgtaaatgacgagttaatgggtgcagcacaccaacatggcacatgtatacatatgtaacaaacctgcacgttgtgcacatgtaccctagaacttaaactatagtaataataaaaaaaaaagaagagatgatgttgatgggggttggttttcctatgtctgtgtgaggctgaaaagctggtattttcagttttctgtttttcagaaaatgccttcccctttgggttctgtattatgtaatcatagcacttttaatgccttacctcatttaatttcttcatatgggagggaggtctaactctgctagtctttatgctccctggggacaggggtctaatccatctctgtgtttccagaatttaacacagtgcttggcacataatggatgctcaatattgtttactgaatcactgactgtatgatgaatgaatgaacacatgaagtaaaaacatgatttagagtcctgatctatctaatcacaaaggaactctttggtttcaatctatcaagtagttgtgactgtcataatggctttcagctgtctttagctctgcagtagtttttttaataggcttcattctagacacatatactcaggtgttcctgagctgcttccttaaggcatttcctcggtcagatctacttatggttgacatctcaccacaactaacatgaccaccttgggaatattgctcttttttgcgtaatgtttgggccaacaggttatgaagccaaacacagtgattaggactagtggacttgggggcttcctgggggagcattacaggtgacacaaaatccttggttgacattaagtacatttgtggatttgatgcttacaaatccagctgtgactcccttggcaagttcaagtcttagactctataggaagctaaaaatggtcattgttccatcaaatttggtatgatctgaaatctacagccatgctttctgtcattttttaaaaggcacattgacctcaaagagcacaatttgagaggaattcagatgaggtgaattctaacccagatatcacattaaatagctgtgtcatcttggccaagtcttaacctttttgaacttgtctagtaagggtgttagactagatgatctcatgatatgtaaattaattctttttttttttgtttgagacagagtctcgctctgtcacccaggctggagtacagtggtgcaatcttggctcactgcatcctctgcctcctgggttcatgtgactctcctgcctcagcctcccaagtagccgggactatgggcatgcaccactatgcctggctaagttttgtatttttagtagagacgcggttttgccatgttggccaggctggtcttgaactcctgacctcaggtgatccacccgccttggcctccaaaagtgctgggattacaggtgtgagccaccacacctggcctaattcttttaaatgttatataatcagcttagtcttgcctcaaggactttttatgtgttgccctgtttgggacacaattcctcatgaactttcgggtctccctccccacttctttcaggtctttcctcaaatgtcacctcctcagtggaaccttccctgatcaccttatataaaatgacaattccttccatgaacaactctctagcgtcttccttgctttatttatttcaacatgctgtcactatttaaaattgttatatgataattgtgtacttgtttatcatctttcttctttgtttttcggttttttttttttttgagatggaatcttgctcagtcacccaggctggagtgcagtggcacgatctcggctcactgcaatctccagctcccaggttcatgccattctcctgcctcagcctcccgagtagctgggactacaggtgcccaccaccaagcccggctaattttttttttgtatttttagtagagacggagtttcaccatgttagccaggacggtctcgatctcctgacctcgtgatccacccgccttggcctcccaaagtgctgagattacaggagtgagccaccacgcccggcctatcatctgtcttctttacaagaatgtaagctctcctgagggcaggggttttgtcttgtttgctgctttattatcaatacctaaaatggcgcctggcatataacagacccacaatagatattaattgaatgactaagtgaatatttaaactcctagctaaaaagtcttcagggtttcttaggtgtaatctggtttaacacaccaagttgagaatcacagaattattagataattaaagcgaaaaaagacattaagtttacctagctcaatacctcattttgaagacagaaaaagtgaaagtcaaaatggttaaatgaggccaggagcggtggctcatgcctgtaatcccagcactttaggaggccaaggtgggcggatcacctgaggtcaggagtttgagaccagcctgaccaacatggcaaaatcccgtctctactaaaaatacaaaaattagccaggcatggtggcaggcacttgtaatcccagctgcttgggaggctgaggcaggagaattgcttgaacccgtgaggtggaggttgcagtgagccaagatcacgccactgcactccagcctgggtgacagagtgagactccgtctcaaaaaacaaaacaaaacaaaaccaaaaaacatttgagaccattggaagagctgaatctcagcatcctattaggaaaagttaaacttacagaaaatttgcaaaagtagtatagaaagttcccatatacaatttgtccaacttccaacttcttttactaggaaattagtttgcctgcccaagaaatgtctgcaaggggttttatgactatttcattttgatcctctacatattgaaacttgagatgctccagctgacttattcattatcttgggggagtgtagattatttgtgcaacaggcatattcttattttaagccattttatccaacgtcatcaaatgatttaacaagagacttttaaacttctcagaatattcttccttataaataacaggaggtgccttagtttaggaatggcagacaaatgtaaagcacttgtaccattattttctcatttaataccaatggtagaaattactaatcagcctatggcactgtattgtagtcttccccaatttgctttatgctcttttacaataaaccactctaggcagctgatatcagtcaataagagcttgcttgtgagatgaacaatatttaccattccagatatagtgcagtaaggaataagataaagatgccgaaactcagattctattataatcacagattatccattgattagcttagtgagttttaaaaaatcatttctacacttctgtgccctacttcacacagttaggatgagggttaaatggaatagacacatctaaaggtgctttgtgaaatgtaaagaattatatacatgaaacctgatcttaggatattcaagaaaattgaccatagaaatgcatttctccaatatactttaagaatcctttgtttttctaccatctgtttagtttagtctgtatacatctaacttttattcccatgtccaacagaactgaagttagagtgtgagagattccttcttcagctaatggaataaatgatatagagctcagtggataaacatgtgcttgagtgccattctagagcaagccctcatgacagctgagccagagaaacatatttcagccacttccctatctcattgcttcatatctcagataatttagaagtatatgattttaaaaatcactgctttctgatcaagtatcaattaacatcctcagataatttgggagggtgtgggattcgtagccggattgtagcaaagttggaacttaaaatggaaaaaaaaaacaaaaagcccagaccgaaagccatccatcacttacacatttattcacatccttgaattctgagatgtcatattcttttgatttttgactgacttctcttctcctacctctgcttgacttctttttcttgaagtttatcaaggtttggtcctaggccatcttcccttccctctttacatgctaagtgatttccattctggatgctctaaattccattttgtatcaatatttttctcatttacgcttctagctcgggtctctcctttgagctataattgaatttgacttctgcacttggacatatcacacacatttcaaactgaacatgtctaaaactgaactgttgatcttttccaaatctgcttcctcctccatctttatcacctcagcaaacagtacaacaagttgatcaaacaaaaaaaacttgggagtcatcctcaatccctcatgcctgacatctaatccatcaccaagtcatacagattttgtctcgaaaatacatctcaaatctgttcatttctctctatttccattgccgccatcttactcccagtagtcattttctttcatcaagacaactgcaaatgcctcttacctggcctctttgcttctactcttgccacattcaatctctcatttatacagcaggtccatcagattgtatgatgttttgcaggtacatcagctcaggtgtactttcacaggtacgtcagattatattatttctctgcttacccataaaataaactctccagccttgtcctgtaccactcaccccctcagtcattagctcctagccatacttgcctccttttaggtcattgtcttgaaaatattattccattcccctccctgttcatatgactgacctaaccttcagattttagcttaaatatatccttttcagagaggccttcctagactatgaagaagttcccactattattcttccaaagtagcctattctttgtcttcataacatttctcactatttttctttttattttatttttatttttttgagacagagtcttgccctatcacccaggctggagcacagtgacgtgatctcggctcactgcaacctccgcctcttgggttccagcaattctccggcctcagcctcttaagtagctggaagtacagacagggtttcaccatgttggtcaggctggtcttgaactcctgacctcaagtgatccgcccgcctcggggtcccaaagtgctgggattacaggcatgagccactgcgcctggagcatttctcactatttttaataatatattaatgctaacatttttactggctatttgtctcactgtcttgcaaattccttggcacgtccaaaaatatttcttcctattttgtgccagacaatatgccgggtgtttggactatgaagatttataatgaaaggtccttgaactaaaaggctacacattggctgggtgcggtgactcacacctgtaatcccagcactttgggaggctgagatgggcggatcacgaggtctggagttcgagaccagcatgatcaacatggtgaaaccccatgtctcctaaaaatacaaaaattagctgggcgtggtggcacacacctgtaatcccagctactcaggaggctgaggcaggagaattgcttgaacctgggaggcggaggttgcagtgagccgagatcacgccactgcactccagcctgggggagagagtgaggctccatctcaaaaacaaaaaacaaaaagcaagcaaaaaaaacggccacacatttagtaggaaaaatcaagaaaaggtttataaatagagtggtagacactgttggttgcctcatcaacaaccattccactctcccttttttctctagtgattatctatttccacacacacaaaaaaaagtttaaaaagcactgatagtcaatttcttagtttcccttgcaggtagatgcagctacttgacctagttctggccaaagagatgttagggagacatgctgttgcttctgaaacatgacaagaactgccactcttcctttattttccattcacactgtcatgatgcaattcctggagtgtggcagccattttataaccatcgcgtgacaattccaaagaccaaagccaaaggctaaggatagcaaatgcaaagatggaaagacattggattctgaatgaaactgttgagctaataaaccaattttgggtatatctttctcttaaattcctattatgtgagaaaaataaacgatggttgcttacattttcattatatatccctttactagaagttaaagcctctataccgacacaaactgttcctgctgtgacaacaatatagccagcacaagtccccccaaaccacagatcccctgaccctggtgtcaagattgggtcttctaattctgcatctgggtactctaggaagctttgtggcttcccatttatatgactgaagcgcgaactgtgtctatatgtgtatgcacacatgcacactggagagaaaggacaaaagatcattccacaattgagacttgaaggctaaactgtaagatggctgtacgtaataaagctctaatcctctattaggctcctgaaatctaggttttatggtttagtaatgttttcattatttcaaagactcagaattctttctctctgaggcatcacaaaagcttccatagaaacagatagagaatgaatgtcacaccaagaataggaaataaagcaaagaaaaatttgcagtgaactagtcattaatgaaaggtataaagagtgcatgcaaaatgttaataaatcattaaaaggttaggaaagtttccagcaaggaagaggtctctgagccaaaaggttgaggataacaaggtacctcattcagccatattctgtcatcatctccacatatcattgttttgaaattttaatatggaaagcaggtcattcttttaaaaaactgaactgcatctaaaatcaattagatctcatgatctacatgttcacctcatcttagggcacagtatagtaaatgatcttaacttgtttaaaatattttttcttggctgggcatggtggctcatgcctgtcatcccagcactttgggaggccgaggcaggtggatcacaagatcaggagttcgagaccagcctggccaaatatggtgaaacccggtctccactaaaaatacaaaaattagccgggcatggtggcggacgcctgtagtcccagctactctggaggctgaggcaggggaattgcttaaacccaggagacagaggttgcagtgagccgagattgcgccactgcactctggcctgggcgacagagtgagactccatctcaaaaaaaaaaaaaaacaaaaaaaaaaaacaaacccaactttttcttaaaatcaaatattccataggatggtgtgatgagcattcacatatcaagagaatacatcatcatcgtcatcatcatatcaacaactagaaattattgaataccaactatacaccaggtgctccactttgcattttgcaagcattgtctcatctaatcctcagacaactctttgagcgagtgctattattactcctattgaacagataaataaatggaagcactacaaaagggagttgttagtaagtggtgaagttccaattcacaccccacacgttgactcccagactctgaaaattttcagactctaagcttaaaaatatagaaataagcaaatgaataaactagcgttcttatcagcccagaaaggagtcttcactttatgcatgttaaacactgttactgttagctaaattgctctttacaacaaggcttacaagatgatgatactatcaacattttgtatatgaggaaactgaagtcttaagataaatctagctagctatggcagagccagaacctgagctctgtttatttttattctaaagctatgtcaatatttgctaatacttggtattggtaatattacaatggctttctttttatgacacatgatatccatctcaaaaatattagattataacatttgtatgcaacttaagaaagatgaagttatttggaaaagggattgagatatgaagattgtgatataagaattgttaggtgactacagctctgatggaaaggtttatgcgcaccagaatctcagctgtagctctgttctctttggagaaacaacttgtaaaaatatgatccttgttagcaggatatctaatatccattcttgttccattgatagcatttgaaatttatttatcaaataatcacttcagtttttctaaactaccttaaaaatatttttaaaacctgaggataaagaggacacatttttaaactagtgcatttttctcttacaattaaatcgatattccagctgggtgcagtggctcgtgcctgtaatcccagcactttgggaggtcgaggtgggtggatcacctgaggtcaggagtttcggaacagcctggccaacatggtgaaactctgtctctactgaaaatacaaaaattagctgggtgtggtggcacgtgcctgtagtcccagctactcaggaggctgaggcaggagaattgcttgaacccgggagccagaggttgcagtgagctgagatcatgccattggactccagtctgggccacggagcgagactctgtctcaaaaaaaattttttaaagttgatattccatttatttttctccacttaaatacagattttttttatgatctcataaggatcacaatgaatagctaggccttagttttgcagctttagtttcattactatgagagagagagaagggtgagagagagagagagagagagagaccaagtgtggtgagaagacatatgttgtctttgtgggtccagtatttcatccttctactaactgcctggttgttgtttctgtttttgtttttcctttgaggaatcgctttccccatatttcttgtgactctagtagagctgccaatcatggtacctttttgccttcctcaattcccctaaagagttcaaagaccccataggttactcagactctgccactcaggaagctgacaaaggaagaaaataatacaaggttggaaagactttggagcttagtatttcaaagacaacacttaaaaagaagatgcatgtgttcctgcttttgagattttagaactcttatacttcatgtcctattctgagacctagttttcaaattacttcgttcatttctatgagtatcttttaaataaagagcccctaccccatcccctttgttttccctgacttgaattagccagagttagctgctggtgtttataactgaagaccggcagacactgccggttagctacttcaatacctgttgaaaaccacttctccctagccatctttttgttggtggctgtcatgtgacacagttctacacaatgatatacaagtagaagtctttcaaaaaaggtttctgggaaatttttggctttataaaaatgataagactcagatagtacaccctttttgccttctctttttcaccctgtgaaataatggtggctgctatattgcatgaggaaaagtcaataaaaaatatacagatgccagtcctgatactgttgggcccaaagcaccttatttccagacatcttaatattggagataaataaaactctatttatttaagccactgtagatagcttctgtgttttttgctgccattgcaattctaaccccagccaataaaatgggaatatgaaaaacaaacaaaaaatatgaatccttctaaacaatgaagaatttatggggttagggtttgggaggaacagaagatatagccagatgaatttaggcatatctctcaggaactgacctttgtcctttagctattactgttgattagtcttagatggcagtgaaccttgtagctgatgttaatgcaaaactggagaacattgcatcctggatataggtatattctgatactctgatacagggcccttagcttccaaagatgacaattttttttttttttttttgagacggagtctcgctctgtggcccaggctggagtgcagtggcgcgatctcggctcactgcaagctccgcctcccgggttcacgccattctcctgcctcagcctcctgagtagctgggactacaggcgcccgcaaccacgcccggctaattttttgtatttttagtagagacggggtttcaccgtgttagccaggatggtctccatctcctgacctcgtgatccgcccgcctcggcctcccaaagtgctgggattacaggcgtgagccaccgcgcccggcccaaagatgacaattatatgtgtgtacataaatatgtgtgcacttgtactgagtaaaatagagactgatctcacccatacgtcaattctacttagacaaaggaaatcccagggtttttttttttttttttttttttttgtctctccataatgtgctattaaaataaaatgctattttgtcagtgcctttttcttttgctttcaatcctggactgtaggcaagacatacagtctcctcagagattgagaaaggtcaataatagaaatgctgttttcctcctttcactaactgattaaataacgcatgggcatatgtatagctacacgtgtatttctaaggaaaatcattcaaaaactgcatgatttcctgaggtgacctccagggtgctgaaaatttagaaaacgtaacatctaatgcaatcaataaaatcaagaatctgtgttaggcattttgagagttttggagtgagtgacagtacagccaattgatatagtccccgtgaaaggcaggtaaggcatctttatgtggctctctattgatgagaaaagtcttcctaagagaataaactagatttagagtgtgtcttatgaaaactgttgtttcccccatgccttcccagttaactcatttgtataattttggggcttcagctttgatggggctcctttatttgcaacatttagattaagttaatgactgttttatcatagctaagagcactagaattaggaggtcaatggctattagcatttgattttcttgatgataccaaagagatgagtttgagggggaagaagtgtgggcttgattactcatgttttaatttcatctcagtagacaaatccaaaatgatgtctcagggatgactcagaattccagatgggatatgtgtacttttgccctttgtccagtcctttgcacactgggcatatccactgacaacacaactgtcagaggaacaagctttcaatttccagtttcaagagggaatgagatcaggcttgaatgatcatttatggtgactgaattgctttctccgacaaggaagcctcacttgttcgtggactttacggatggtgctctcaaaaattggccagttaatctctttatctgttgcatctttcctagattccattgtgtctttcgaaaatactgtaaaatttacaaatgtagcttaggcaaaatgcaaatgtgtttctgtcttaaaaagaggaaatagctatctgcaacgatatgggatggagagaaagcgaacaggaggaccgtttagaatcatgatgtaggaaacataatgcaaaattgtaaggctggtgtgggggtatggcaaggataactagtgagagatccccaacggagatgtgaaatttggagaaaagcataggaactgcacataatgcaaagtttccttctctcactttgagctcagtgaatctgggatttgttttatgaacaaagatagcaagttgctttatgatggcagtggttataacaaatgcatgaacaaagtaacgggtaaacacataaaaaagaacaattgaccttgcgtaagggagagcaaatgtaacttgacttatgtgctaagaataatgcaaagaaaaagaactgagcacttactatgtgcaacacatatagtatgtactgtgttatgtacatgaggattatacgcttcatctcatttaatcctcactacaaccctatgaaaaaagcactactgtattattttcattctactgatgaggaaactgaggcatagtacataacttgattgaggttggcaaagcagacagaatctgacagaattgcaatttaaatctagagcctctgaactaagccactaaaatggactggctcagagttgaataagaataggaatttccaggtttataagggctttccaggcatagaaagagtattttcaaaggcatgaagctgagaaagacatagcgagagggccagaggccgaagagtaaataaggttgcaagggggtagggtggggagcagggaggaaaaaattctttttgaaaaaatgtgttgtagatatgaagtctcactatgtttcccaggctggtcttgaactcctgggctcaagcaattctcctgtcttggcctctcaaagtgctaggattacaggcataagccactgtgcccagccaggaggaaggaattcagttaagaggctagatcagtgaattggagccacatcatatatattttttcttttttagagatgagatcttgctatgttgccaaggctggagggcagtggctattcacaggtacaaccacagtgcctacagcctcaaacttctgggttcaagagatcctcccacctcagcctcttcagtagttgggactataggtgtataccactgtgcctcactggagctgaaggaggatatttccctgatcccttcgtgggtgggaactggaggggagcaaactccactcactcgctggtccacccctcatggaagggggagcacaggtgagcaggtgcagcagctggggccagcatttttgagtgctggcaagagtgaacaccgtacgggccctgcagcagcctctaggggagggtgcccatgaggaagtgttacagcgcccttttagctttgccattcacagatggcttaagtgttaacagctcagtggagggtcagtgtgacagcctttttcacccacacgcatggcacccaagttcttgtccagcatccaggaggaatgaggtcacatgaacaaattgaagatggtaaatatgggggattttattgccaatgaaagtggctctcagtgggaaggggagctgaaaaggggatggagtgggaaggtaatcttcccctggagtctgaccatccacagctggactcctctccaaagctatgctgtcaaactgtccctctaaagtcaagccgcttctctttgatgtccaactgtagtttctgacatccatctgcttctcctccttctgccagctgagctctggggtttttataggcacaggttggggggtgggtggggggtaatggatggttttggaaaaggcacccttcaagagggaaaacagggatgtaagttctcactttgggccatggttccaggctttttggcttgagggtgggtcctcaatggggacctgccctcttctgcccagaatttccctgccttctgtcctttatcaaagccacatcttgacaggctatggatactgacctggagggagagaaagctgtagctatagaagatttttttaatataatggggtactaggattagatctgttgtttagcaagataactagccatagtgataaagatggataaaagtctggggacagggaggctaatcattagaaggccaaatcattaatagtcactgagaaaggactgagggaagggcagagtagttagagaggaatagctggatttgagtgtttttatttttagatataagagtcagcaaacagaatttagtgaccaaataaaaactgaagataatagagaggaagaagtaaatgtggccccaaattttctaaattgcaatgacatcattaataaagaaagtaaatgcaaggtgcaaaacaggtttgattgtgatatggtatgtaggaaacacaatcatttccattggttgggccatatctggaatattatcatcagttctggatagcttatattgaaagtgtgaaaggaaaataaatcttggggcctcaaaatcaccaaactaaagggaaaagtcaagctgggaactgcttagggcaaacctgtctcccattctattcaaagtcatccctctgctcactgagatagatgcttatctgattgcctcctttggaaaggcgaatcagatactcaaaagaatgcaaccatttatctctcacctacctgtgacctggaagcccctccttgcttcaagttgtcccacccttctggatggaacaaatgtacatcttacatatattggttgatgtctcatgtctccctaaatatatataaaaccaagctgtgccccaaacaccttgggcacatgtcgttagaacctcctgaggctgtttcatgggtgcatattctcaaccttggcaaaataaacttcctaaattaactgagaccagtctcagatatttgaagttcacaaaagggaccactgttaattcttgcagaggaagataaagacgaagatgaaagtcttgactgagggtaattatgaggaacaacagagggaacgaaaaaaatcaatataattgaatacttttacaaaagcagttatttagagtgtataccctgaactcaagttctgttacacagtgggatatataacagtgatgaaagagccaagcttttcttagcttttcgacttagcaggacaatgaaaacaatcaaaaacccaactagttcacatcagcttgaaacgaggatgcttagagaagatacgaaaattgacaacgagtattttacagatgtagagaagtgacgtttctctttggctccagtgggcaggaatagatcaatatatagagatttcaggaaagccaattttcatttattataaagactttgaaacaaccagaactgctccctgggaaaagggtgatttatcatcaatgactgtactcaaactgggtttgaatgaccaaactgacagggattttatagggtcgaatcctgccttaggaagaaaatgaatgattcttaaatccctttaaattctgagattgcatggcagaagcacgatgaagatcacactacctaaaaagagaggatctgatttcaggtcctagaagccttggttttattggcccttagtttccatatctatgatatgagtttagatgagttatttctaaggtttcctgttgctttaaaacattcaatgattttagagttgcttgatgtcgttagaaatattgaatgccagaatgtggaatatttatttaattggataagaaatagaaaaactttgttcaaaaattttaagaaacaatcactattaaagctgcacttagaggctatttatctgcaacaatgagtagacgtaaccatgtcagctaacatttattaaatcctatttcagctagtgagctaagcacctgatataaatgatctcatttaattctcataacaaccctgtaacataggtactattcacagtcagggaaaccaaaccttggagaggttaaaacatttgcccaaggttacacagtttctaagtggtagagaggattcataccctgacagctgtcaacaggaattaatgaaagttctctgtaaagggccagaaagtaaatatttctggctttgaggaacacataaatctccgttacatattcttctttgggtttcgtacaacttattaaaacaagtaaactgtttttagctcccctgctattaaaaaaaacccaggccccatgttgaatttgtactgagacctgtagtttgctgtcccctgctctgctctcttactacaacaccctactgcttccccaagactactatttactgaggacttcttatgggccagacactgcgctaaatgcttttcatgcaatatctctgtaatacaacgagcctctgggttggtttccattttatagatggaaaataggcttagagagtttcagcagcaactgaaacacaaatacaaggctagaaagtggcagagctgtgagctttgtgaatctggaaactgtgattttatccattgcagtagagaggctgagtagagtgaactgggactggggcagggagggactggaataagaaaactggtgtgtagagcatggcaacagcctagacaattatggtatggtttgaaaaacactgtagcttcataatcaactggatttgtcagtttattggatgtcaggcagggtggattaggggaaggtcactctaaggtctgagcttggcttacttagagaacagaaataaggaaatcaggtatagggctgctttgaggagataaacggatgggccgataaagcttatggtggcaagatcccttatagttttggctgcttcactaactagttgtgttatggcaggcaaaaaaattagcttctcttggcttcagtatcctaaagtacaaaacgagggtgttgaattagatggtcccttagtttacttctagtgataatgttccagttggtgaaaagcaaaggaaaattctaggaaactgccaaaagaaagagcctagaataggctttttgagggaacgatttctgaaaaagaattgaacagaagggtgctaaaaagtttattgtaattcttctgtcttactgctctcagcaaataaagatcaaacagggtatttgtgtttgcaaggtcaaagtaaactagtgtccattatcaaatggctgaatgactcttaactggctcagagaaagatcagaaaatgtataggagaaaactaatggaaagagtgattaacgtgatcgtttctggctccaaagaataaggaaacatgggaaatgaagaaatatgaagaagtatgaggcaagaaataaagataatataaatgaacaggtcactatgattatttgggttgcctatttagacaagaaaatagggcatcgataatctctcatgcctcctagtacaattggaaaagaaaactaatgctagtatcactaggaaaagacatagaagaattacttttagaatcatcaaaaaataagtttgaaagcttttgcaaaaagcacagaagtgaatgttttgaagcaaatgaaactaatgggaattataatgagacacatagcagttttataatcttgcctctcttgtaatgtgtcagagaacaagaaccctgctattttaacacgctttgtctatacggtgccaacactgaacttgacacgaagagaagaaagtcctttctgatgagagcatgtagtatctggatctgtttctagactatgtgattcattttaaagatttctaaggaaaggacacatctagatcatctatgacgttaaatccgctgttctgaaataatatcaataatacaaacaaattctaattttatgtatgtgaaaaaaactacttatataaactcatattcattcgagaaacaaatactccaagttggatatcaaggagtttcctttcagttatcctttgttcagtggatataaatgctgtgctccttaatactgggtacaaaaagaaaaataagtttattagaaatatacacatcaaatacacttctgaaaaaaatgagaagctattgaaatgaggtcaactaaacagaaatctatttgtagggtttaaaacaccatgaatgagatcatcttttgtgattccatctatccttgcatttctcaaattctattttgaaatcactgcctatgttcattgcctaaaatagcttttcctttgattcttagatgatcttatgaaaatgaaaatatatataaggctattttgcatagaaatgattagacatagataaatatttacaccaaacagtttagggagtggggactagttatttcagagattatacaatgaaaattttagactgatttaaacatattattttatatgccagtttaggatgatgaataagtaatgaatcactgaatttctccctcccttcctacccccagccttcttcacttctttcctcctttattccttcatttctttattgacatacatacgtagtgtgtacaccccccatcttctaaagtaaccccatgggaagaaacgctcaggtggttatattaaaaaaatcgagggtatgaaaatctcagggtcgtatgcccaaacaccaatgcgatataaaaattaaggtgcacatatatgatttttcaattttttcatttttatgtgtgaatgaatttggaagaaaaacctttcatacactccagactttctgtgttttgtagccacagccttcatttgcaactctgacatggcaagctgctgttttctagatttcatttgtgtgggcgcctgctgcacaccaatatatattttctctttacaaccatccaccatgtggatgcatttctttattagtcaatatatattctgtaggttacattctgcaaatttgaacatggacaaaatgcaatcaatataatccataacactgcacagatgtcttggagagattgcagaaatcattcaccaggaggctgaatgtcgaagaattataaaattgcatttagatggacaagtcagaaaacaggtttaaaaagtagtacatttttaaatttgtgatttcattatgaccatggaatgaggtaaaagcataactgtagtcagcaatttacacttaaatacagaaaatgcaaaagacactatgtacataggaggaaaggaggtatggatgtgagaagaaacaggagggagaagcctaatgaatgatcttcagatgaaaagaatcaatgaaaaatatccagctgtggttaaatgctttcaaattgccatttatgcaattgatgcatggaataggtatttgtcagtgcagagagtgcgaacagaacattattatgaaacagagcaggatccttggcaaaataccaatgaaatacagttttcaatagtaaggaaaatggagagtgtgaaataatgtcaattagagagaaatgcatgctgctgaagactctcggcactattcctggaagaataaccaccatgcttagaaatccggagagttctgggaaacaatggccacagaaacaagacttattgatttaaattaagatttcagttgtgcttaagaaacatgtaatgactacaattatatcatctgacaagaaaaataatatgtataggcaagagtgatatttaaaatgttgtacttaaccattcgtatcagatggatacagaacaatcaggcacaggcaatgaaaaattagaacagaattaaaaggtttaaaatggaaagacatggatgtattggaacatactggctgaatatcagtgcctgagggcaatggttgataaatctgtaagaaatttttcaatgcatatttctgagcacccttttgtccctttaatagaatgataatttccagcaaaatcaaaagtagtagaaataaacagttcaaaaatcccaacttttaaagaattaccttcatatgacatttgccaaacccctgacaaccatctataattgacaaaaaaaagcgagcataagttgactcaaattaataagaaagagctacaaaatatttagaaagtaggaaaaaatctaatatttaaaaaaattctgcctaaatcacctgtttagccgaagttcagaatagtgaacaatcagcaataatagatgtaaatcaatttccacttatggatgtaagtgccctttggaaatactttttgaaaagttaagagaccacagtggtaaaccatatactaaaagcaatctatgacaattttctaaggcctctgaaattctatacaggttctcaaaagtactattcagaagtgaaagttccaataatagatgctttcaacgatattaaagcaaaaacacaagaggggaacaatgacagatataaaggttttatacctagaaaagacttaatagctagacgttgtcacaaattactacactaacaaacagtgcatgaatttcagcttttcaacttaacaaaagatgggcaatatagtcaaaccatcatttacatgagctcttgaggcttgaacatattaataccaaattagaaactaagagcagattgtacccatacattcaatacagagttgctgaatatctaagtgcaatgtactgtgttagaagccataggaaatatcaatgttttttcaacatggatcctaattttaagatatgtatagtatacttggggataatgaaaatacgagtaggcagaaaagataactattgagtactgggcttaatatctgggtgataaaataatgtgtacaacaaacctccatgacatgtgtttacctatgtaacaaaccttcacatgtaccgtcaaacctaaaataaaagctaaaaaaagaaaatacaactagaaaagtaatattattaatatgagaattaattattttcatatggaggaatcagggaaggctccatgatacagcatggtcttgacattaagagtttgtggaattggtgttccaggtagagaaaataataataatgacaataataataataacagtaaagacagtgatagataacattattgtttctgatacccaataatctttgagttatgtcattttcattctccaaaagcctcacgaagttggtttttaattccattttacagatgaggaaactgaggcacaggaaggactcaaggttatatatctatcaatggagtggattgattagaattggatctgtccaattgcagagcccctgttcctataccgccttttcataaacagatcaaggtcagtttagttggcatgtagtttgtaaaagaaaggagtagcagttagactagaagggtgacttggagtctcctagctgcatttacaaaggcacatttaaggcaccctaatccaaggcatgttcatttccacaagctttaccacaattttttattaataccataaacaccaaaagaatatagtgccatcatcatagaaatccattacattaagtcatcaatgaaaagtatactcagaagttcttgaactctgctcatgaaattcagttatcttttgaatatcataggcatcatagaaaaatgcatgaagtttcaactacatcttacttgtgatactttatcttattttttattattattttatttcattttatttgagacagagtttcgttcttgttgcccaggctggagtgcaatggcacaatctcggctcactgcaacctctgcctcctgggttcaagcaattctcctgcctcagcctccgtagtagctgtgattacaggtgcctgtcaccacgtccagctaattttttgtatttttagtagagacagggtttcactatgttggccaggctggtctcgaattcctgacctcaggtgatccacccacctcggcctctcaaagtgctgggattacaggtgtgagccagcatgcttggccctttttttttttctttttttttttgagacagagtctggctctgttgcccaggctggagtgcagtggtgcaatcttggctcactgcgagcttcacctcccgggttcacgccattctcctgcctcagcctcccgagtagctgggactacaggcacccaccaccacgcctggctaattttttgtatttttttttttttaagtagagatggggtttcaccatgttagccaggatggtctcgaactcctgacctcgtgatccatccgcctcggcctctcaaagtgctgggattttaggcatgagccaccgcacccgatctatcttatttttaaaaattatcactcaacgtacagctcaaatcatccatagtataattttatttagctgaaggatggatttgtcattagttccataactcctgttctctctcttgactttattttttatacacacaacatttaaccagaagacagacccaataaaaatttattaaattatgaaacaggataaaactggacataatgagacaaacaaacaaacaaacgcaaagtggtctaaaatgtttcgatttaatgatgatagcgtaacctgcaatcattcatatatgagagaaggcatcatgaggatctcagctttgggataggttttccaggaagggaactagagcattagtccagccctgttgtttcagcaaggacccctgttagcaatgacaggcatttataagaagtgaggccacactcatcaggtgcagagcacagcaaagctgcatggctcactagagtactgaatctggcatcacgctcatgttatccacttagtaaccaatggggcagttttaaaaaccacaaatgtttgtagggatctgttttctctattaagcctctttctcctgcgaaacatatctcctgaagcatggagaaataacttatttttctttaaactttttttttttttaatttgagacagagtcttgctttgttgcccacattagagtgcagtggtgcaatctcagctcactgcaacctctgcctcccaggtttaagtgattctcatgcctcagtgtagctgggattacaggtacgcaccatcatatccagctaatttttgtatttttagtggaaacgaggtttcaccgtgttggccaggctggtctcgaagtcctgacttcaagtgatccgcctgcctcggcctcccaaagtgctgggattacaggcgtgagccactgcacccggcctctttgaacttttttttgttttgttttgttttgttttgtttttactggtttatcttactacttttattatacaatgcttttacaaaaaattttattattattatacttaaagttttagggtacatgtgcacaacgtgcaggtttgttacatatgtatacatgtgccatgctggtgtgctgcacccattaactcatcatttagcgttacgtatatctcctaatgctatccctccccactcccccaaccccaaaacattccccggtgtgtgatgttccccttcctttgtccatgtgttctcattgttcaattcccacctatgagtgagaacatggggtgtttggtttttggtccttgtgatagtttgctgagaatgatggtttccagcttcatccatgtccctacaaaggacatgaattcatcattttttatggctgcatagtattctctggtgtatatgtgctctttgaacatttgatcttggtatcttaatgttatcctttcccatccaaggaaaggtatctagcccattttctttgcgtttactccctccagatgttctaatgtctgctccaaaatgctgggtgaccccatcctagagctgctcacatggtatacaggatcatagcacttttgcttaagtgaattgacttatttcttgtaagtcatgcccagcagcattaatacttcctcctcaacacaaccacaagagctctggagggaacccctcctttactacaatgggggttttctctgctttccagtggggaaatgggggcttctcccatgatttactagcctctcaagactattgtggcaatttggtaagataatactttgaaaatgctcagtcaactctaaagtgcaatgcagatataaagtataagtaatagctactgaaatattttaaatatccttgggccctaatacaatcatgataaaatcagcagtcttctacataggaacaaataaaacagattctccccattaagtaaacaaaacttagggtaggcttgaaaaaggacaagttgtgaaattaaatttccagatttttaattcaatttaggtgttttctggtgccagatggtttgaagttcttaaaccatttttattttattttattcatttatttttttgagatagatagagtcttgctctatcgcccaggctggagggcagtgacacgatctctgctcactgcaacctctgccttccgggttccagagattgtcctgcctcagcctcccgagtagctgggattacaggcgcccgccaccatgcctgactaatttttgtattttttagtagagacagggttttgccatgttggccaggctggtcttgaacgtctgacctcgggtgatctgcccacctcagcctcccaaagtgccaggattatagacgtgagtcaccgtgtccggcccttaaaccatttttaaagcggcatgcatctttaacctttaatgtaaagaacatgatcatagaaaagtatttaaattttgaccttattcatgcaatgcaatgctttaaactgtagatgtcaactttgcactctatgaccacaaaatatgcacatatcacccttttattatagaactcggtaccactaggtatgatataaatggttactgagaaacagagtttgctgcatcgtgcttctagtgagaaatagttgcacagtatttaaggagttgttcattatgtaatgggaactttgtgcttagaacagctccacagggagaagcaatagagctagatgtaaaaatgttctccatttcacaatgtagaagtttaatttttgcagtatacttttccttatactatcataattttacatgttgggtaagaatttccatgaattctatgtacaatttggcctcctgtcatctttgttttgccctctccctttctcttatagttggaatgaaacagaggaaggagtagacagtatggcctttttctgattttgacctacattacattttgagagtttagagtaatggggaccatataataatattaatcaatcgataattatatatatatatttatatatttatgagatggaatctcactctgtcactcaggctggagtgaagtggtgcgatctcggctcactgcaacctccacctctcaggttcaagcgattcttccacatcagcctcccaagtagctgggactacaggcatgtaccgccatacctggctaatttttctgtgtgtgtgtttttttttttttttttttttttcagtagagacagggtgtcaccatgttgcccaggctggtctcgaactcctgacctcaagtgatccccctgcttcggcctcccaaagtgttgggattacaggcgtgagccactgcacccaaccccgataactttttctgtgtaagggcgtaggtactttaaatgcaaagtgagaaatgcagtattaccagggcagaaaaacatgctctgtgaacttatgtgaattcattattccttacttacaatgattgttcacatccctgtagtaaagaaacttctctacttacaacttcccataggtagcaataaaggtcccaggcacagcagaagcatggcaatgaagaataccaccaacagaggacatcagaacttactttaggccaccattaggttttcttagcctgtgttgtgttttgtgtgcatattttcataatgttttataaatattattattaacaccgctatgttcaaaagtacaaaagagtcaaaaaagtgttcctttaagaaaagacatgcgattactacggcaacaaaagagaacttattgtagaagggtgtacattgtatatattggtcacttttgtatgtcattttggacttaaaaggaaatgaatttccaaacagcccttgagaaccaattctctttgtagagaaaggaggttgtatgttgtctataaattataggatcatagactctttttgtttgttttttgagttagagtctcactgtcacccaggctggagtgcagtggcacgatctcggctcactgtaaccttggcctcctgggttcaagctattctcctgcctcagcctcccgagtagctgggactacagttgcctgccaccacacccagctaatttttgtacttttagtagagacagggtttcgtcatgttggccggactggcctcaaactcctgacctcaagtgatccccctgcctccagagatgatctggctgggcgtggtggctcatgcctgtaatcccaatcccagcacttagggaggtcgaggcgggcgagtcacctgaggtcaggagttcgagaccagcctggccaacacggtgaaaccccgtctctactaaaaatacaaaaattagccaggcatggtggcgggcgcctgcagtcccagctactcgggaggctgaggcagaagaatcacttgaacccgggaggtggaggttacagtgagccgagatcgcaccactacattccagcctgggtgacagagcgagactcttgtctcaaaaaaaaaaaaaaaaaaaaagagagagagagagttgataggatcttaaagtttatcttgtaaaattcccaggtaaaagagtaattctctgtaaaacatctttgtgcaagtactgttgattgtccccatatattttccattttttcttgtggcaatagaactcataattttcagttgggtatgtagatgcctgaaggaaagaatatatttcttagcctcacatagatgtaaatataatcatgggacaaagttctggtgaaggaactatcaggggatacatttcatgacagtttctgaaagattttctcacaacactgctggcacacgccctctctgtgcctccttccttcttccatgttgctgggggctggaactcagatgtgttggctggagctgaagcagacatattggaccatgtggtgacaacgagaattgaggccaccatggcaggacaaggtaaaggaggacttcggacttagtgaagcagaatagcggaaggaggcctgatctacctagttctgggcttgtacatgagagagacctacatttctctattgtttaagctattgttacagtttgtcctattagcagatgaatcagattaaaaaatgatggaaatttgtgaagcagcccatgccacttaataacaactctaacgtttacattttccttactcagagtaagctccactgtaacacttgcccatagttctcttctacaatcttacttaattaagtgtgctgtgtcctttacccaccctccccagatgcatgaagaagctgtcctgtattttcatgttatcttcttactgaacattctagattctttcaaatatttgtcatataaccatcgctatacctttcacaatcttggttgccctgctgtcaatgtattatgatttttcagtgttctcatcatacgtgatgctcataagtcaatatgactgcagatgtggtttaactagtgaagagattaatggaacatttgtgaatttcattaatgcaatctaatactgtattgcctcgtacagtaagccacaccagatcatactggagattaatacagtccttgtggttatttaaaatcccaatttgtttttcatataaagcgccacaaagtcagatgttcctcagcctatatttgtacaaaagactttaaaaatcttaaaggcaggacatcttgcttgttcttgttaaattttattttaatttttttattttggtacagtatcccagtctgttataatcttattttgagtcttgattttgatctttcagtgtgttgactcccattctcacctttgtgtcatttgaaaaattaataagtgcacaatgtatatgcttatctagaaaaatgacaaaaatctgggtcaaagtacaggcaaggaggcaccacttttagggggcactatttatggagggttgtgaaatgaagtagaactgaattcactctgtggttagcaccacaaaacacttctcaaattgacagtttaacacaacattcctccttgggcatggttattgaaacatcaccaaatttaccaaattatatttctctccatgtataattcatgtagtttaataagattgtgagcagccacgtaaaaggcactgctgaaattcagatacactgctgcagcataacaccactttaaaaaagccagttaagttggcaaagtaaaaaaaaaaaaaaagcctacaatattaaggtgaaaactttacaacatgactctagtgaatattaaagtctaaaataaaggaaaagaaacagttgctcaatgtttccaaatacggtttctcccagatttatagttttctttatttctttattttattattattttttgagatggagtttcactctgttgcccaggctggagtgcagtggtgcaatatctgctcactgcaaccttagccccctgggttccagcaattctcctgcctcagcctcccaagtagctgggattacaggcatgcaccaccacacccggctagttttttttgtattcagtagagacagggtttcgtcatgttggtcaggctggtcttgaactcctgacatcaaatgatctacccacctcggcctcccaaagtgctgggattacaggcatgagccactgcacccggcccccagatttatagtttttaagataaaagcgacaagccaaattaatgttttaaaaagctcgaaacatatggggggaaaaattaaacaaagtgccaagtagtgaacatacagctaaataataaaaagtagtcatactgatgctttgttattcaaaaatcatttttcctcaaagagtaagggtgaaaaattgtaaggactatcccactacatgttcaattaaatgactaaattaatgtagagacatttaattaaagttccactagtttttccaaatgctattaattacgccgctatctaaaattaaatctctccccaaacccttttacatttcttccgctcatctgatacagacataattaaaatgctgcaagtttacctaaacgcatccaaatattataaaagaaaatatgaaaaactggagtttcagtagctccttaagaagctggaattttaatgggatttctacaatccttggggaaaaccaatagatgtgtaagcaggcatgcacacacacacacaaactgtctcaagattcctctgaaaataaatttctctctttatatctaaggtgctgcagtgaataccacagacaactatagtttcaaaggttttctaccagcaaaagacaagaatttttgaagacactgggtaattaattgcaggcacaaggtgtactctagttataacacttctgtgctaccattttcgaaacaataagcattccttaatagcggctcagaaaggcactctttaagagaaacagtttggaattcaggcttccttgtattgtatccaaacttccaaatggaaaaaaaccagcctggacaatcccagcttcattctatatgcaagttattctccagtgagtaaacaaaggttgatcctaactcccaaacttattttattaatcatatacaagatgaaaacacattgatcaaacaaggtctactaacatgagacttctcttatttcctttctcttacttgattctgacagttgtccttttaattgctctgcacggatagtattcagccatctaaaatcaacaaattctctatttaccccagtcgtcttccagattgctgtaggttcattatgcaaatgttcctttaagaaatacagagttactccaggaatgaccactacctgccattactatggagtccagaggtagggtcaggtacaggctggggtcttttgaaagtgacttgtctcttttccaaaatttcatttgcttctaatcaagagtctggtaaattaggaggagtccttttctcactcatcatcgtagccaaagtctcatgagacaaggctgggtctcagtaggactgtgattcatgaaaagtcaattatggataaattttgtttaccaatatccttcctcattcctggttctgcttggcaaacagccatccctcctcccattctcttattacaagggtttgcaaacttcaccgcactttgtaatcctggggattttcaacaaatgctgatgcttggagcccacccccagagattgaattggtctgagatgcagcctgggcatgaggagctttataagctgcccaggggattctgatatgtggtctgcgctttaggcctgtcaaggtgggataacaacttgataataaaggtttatttcctgatcagttaaaggggttaccacatctcaaagaaatattttgcatactcaaaggacctgtaatggaatttaagttaaataatggtgttacaatatctgtaattaattttaaatatctcaacatagatagttggatattttatatgtgcagttagtgcaaccttcaactctagaggcttgaggcaaatggttattttaattaggaattcatattctaggacagcacagccttcatcttatgaaaaaggccaaaacccagagactgctactactatatatctctgtgaaccttggaggattttgtaatgcatgtaatagatatcgcaaatgtgtttttgctgagggaaatagtggattgcaatgaatatccctataggatctcattagtaaaatttaagacaatcaagatacatggattaactaaaatattttaatgacatcccctaacattgcataaacaggatataagaatccagcaaaacctgttgcttgggcttttaattttacgtctggtctccaatggccttgtatccaaccattggcttaggaagaattcttgtgacctgatgccaaatctaaaggtaagagaatactgtatttgcaatggtgtcaatttaagcctaaaatcctacacttcataaaaattgtagaacaggctgtaagctgacttctgcctgccttctaacaaatgttggttaacgacatgattgcacttgtggaggacttcagcatgaagcatgaagctgcggcttgaggtagccattcctcatccacctcaaacacatctgtggttctccattatttcccaaaaagaacctaatagttgcacgtgacctaaattcacttaggtcagttcacagcaggtggaatttgaggcagtgtgccaataaaatgagcggtaagtaaatatttggggtaagagggtcttctgcacaacgattaaatagttctaggtgattttctaatctcctcatttataagagtggtcccagcaagaacagagactgaaataaagtggtcgtttcaaagctttaaatactctgctttcagctactctgtccacttattcaaagacaaacttgaaaggaaacaggagcccatattatagcacaggcttttaaatttgtcaatatgaggaaccaggaaatgccctgttcttcttcggggctctttcatttagcttgcattccaggaatgttcatttgttccaagcaacattagaaattaatggggtaagtgctgggtgaatgtaggtaatcggtataaaggctgctttcttgagttaatgcctgagaaatcaccaagcctataatttcttttttcttttctttttttcttttttttcttttttttttgagacggagtctcgctctgtcgccaggctggagtgcagtggcgcgatctcggctcactgcaacctcctcctcccaggttcaagtgattctcctgcctcagcctcccgagtagctgggactacgggtgtgcaccaccacgcccagctaatttttgtatttttagtagagacgagtttcaccatgttggccaggatggcaccaagcctataatttctaaagtcctgtttcatttgaagtttgaatgcaaaagtactaatgactgcaggggagggatgttttctatatcttaagaaatacgtaaataatatgtggcatagcttctgatagtactgcaatataactatctataactaatatatacagcaaatatattatcacttcttttttttttttttggagacagtttcactattcttgtccaggctagagtgcaatggtgggatcttggctcactgcaacctctgcctcctgagttcaagtgattctcctgcctcagcctcctgagtagctaggattataggtacccaccaccatgcccggctaattttttgtatttttagtagagacggggttccaccatgttggccaggctggtctcgaactcctgacctcaggtgatccacccactgtggcctcccaaagtgctgggattacaggcgtgagccaccgtgcctggccctattattactctgcatgtttctgcagagatctgtagaaaattaaaaaaaaaaaaaaaagaatgctggcttataaatggagtagattttctggaaaatgaatgttttagtccgttggaatgctataacaaaatatcataaactgggtggcttatagacaaccaaagtttttttctcacaattctgaaggctaggaagtctgatatcaaggcgctggcagattcagtgtttggtgaaggcctgctttcttgttcatagatagcaccttcttgtgttctcatggcaaaaagggcaaagcagctctctgggtctcttttataagggttctaatctcattcatgtgggctctgccctcatgatctaatcacctcccaaggggcctacctcctaataccatcatatatggaattaggtttccacatatgaattttggggagacacaaatattcaagccacagcagtaaggcaatcacaaaatagggcagttagatttaagtgtaatatactagggaatgacaatgagagagatgtatcatcaatttctttgccttctcccctatcatcagggaaggtacctaactgctccaaggccacatgactccatgcgcaccaatagcaaaaactacatccaatgctttataggttaggaaagtacaggttcccacacttatatgtgctcacttccatttcttgctgcccctctctttatttacgaaaggatgagaacttgatccacaagtgatttcattgagatgtaactcttattttatccaaagagaagtgttggaacatgctttgattatcaggtgagggctctgtgcacattttcatgcaaatgtcttagattggtaactctcctccaatgaatgcaagaccttctgccttcggtgatgactaaggtggtaacagttatcaggtagttgcttggcactgacttatttactagacattctttttttttgttttttgtttttttccagagagtctcactctgtggcccaggccggagtgcagtggcatgatctcagctcacggcaacttccgcctcccgggttcaagcaattctcctgcctcagcctccccagtagatgggactacaggcaccaccaccacacctggctaatttttgtatttttagcagagacacggtttcaccgtggtggccaggctggtctcagactcctggcctcaagtgatccacctgccttggcctcccaaagtgctgggattacaggtgtgagccacattgcctggcctactagatactgttaaggcaggcatgtgctaaacaggtcacatgacctctactatccctggaattataatactagttagaacaatagttttcaaactttgaccatgacctacagtaagaaatacattcatcatagttacttagaatacattctccacacgtatacattcatgggtgtatgtgtgtgttgtttgtctaaaataccacttccccaggaaactttccaggcctactacaccaggtcaagtccctctgttatactctctcagcactctgcttttgtcctttctaagtactcattacaattggaatgaaataattgcataacaaagatgttgaacccatctctagatctgtattctagggctttctgagggcagggaccttcttcctctcttatagaacagcagtataggaaaaactgacctgaagcaataacattttgcacataagagctgcttaattagtacttgtgacctgagtaaatggataaagacctcagcaaggagatccctgggtccttttcttatttggaaatcttgaggtagagctggagtaggtcatccaacatgttcattggcatagcttacagaacaacagcatcaacatggtgccaggacagataggatgtatctggggagcaaggtgtgatacgagagcgggatgtattattaatagttctaccttttctcattattttttcagggcttgaacatgtttcttgttggtatccactcatatttattgcctctttcttcatctcatttatttattgtgtcattaccaacttaacccagttttatttatcttctttttgactgcctgttggcaaaaaaatatcaaaacttaagaaaaatgggtgttttctagaaagttgggtaaaaatacactattgttttgttgcttaatttctttatgctgccttgctctgtgaacaaagtagaaaataatacatttattttggaaaataagctcaataaagacaggagttaggaaccgtcccttgactaactactgagggaaagccctttctatagaatagaatttacatcctgtgagttggtcatgtttttagtaagatggattaaattgcatgtatatgtccagagtcaattaatgggaaacatagaaccagaatccaagtcaattttgtccattacttctttctcaagagtaaacaccctcagctggatgacaaataatgattgccaggcaaggtttatgttattacctctacaagtaggaagttgatgcaaagcaaaactctcacctgacatctgttttttttaatcacccttatagcaagttagttttaaagaagtgagaaagacatgcgtgaacaggcaattttgctcccagatcaaacttcttcttataaccagacgtggcttcatgttccagcaaagcaagatattcccaggccataaggtaacaaaggcctgggacactgtggtgtccacatttctcacttctatgaatgagtgcccacaggaatgtgttcataacatgtaacaaagtcaacttgtgagttgctgatacacatctctcttatgtcatacaactgctgccattagcgattcatggcagtgtccttgcccggcagtcatgcatatccaaatgaggcatactccctagctattacaagagtcctgtctggctgcaggcattgactgacttctcctttttatctcaacttaaaatcagtgccttgctcccatccagtgccacatgaaatccaaggaatcaaagtgtaatctccgctgccactcctcatgttcaaaacatggaccattatgcaatattaaagcatgaatcctggaactctgttaatgttgtgaaataggtgagtagttagcaagaattaccattctgacagtgcagtggaaaaacttcattcattgtaaaaagcagggagttgagtttctatatggggttgcctttcacgtcccctccccttgcagagataatgaaaaaatgcccagctatttttcagatgtgatgtttactttcttttccaagaggttctttggaggaatacacagaaatattttatagaaccacaaaataatagaggtaaaataagctttggaataaaataagcaaataagactagtttctagtctacgatttctgggaaaatgcgagaactttagttaaacttgtttattttattctaggtgaattttattaacttaaaggatcataaaataataatgatcatctctacttttaaaatccacatttctatcaattattatatgcatattccagtgtgtacagataaaaagatattcaagtacaactaaacctagagatttcatcagaaaataatccccaaaatgagctgctattgcaaaatggaaaatatgatgtaaacaggcattttgggctttcagataaacagcataaatttttgaacaggatacgtcttgttttccacaaagagaaaaacaaggtgtagtgaagagcgttgaattgtgtctgatttctgatcttgcttttaacaaatgagaacgtctcagctaagtcaaccagaaactatttcctaatctataaattaaagggtttggcctagataatttctagtcttttctggcttcaacccctccctgcttactctctctctctctctctctctctctttctatatatatatatacacacacacacacatatatatatatatatatacacacacacatatatatatatatatacacatatatatatacacatatatatatgtatatatacacacacatatatatatatataaacacacacacatatatatatatatatttttttttttctttttctttttgagacagagtcttactctgtcacccaggctccgggttcaagcaattctcccacctcagcctcccgagtagctgggactatgggtgcatgccaccacacccggctaaatgttttttgtatttttagtagagacggggtttcaccatgttggccaagctggtctcgaactcctggcctcaggtgatctgcctgccttggcctctcaaagtgctgggattataggcatgggccaccgcacctggccagattgcaggtatctttaacaggttggagtgttacctgaattttcatcaatcttgggaaacatatagctgctaacagttttaacttcctactctatgtttaactcgtttaacatattaaaacacgcagacaatattaaactgcagcaacacatggagaagaaaagcatcgtggaaatggggtaagatgggactctagaagtgtttaaaacctcccatgctgaaattttaagtaaatgttgacgggcaatggttaaattgtaaaataaatgaatttgttgtcactgaaatttagaatactcctacctcttcttatgttttgcccttttaagatacaaattaaaatttttaaaaaatagaagagctcagaaataaagtgatggggataatatgcatacctatactaccacacttttcctttcaccagttactttggaaagtatcctatggagttttgattttagtagaattcatgtgaggcaaaagatggcttattatttctattgtgtaaaatctccaaaccactgggcagttataagactttttttttttttaagctcaaacacaggtcaaggctataggtgggagttcttgaacaataaacaaagtgagaaatggtcttaattttttgttattgctgctttgaatgacacacagacacatgtactaacacaggcaagactcttgctgcacggatatatgtatttttgtagaaaagatcaaactaaaatgaattcactgcctggcatcatgttttcatctgccttccattttccacaagggtgtactccacttgcttagacttaggcaatttaaaaattcttgatcttaatgtcctctaaaatgtacagactttatagcttagattttaagagacaccattacctgacagggtaatgacagttttatttgcactggtgactggatttgctgtgatacttaagcaataatacaaataaaatgataatttttttgagaggatgtcagggaaggagaaagaaaagaacaaaatgcatcgcatttaacttggtttaaaaacacaacacactgcagcttcccaaagcttcttattttactggaaaaaaaaatcccttagcaattcatcttcctttgggcgcatgaatgacattttactgtgatgtgattataagaaacaaaatccctcggagatgctgccttaaaatatttttctttataatgttctgagctcgacaaaccttggtagaaaacagaatactcttaattatgaataaattaactaaattagtaacatgagatggatatgcaattaagggattgttaattgaaactggaaacacagctgtatacagcttagagatgaatcataccagtaatgacgcagatgtttataaaatgtgattatctttagtggagacagcgctgcatctcccaagcccattcttatattgtgtcactgaaatggtttttaaacccgtgaacaccaggaatcaggatctcagggacggcaaattaggctccctggatatgggaattagtgttgtctgaatgtcagcaatttgattctccagctttcaaagaatgtagatatggagccaacaacaaacatctgttagttgcatggtcttcaaaaaaacaaaaacaaccaaaagttgctggcaaaccagtccctgcttcaatcagagaagacggtaaagtatctgtaaacagtcacactgctgtgtgtgactgttagaaacatatagaaaagagaaccccagggcacagtgccagagaccttatgcacaaatggtaaatgccccctctgctggcagaggctctaaaacattttctgctcttttcccggcagtgaacccagaagaaaaaacaaaatcttcacaactaaggaagcagtaggaaaatgccgtcattacactcactgtatgttgaaatgtactaaaattatcaatattctgttgcactttggaaacttccgttttttgcttatccacaccattttcccccatgtgcaattcccatttgccccagggaagggaaatgtctctatggttctagattttaatcgagttacatgatctctgcatagactgtgattggacaaggttgaggggagactggatactgtgtcctaaccatagtttaatgattatggaatgaagggctcagctacatagactagtctttggaaatcaggtttttggtttctggacaaagcttgtggcattattcaaaccaacaactattaggctggatggtgcttacaaagatggaagatggtagacatcagttttttacgtaaagtgcaaactaaccactgtaaggtgtagtcaaaaaagaaataatacataattttagatattgaccaacagaagatatatttgtcaccttagcttagcttctctttcaaaattatcaatgtccttaacaaaatctagtgctgtaaaggaaaataaaacaacagatagtctgacattagttaatactttcctctatcaaaaggatgcagaaaacttagggcatcctccttgaattcaggggagaccttttactacaacgtttaacgaagtatttggatgacttgaggctcaaataaacaactcagttttccactgtgttgactgtgggcatatggggtgtagctgagttgtgagtctgttaaaagaaaatacactttcaggaatgaataaggagaaaaacgcaaacacataaaaagacacaccactatatatagttttctctctatgttggatacctataaatgtgggatttgttgaattttgatcacaaagtctttctatcctatgtgttagtctgcacaagtacaggctttgcctataatttcagtattgatttgctgttatacaggttccaacttgtctaaatttcattacctgaagggacagcttgcaattccatatacaggtataataaaagcaagatgagtacatgcatactgtgagctctgaaaaggcactttttctacaatggctgtgccaaattcttcatgagactgttattctgttgcaaatggtgataagaaagccaatatcatacattatttactagcatttgtactaatattttcaattctgaacctcattataatcacacttgtttcagaacccatttgtggacatacccagctatttgcctaactaacagctatttacttcttgttccttggtaaagaagctcaattatgttcagatattgggcaacaaaggacacagctctgaggaaaaaattaaaatctggtctaagccaatcacagtaagcttgtttctcatagccagtgattggcttaaagaggttcagtgagatccagttctagttgacacataagaagaaatttgttggggagcttctgggaaacgtttgcttttccaaacacagacacacaggcatgagtacacacacacacacacgcacacaatacagttatccttgaaccttattccttcttgccttggttattgttgtctgcggatatgttgcttggcgcagtgggaagccatcttgggaccatgaggaaaaagacaagagaatcccagagaagctgacctcaagtcttgatatagctaatctgttgaattaaccagctctaggtctgatggtctttggacttcagtttattttgattagtggttctcaaagtgcagttcctgaccacaggagtagcagcataacttggcaacctactagaaatgtagaatctcggactccacgctggacctactgcatcagaaacgctgggagcagcctgccagcctgtagtttaacaagcccccaggggattctgatgcatactaaagtttgggaactgtgctagattatcaaatgtctctattatttctaatgtgtctattattaacgatagggttttcacttcttgcctgattccactggagttcgtgttaaaaaaaaatatattcccaagtctattgcatcagaatctccagtgaaggggcttgtgaattaataatttaatcaagtgcccctggtgattcttatgaccagaaaaccttgggaaagacaaacttaagaactttaaagtcaggtatctgttactggcctctgaaagtattctaactgacattccatctgcaatctcctgtttcaactggccgcagctccaggaccactcaggtaagcagatactagctcttgccttggcaaatatattatgaagtcttagcttggagagcctttgacttaaagtgaggtttacatttctaagatgttggtttcttgacttaactgtctatttgaattcctgatcttttccattcagagcctgtttacccgaactccccacttcagctacagtctgaattcctaacctcgtgtacattcttgatcagtgttatctggtggcctcaccaaccctgccagaatttcagagcccctctcaagtaattacaggggtaatcatgcattccttaactcttaggctgcattcttagggggcagattcctacctactaaccttgaacctgctgatgcccatgaggctggcatgaaagcaggaacaattagtctgttaaaaactaaacatatattcctgaagtctgaaaaaaggttctactcatccaaatagaaataattgagaactctaaaatatttaactttaaatggtctggaatcatcaatgttctttcaggttgaatgaatattttacattaaaaactttctgtcccttgtttacttggccaaataaggtaaaaaggtcaaaacaatcttagtgaaattgtttccttatgaatgacaaatgtaaagagtcaaaagaggaattaaggtaaataatttaattatatttcatctcccctaattacatgtttttcatttgcttagatattacttatttcacctctgctgccttccccaccatatacccgataactcagtcattccagacttataaactacctcaggttatatcagatcttcccagacctggttttcttcctagaaaaccattccatttttttctttacctcttggaaccctactcattgctcgagtctaagctcaaatgtcaccccttgtgcaaaatttattgctaactcttctgcacattaatatcatttctggggggctcacatctctagtggagcccttgtaatactgtatgtagttcatgtattaatcatctttgaagggagcctgtgtcatgtacatctttgtccctcctattgggtagagggtctcgagactaatgtagtcactgataaaatactgaactgaacttcatgcaaaagtgatttctgagaaaaggcattaaccaaatagtgccttaattttattacttgttttgcaggttttatgtacttaattgcaagtaggaggctaatgaaaaatgtttagtttttgcagtgtggtggtggtgaggggcatcccagcttgagtggtagaggtcccagcttaacacagaaatttagataaatgtggcaaattggtgggatgggcaatgtatctcatctgcactgagagaaaagctcaaggtgtaaccatttctggggctacatgtctagtcatctctaagagattggtggctccccagacatccattgcagggacactaaggaggtctcttaggagaaggcgtaatgaaagaacatattataaaccaggtgctttgctcagtagaaaagcctcggtcaacaagagaaagagaaagagtggttttgagaatactgtggtgtctgctacttagatttatcttctggttcagtcatatctgagtcccatgcatctaagtcagaattatttgcaagaccatgtgccagatgagatgctttctgctgcaggttgtagaaaactgatatgggttggatgtttgttcccttcaaatctcatgctgaaatgtaatccccagtgttggatgtggggcccggtgggggagactggatcatggggctggatccctcacgaatggctcagtgccattcttgcagtaataagtgagttctcactcagagtgagttcatgtgggatctgactgtttaaaagagtgtggcacctcccaccccctcactccatctctcaccatgtgacacgctggttctcctttcaccttccaccatgattgtaagcttgctgaagccctcaccagaagcagaggctgtcaccacacttcctgtacagcctgcagaaccatgagccaatgaaatctcttttccttataaattacccagcctcaggtattcctttatagtgatgcaaatggaattaacataaaaacccaacacaaaatgtcttgactagtcaaggcccacagaggcaaagctgctccaggactgggtaatccagaagcacaatgacattattccaggttcctcccatccttccattctgccattcttggtgaactgtccacatactcacaacgtagctactgaaattctgatctattcactcgttcattcaacaaatatttaccacgctaagatctattcttaggtaatttggatacattagctaacaaaacagacaatatccctggcctcatggagctcaccttctcatagtgaaagacaatttaaaaaagtatattaggccgggagtggtggctcatgcctgtaatcccagcacttgggaggccaaggcgggcagatcacgaggtcaggagttcgagaccagcctggccagcatggtgaaaccccgtctctactaaaaataaaaaaaaactagctgggcgtggtggtggatgcctgtagtcccagctactcgggaggctgaggcaggagaattacttgaacccagcaggcggaggttgcagtgagctgagatcatgccactgcactccagcctgggcgacagattgagactccatctcaaaaaaaaaaaaaaagtatattacacatgttaatcctgcagaatgagtgtatgataggaaaaaccagaaaaaacaggacagatgttccttttgctatatatcaccctagaacttactggctaaaaataaccatttatcagtattgctcatggttctgtgagttgactgtgctcaggtgggtgtttcttgcttgggttctttcatgtgtttgcagtcagatagtagccaaagctgaattgatctgaaggctccattggaatggctgttacagttttttcacttgtacatctggctcctcacttgggatggctgcggatcttcggccaacagctgggggctagccacgtatttgtctttccatgcagcttccccatgtggctagcttagatttgtggcttcttcatgtagacagcacagtggccttagagtagacttagtacagggcagatcactttccccagagtgagcattccagaagaccaagacagaagctacaagactccttcttatttagctttgaacttcttgcagaatcaattctacctccttcagtttgttgtacaggagcagcccagatttggtgtgttcctctacacaaggaacaattgcctggagacatgattcacagggaggagggagtgccttcctagaagagctatcataaaaaggtaagtgggaaatggattcagatggctgggaagagggagatggggcagttgctgtctaattagtgtggtcaaattttaagaaggttttttttttttttaagttgagatttgaataagacttgaaggaaatgacagagttagtcacaaagatttctggagaaagaatgttccaggtagaataaagaactacgcatagtgcccggagaaggatgcctgtttagttctctagacgagaaaaacctttctcagaaggtcccttagctgaatgccctttgtattttattacctaaaattgcgtaatatgaccatgtccaattccgaagagggcaatcaagactgcgagagcaccatgaaatagctcaggactatcattatgtattcccttgggttggggcttcccttgatgcacatgatatgcagaggagggtagatcctcaacaagcctggtggctgccagcaaaggagaagggtgtatatggacacatttggggaaaagaaaacaagagtatctttcttccccacaccctggggattaaacaatactccttttgggcctgtctaacaggacaactcatcccattttcccagccctagatcctgactatcagcagagaattcttgtgcttggtgtaagagcagaaaaggctggaaaggcagcgataatgaccaggatcagcatctaactcacccagtggcaaaggggccaccacccacagaaggtttaaaagtgtacactcaacagataagcagtaggtagcattcataatgggaaaatatgactctgaaagaaaatttttatgtggcactgagatactttgagatgcatgatcaatgaaggacctaattcaaagagggtaacattaaaattcccaagtacagcacagccacaaaagctgtagccacatgggcaactttactgcccctacagtttaagtgtctgatgggaatgccagacctaagaattggaattgggggtcctgacttgtttgaagcaagttaaggtcttttttttttttttttttttttttttttgagagggagtctcactctgtcaccagtctggagtgcagtggcatgatctcagctcactgcaagctccgcctcccaggttcatgccattctccagcctcagcctcccaagtagctgggactacaggcgcctgccaccatgcccggctaatgttttgtatttcagtagagacaggatttcaccatttggtcaggatggtcttgatctcctgatctcgtaattcacccgcctcggcctcccaaagtggtgggattacaggcgtgagccaccgcgcctggacaagtcaaggtctttttatatttcctcagtgtcacttacaataatccacctacacttgattttctctgttacaaaaagatagtatattaaaaggtagttcagtcgatatttatggatggaaacagaggtgaatatttagaaagactaaatcaaactgagataataaagaaatataagctataattcagaggaatggaatgccaaaagtaaggggagtggaatctgaagttcatgactatgctctcatatttttttcctgccagctgttggtagaaattattattatgatgatgatgattatgattattattattttgagacggagtttcgctcttgttgccccggctggagtgcaatggcgtgatcttggctcacagcaacctccgcctcctgggttcaagccattctcctgcctcagcctcccgagtagctgagattacaggcatgtgccaccacgcccagctaattttgtatttttagtagagatggggtttctccatgttggtcaggctggtctcgaactccggacctcaggtgatccacccgcctcggcctcccaaagtgctgggattacaggcgtgagccactgcgcctggccagaaattattatatgaaactagaagcctgttcaattttaacaaaaggatgcagatatgatgcaactgttgaacataagacaaattaaaatattttctttcttttcttttctttctctctctctctttctttcttttttagatggagtctccctctctacccaggctggagtgcagtggcatgatctcagctcactgcaacctccacctcccgggttcaagtgattctcctgcctcagcctcctgagtagttgggattacaggcatgcgtcaccatgcctggctaatttttgtatttttgattgagacggggttttaccatgttggtcaggctggtctcgaacgcctgacctcatgatctgctcacctcggcctcccagagtgctgggaccacaggtgtgagccaccgcacctggcccaaattaaaatattttcattgcaaatacaaaataccaagaggttctatatataatctttgaaagtaccctttctatttaaagatcaggattttttttcacatgtctagaaagaaatttggttcaattctattcactatgtatttattgggaacccattagatgtgtaatataatcaaatatcaatagattatagaaaagaagagagtcctttttcttacaacccagcagggcggaaaggattaaattcttcttataaagggagaacaaatagattagaaaagacgctgcgtagtcaagttcagaaaagtgagaaagtttagaaaggtttcatagagatgaactgcagttctaataataaaacttaacatttttataacatttgatagtttcggaagcagtttcacagaccttatctcattgcttcacatggaccttgtaagacaggtgggatttggataagtagttcctttaaaaaatgtcttcgaatattgtacatttagactgacaaatgcctttattagaataaagggaaaaggtatgtgagagacatagagagcaaattttgggttctagttccacaactaactagctgtgtgaactatgaactatcatgtggtgtctttgtaaactcaagggttggatttctggactttctgtgctgaagtgtaaaactaaaaatattaaaatattcagtaattcaaagtggatattttaaaagcaatgaaacatatcagtagattcaattgttttcttatttatttttatgatttgatattttatatttttagatttcaatttttattttagactcaaggggtacatgtgcaggtttattacatgggtatattgtgtgacactgaggtttggagtacagttgaacctgtcacccaggtagtgagtatagtactcgataggtagttttttcagcccttgtcccacaccctcctgcccttgtcactagtgcctgttgttcccaactttacatccatgtgtacccaaaggttagctcctgcttataagtgagcacatgcattatttggttttctgtttctgctttaattcgcttaggataatgacctccagttccaaccatgttgctacagaggacatgatttccttctttttcatagctgtgtagtattccatggtgcatatatgccacgttttctttatccaatccaccattgatgggcacctaggttgactttatgtctttgctattgtgaatagtgctgcaatgaacatatgagcgcacgtctttttggtagaaaaatttatatttctttgggtacataccaagtaatggaagtgctgggtcaaatggtagttcttttttttctttctttcttttttttttttttgagacagagtcttgctctgttgcccaggctggagtgcagtggcatgatctcggctcactgcaacctccgcctcctatgttcaagtggttctcctgcctcagccttccgagtaactgggattacaggtgtctgccaccatgcccggctaatttttttgtatttttagtagagatagggtttcaccatgttggccaggctggtctcgaactcctaacctcaggtgatccacccacctcgacctcccaaagtgctgggatcacaggcgtgagccacgacacccggtcatttttttcttggagttttggcaaaactatttaagtgttggttaaccttatgaagccacaaatttagatgtaagtactacgtcttcagaaattatagtttttttcccctaatttttctcctctggtataactttctgcttatttttatagttttcagtaacattttaacttagttttatgcattcatctattcaagacatttatagaatgcttactatatgaaagacactgccaaatgtcagtagatgtggtattcagggcctctgtccttatggagctcacattcagataggggaaacagactttcattaaacaagccaccaaacacatagctatagattttcgtaagtgctgtgaagaaagcaaacaggatgctctctgtgataatgatgggaaatcttccctagatgtgacttaattatacattaactctgcagtccattacttcaaatgatccctagttattcaatttacatactggaattttacaaccctgtttagttagtcccaggcttcaggccatttaaaacaaaagatatagatgaatagaagagtcactcagcttgtcttcatccttcagatctcggtcaaaggtcacttttattgggagggtgtcctgattgccctttcctgcctctcacccttactgcagcgcgcgcgcacacacacacacacacacacacacacacacacacacacacacacacacacacacatttaggtccttactatatattctggtagtgtcctgtattttctttcctgacacatttgtaattattttatgagatttaaaaaattactgtctgtcatcccaagaaaccataacctccatgagggcagagaaggtctgtctatgactgaatccctatcatctcaaacagagtttggtaaagagtagacaccagaaaaaaataattattgaatgaatgattgaacaaaggaggatttccgttcacttcagcaagactttgatgattcaaccctcttggtcctacagaagagtgattctagtttttagtctgtgaatgattcaggctctgagttaaacaggcaattcttgagatcgtggtctgaaattcatacaaccctcctactttaaatttcctcaactcatgatccaggtgattcctgacaaattaataaatgtgagaatgatgctgttctttttgtttaaagggtcgaatcataaatgaataggaaatgttgtcatgtcaattcaactttttatcagaggagtggtactgcatagttaggagttctgacagattccccaggcagactgtctgggttcaaatcctggctctctcacttacctgatatatgaccacaggcaagtcacttaacccttgggctcctcatttttctaacctgtaaaatgaggttaaaattgtacctccctcactgggttacgtgaggcttaaaagcattagcacatgcaaaagtgcttataattgtgaatggcatacagtaagtgctaggtaagttctcactattaatctcagtaagcgtaatgctcactaaaattattttcaaatttataccatatgactacattgattgtctgaataaagtaaaactatgtataaaggctgtacttctgatataagaatcatcttctaatttattatatttccaccctcccgtctcctttagtaaattaattaatatattaagggagaggacaacttatatcacagtgatcattatattaaggacattatagcatttataaaaataaagaagtattatgataaactgtatgaatttgaaattcactttgtggtatttacctttaaaagtagcatttctgaatttcatacgctagtttccattcccctttatggagttggctttaacacgcagcttctcatgtggcctgaaaggggattctttctactttctagaggaatgtgctgtgaaggaggagtcgggaatcttactggcggccatgtgagaacagcagctctttgaatgctgggtatgatgtagcatgggaactgtgagcagctactggcggagtgtttcacatgcagcgcagcggggcagtgggaaaggcaatgaagaaaacaaccagtgcaaacaaatgcagaagaaagggtggggcggggtcaaactccagggaaggagagaggtcagcccagagagacaagaacacttacaagaacaaagaataaagcagtgagaaattggagacaagggcaaatgtcagttgcagaataagggaaaaggacaagaaaacatgaccatcatggcaattttaaatgcctggaattatatacatgtttctagtaaggaactagaggtctcaggaaactaaaataaatacatgcatgcataaatacattttgctatttaaacacatttactaggaacacattccatttttaaaaacaataataaacacacttacatggattaccataatagctagccttagaactagcaaaaatagttcccgattaaaacaaattagaaattagtatataaagatcaagcaatcaagtagcctaattaatactttataatgatttgggttcactttataaaatatctgaaaataataatatgcttttcattctcttaaattcataaatatttctttggctcctgatggcttcattcccattttatacttcatataattttttcatcacattctgtacatcgttcatttatccccctgtagtttcacacatcctgatgccttcaaaaaaaaaaaatagagaattcccttgaaaaccagaccattcttctcctagggtgagaaagacagactctggaatatttgggccatattagtttcaaggctacctgagcaatttcgataacagtcctcttgactaaagtacaattagttgtacaaacattgaaaaccaaatgttcttaagcttgacagtacgctttgacctcagtatgctctaagggtggtcactaacctgggcatttaaatttatactctccttcttcaattctttaaagggttttgtttacatcctttttttcctaacagagttgaggttaagcataaatgattattctctccttactgaaaagatgttttcctggaacttaattgtccttttttcacgggtcattctattcctaatatcaacaaatccttctgtgacctaaccttttcaaaaacaaacacatacttctttcttttttttatttcctttacttttagcttttacaaaactctggccagtgggcacatcagactagatattatagttgaaatatttacataagagcaacctatagtttagaatatgttagagcagtttttcctacatcttactgcagtattttgggagaggtgctttctaatttgttttaaccctgtgtatttctcaataacattccaaaaactggagaattgccacataataaaagtactacttagtatctgctaattgagaaaaggctattagctgataaaaacttgtatgctttgtaacacaactgctttacttacaaaaaccagtggtatatgggcaacataattttgtattcaagctacagacaatgcttgatgcaaaaatatatttttgcacctctctgtaaaactctatcatctgtagtttgggaatgaatttctatatgtggttacaaatagacagcatctcctgggagcatgatagaaatgcagaattgcaggcctcacccgatactaaatttctgggggcggattggtttaacaagctttgcaggtgattcttatccatgctagattttgaaaacttttaggccaatgctatccaacagaaatataatgagtgctacatgtacaattttaaatgttctagtaggcacatgtaaaaattttgcagaaacactgcccattgttgtagccgaagcaacaggctcacttcattcattttcaagaaaaataaccaagtttgaataatcataataaatgagtgaaattcattatgacattttacccaagcaaatacataaaaatactatcatttcaacatgtaatcaatataaaaataatgagatattttacattctttttttggtactaagtctttgcatcctgatatatatatatatatataacatatacatattacatatatatcatatatataacatacatattacatctatatcatatatataacatatacatattacatgtgtatatattacgcttactacacatctcactttcgactggctacattgaagggctcaatggccatatgtagctatcatattggacagcacagttctagaccatgtgatttgaaatacagtaaatataaatccatatagcagcaaattgtgtttctggggatctattaacagtttcccttcatcctccacgtttccctttatcttcctctttctgcctcatagaaaagttaagtgcttggttctccatgatcctgcagcacttgaacactcctccaacacagagtttttgggatggcattatacttaatttccccagagtctaaacccttcacagtgtcttacagaagtcatatatatatttttttaacttttaaatttgtctgtacctgacaagtacttaacatagaacaggggttatcaaagtgtggtccatgattcagcagcattagcctcacttgaaagtttgttagagatgcagattctcaagctccacaccagacccactgaatcatttgaaacttggtatgtggagcccagttatctgtgttttaataagccttccaggtgaatttgatgcttgttaaaatttgagaaccactaatgtaggaaaacatatttatttggagaatggcctcatatttatcattttctcctgagttctgtggtagaaccacaagctgaatcattttagtcttcttaaagaaagaaaaagtcaagaaggacatgctagaaagacatcggtagatgtcttctccttatccccagttagtgataggccgacattatttgtaagagcagatggctaggctctctgtccagaagtgaccccataatgcaaaatgattagtacaggatcattaaaaaacaaaaaagaaagatatgaggaaaatgttcaaaatctgtcaacacatttaaaggatcaaatcctgtgctcaatgatggtaagaacaaacatacatagatacagataaaagacctgcttagaaaatcctatctcaccaaagtaaagaatataaatggttctgatataagaattgcttgttggaaaaaaactggttagtttttttaaaatgaagccacacaaatactcctattgtttagctaactatgatcccatcacatcctctcacaaagcttactactatgactatatagaccaagtttccagtaagaaattattgaataatttgtaaaccagagataataatgggtactgcttttgtagtatcagtgttatgatagtatgtaagtatgtatatttctggtttttaacactgagaaaggatgagaggggtgggccatcatggaagtaataaaagagaacccatctttaaagctttacttaatatagcataagcagtaaagggagttttgtttagtatgtccttggaccaaacaggatcattacaatgtcttctaggtacacagtagatgctcaatcagtgctgactgaatgaaagaacaaagggatgaaagaaggaatgaagtttgcaaaagatgaggctctagatccctgcgacagcaagttaccacagaggtatacagatggagtgtaatgatgtctacatgactttggaagaagcttaggaaacctttaaaaaacatacataatttatgatactgttctttgacatatgtaaagaatctaatagctggaaatgccttcatattattcagattttaaaggtgtttgcattccatgagttcctacagtcaataaaacaaatactccttatgttaaagtgtttttgcagcttttgtgctatttgtgggtttactcatgagtaaagaaaaatggtataatattcctttatatactacttgcgcttggtgaataaagagattgactgcattactcagtgtgtgtactatttcaaaattagaaaggtttatcatcattttaacttttttctcacctggtttagatattcgtttctacttggtcaaatattagcattagtttggctttaagagctgattcactgaaatcacttttggctgattttagtacaattgctgagttctaaaggcaatgaggaatataatgctttaaaattttatatttgaaacaagtgtgatttctaaggggtacactgaactgggttcattaatccattggtttataaaaggaagatttaaaagttaatatacctaagaatcatttcaaaaaagaagatacatgtaaaaaagtgaagtattttacacctgtattgtccaaaatagttttaaagtattgctttttttttttttttttggaaatggtgtcttgctctgttgcccaggctggagtgcagtggcatgatctcagcttactgcaacatccgcctcccgggttcaagcgattctcctgcctcagcttcccaagtagctgatctacaagcgtgcgccaccacacccagctaatttttgtatttttagtagtgatggggtttcactatgtgttggccaggccggtcttgaactcctgatctcaagtgatccacccgcctcaccctcccaaagtactgggattacaggcgtgagccaccacacccagccattattgctttgttaagtccaaacgtaataggattttgagaagaggagacaaaaagagcatgggaatagcagttcgaaaaacctgactcagatcttgactgatacaagttatgtgactgtgactgtggtacttcatgtttctaagcctcggtttccttacacgtaaaagggaataatgataataggtaatcataatcataatacaaaatcacaaggttgtgattcttagatgagagaatgcacatgaggactttttctaactgcaaggagtgatggtttcctacaccacaaaaagtcaaatggtcaaatagtaacatgcataccaatgtgtctactttgaggaagaaaataggacttcattcccacagaaaatttcaaacaggcaaaccaatgtctcttacatttctattagaagattcaaagtcagtttggaattctctatacattatgattctatacataggtaaattgtgactgggtttgactgtattgttggtgctcacatcccttaactggtttcaccattttgactgatattacagacagctaaaaaactagcatggctttccttgaaaattaaatgaatggataatgcaaagaacccaggatattctgatatcaagtagacacggcctgatagtatgtaactctaatctttctattatactattttgcccaaatttaagactcttcttcttttctcaggtttacatctgcctttctactactccagttctctatttttattttattttattttatttttgagaccgagtctggctctgtcgcccaggctggagtgcagtggcacgatctcagctcactgcaacctctgcctcctggtttcaagcaattctcctgcctcagcctccagagtagctaggattacaggcacgcaccaccacacccaggtaagttttgtatttttagtagagatgaggtttcaccatgctggtcaggctggtgtcaaactcctgacctcaagtgatccgcctgcctcggcctcccaaagtgctgggattacaggcgtgagccaccatgcccagagagttctttactttttgattgttctttgtcttagtggacagaggcaaagatgaacttgtacttggtttttatcacgatttaaagattgacatagcattgtgactaaattctttattttcatagaaatatgtcttttttgacatttactatttaaaaaaatatgatgtcataatggtggtgggctcaagcttcccgccatagaacttggataatgcgttagcctcacatacattgttctaaatataaaatattctcaacaggatgtatgaattgcttttccagtaatgggaaaaaaattgcttgatgtgaacctcatttcttgctttcttctctttctgaacaaggcctcacatttataatgtagcagaattactatcaaagaaaagaatggaactaacttgactcggttatatgcaaaccaaaaccttggatttatcagctttctgctaaaaacactttttaagcatatctttaaggtcatgttcaaaaatagaaacatgaaatttgctacaatatagagcagacaccacaaactgaactgtttaataggagaaggctgtgtatatgtgggtttagggaagaagagattaaaagttagagttatacaaggagaaatataatttcaacaaaccacatttgtattatgaataaagaaaggaacttcattggttttaaactaaattctgtcaaatgtgtatctcccccagatatctagagacagaatcataagattgaactgtatgtgaccttagacaaaatagatttctgcattttaaaaatgaggagaattaaagctgagagaggttaaatggctttctcacaataacacggtcaaataatggctgagcttaagtttgaagttagacctcctaatagtcaatccaatgctcttttcgctatatcatactatctccttacatgtgttttcctgtacttataaccaagtttttactcattgtaaagaatggctacatagtaagctatttactgtttttgataccttaaatgcaaataaatagtgcaactagaatggatcacttagcattgattaaaaaaaaaaaaacttttcttactagtcataatcctttgacctcatttggaaatctacctgccactgtcacaaatcttttaccacgttctgaaagcaaacgtggcattctgctctctaaaagaaattataaaatatacttctagaacacttatatgggactaatgtggccattggttttctttggacatttattactttccttatttatacttaagatgaaaaacatactaaggatggaacagataaaattttaatagtactcaactactatggagcaaacagagaaaggcatataatcacttagctatatcgccttgctttagtcgatgccacttataacaatctagaatacaaatctttcaggactatccatcacaacaagaattaaattatgtgagatctcaagaggtctgggatttgcaacttatctttattaaagatctagcaattctttaacaggcctctcaatcacacccctaaatggactgacaataggaaagtgatttggtttattatatttttcttattaaaaagttaaaaccaaatagttttaaacccagtttcctcagaggcataccttctgcatcctgttggaaaggagaaaattggaaaggagagaaaatgattctctaattctacggttaaactaattttagggttttggggtataacatggtgtccttcacactgagaaggtagacgcacctcttccaccactacaaccattactctgcatgaattaactcattcgatgttacagtaaccatgttagagatgagtaaatggacaaccacagagattaagtggcctcaaggtcactcagctaatatgttggattccaaaacctgtgtactgtaataataataataataacaacatcaagagctagaatttgtagagtgtttatcatttggcatgttcgctcccgagcactttccatttattttgacttattcatcctaataataaactgatattgcagagaattttattatcgcatttttttttttttgatgaaagactgaggctcagaaaggttaagtaatttgctccaggtcccatggctagtaagtgtgaccttgagcagcacacttacattgcctgtatttattacgcaaacctacgaaaaacttccacatgtaagtttgtgataggatgctctttctttaaatgacttttggacacatcttactattgactcttgtttaaattaggattctaaagggaaagatgtttttgagaatccaagcagtaagagtacaaaggaactgcatggtggcaattcacatcttccatcatgattcagcattattttctgtttatcgtaagaatactgctacacagagtttggatgttccctctaactcgcgtgttgaaatctgatcccccgtgttggtggtgaggcctagtggaaggtgtctgggttgtaggagtgaatccctcatgaatggtttggtgccattctcacggtagtgagcgaggttttgctctagcagttttcatgagaactggcacctcccctccctctttttctcctcctctcttgccgtgtgatctttgtacaccagctcccctttgccttctgccatgagtggaagcagcctgacgccctcgccagaagcagatgcttcttgtacagcctgcagaactgagccaaataaacacctgttctttatgaattacccagccccaagtattcttttatagcaacactaaacagactaagacatatactaagtcttagttgcttccaaaattaatattaataatttgaaaatgtttagatgggaattataaactaatataaaatatcctatcctcacaaatattaccatgaacattacatgaaaaaagtactttcattgttctttacaaattttatctgtatattattttactgtaacaaaggacaacaatgtttacaatgtgcttacctgcagaagcttccatctggtgttcaggtcttccagagtgctgaggttatacggtgagagctgaatgcccaaagtggtaagctggcgagcaaggtcattgacgtggctcacgttctctttcagaggcgcaatttctcctcgaagtgcctgtgtgcaatagtcaaaagcaaattggaagatgagaatatttaaaacaagaagaactgatacctgggcttattctctttagggtgcagtgccagtaatgtttgctctatgctacggtttgaatgtttgtgtcccccctcaaattcctatgttgaaatcctaaaaaataaaaaggaaacgaaatcaaaacacctaaggcaatggtattaggagatggggcctttagggaggtgatttttgggattagcgcccttataaaagagacctcagagagctagctagctcctttcagcatgtgagggtgcagtgagaaggtgctttgtatgaggaatgggccttccccagacaccaaatctgctggtattttgatcttggacttctcaacctccagaacagtgagaaataagtttttgttgtttcacaagctatccaatttatggcatttctattatagcagctggaacagactaagacagtctcttgtggtagtattataacaatggatatttgttaatgggggaataatgataactactatttgttgagcacttcctaggtgcctaatgccatgatgagctctattcatacataaactgattttatttctacccaacaatcctatgaggccagtagttggagaattctaattttatacatgagaaaacaaacttgcagaggtttgttttcaaaacaaacaaaccttgccaagctctcatgggtaaaaattgaggaacctgggatacctatatgcaggtttgcctgcctctagaatatatattcttaactattatgttatatgcttcccctaagaaattctggattggcaaagtaacaagaaaaatatattgctgctggattctaaattctactcatgtcacaaccagaaatggatccttattttttacaatagaaagatatattcagtcataaaatattgcatgcatactttgcaccaaccacatcataacagtttcatttagggagtagggtattttgtcaagtcctcagaatgacttcctgatctcctggtattttagcccttgtagcaatgacttcagaaggctcccgtggggcttctcagctgtctttgaagcactagagcaggagtctctgatgcaatacatcatagcaatccgttgagcagaagaaccctatgcagatatggggaggatattaccacgcctcatatctaccctatcgagatggcatttatggatctttaacatgatgcatgatgtccaaatgttccaataagcaatttctaagggacaaattccctcacttaggagaacagtttgtgtaatgtaatgtctgtgtacaaggacagcaccacttgactatacgtgttgttttgacttgcttgatctgggcaggtgttatttctctgtctggttcactatgttgataaaaccattggttacactgacctcatttataagccttgcatttcctcccactccaaataaaaggagccagtatgaacattcaaaataagaacgacattatcctctcaaatcaacctgaatacttcatcagtaaaccgtggtgctgtatagagcataacactgttgtgtagttcttagataatacaaaacattgtgataatcactctgttgaacttaaagttttaaaaagtggtcattaaaaacattacgttaagcaatcagggggtttcttttggacgataacgaaaatgttctggtattaaacaatggtgatggtggcacaatcttgtgaatatactaaacaccactgaattgtacactttgaaagagtgaattttaaagtatgtgaattatatattaataaaaacaaacaaaagagagccccttctgaccatacacatgcaaaaaaaaaatcatatgtgatgtattcatctgtattcaacttcgtgttagtggaatgtcactggaatcagtgtgaaattcagaaagttttataggggtggatagtaaatattgttccatttccttatgaataaatacatggattaaaagtatcagaataagggcccatggagaaaggtggtttaaatccatatatatgaatacttatctctaaaaggaaatgatccatattaattttgttttgcataatagaaaggttagaaaacagatttcttaaatgtcaatgggggaaacttggacaaggacaacggttacaaaatgaaatcattctcttctggataataacgtgcatttctagtagccacaaataaatatcatgtgaggggaaactgtaaacaggaacctctgcagagagggcaagccagcaggcagcatctttcagtgatacaggtgagtcctttgtgctaatcatctctctttacaagcaagactctcaagccattaagttgattatcctacctcgttaagccatagctagatttcagttccctttaggtgacacaatgtacattttcaaatgtctcttattagaatattttgattttcattttctctcccaaattcctgagcacacatattaatcctgcttcaatgttttggaggatgaaggggattcaaaaataagttttggtactcataattaattgcaatgctctcccttttcctctttttttttctttttaaaatttacttttcttctttaaactttaccataagatcttgggattttttttttttttttttttttttttgcttctttcaagcaatgatagtggaagttctctgaactaatctccacttaagactcaccaaattagccaaagtcttcattctctttgtgaaacagcagtgatgggaacctctcacagcctcaataaaatgttcgaggtgcctgtcagtatgtgtggaccttctgctcccatcagttgacttgttacaaccgtcagttgtgtgtatgttctcaaacctatctttgccagtaactgttgtgattatgtaatttaataaagaaagatttcctaaatcataaaaatattagtttaaaaagaaaagaaaaaagttattatttctataaaaaccaggccaaatactctggagagttgcttcaaaaagaaaaagaaaataaatattgttgaagtagttgtgaacaagacaactgctaaagatgaagaaaacaacccagaccaggtggggtggctcaagactgtaatcccagcactttgggaggctgaggtgggtggatgggtggatcacttgaggtcagcagttcgagaccagactggccaacatggtgaaaccctgtctctactaaagatacaaaaattattcgggcgtggtggcacatgcctgtagtaccagctactcagggggctgaggcatgagaagcgcttgaacctgggaggtggaggttgcagtgagccaagatggcaccactgcactcactccagcctgggtgacccagcaagactctgtctccaaaaaaaaaaaaaaaaaaaaaagaaaaaatgccaaatattcagtttaatctgaattcctaaatttctgttaaaatatttgacaatggaagctttgactggtgtgaggtcagttgataaacagataactgggggcaaaggttcactttggggaagtctctagatggggttgagcagactaaaggacttcagtcagctagaaatcatcatgagggcactcaacgcatgaaggtggaagaaaggagataacagatggtaggaaagataaaaaggaaaaggaggcaggagaatgctcatgtcagtcttcactttggcatttgatttaggttttggtagcagcttttaccacccaaggatggctcaccactgtgggctctcagtgcccagcagcatacataacaagaagtatggccgcctaaacacagagtcacaagaccttcaccctgtaaagggtgaacacaggtactttgctatttaaatagatgtgacattggtttggctatatttcacagattagagcttttaatatgacacacataaatttgtgtttaaattattaaacactacacctaaaatgtcaaaaagcacagttaacgctgagcaatacgaggtgctatttaagtgatatcaggattgcattaggttttttttctagtttggaagcagtaagtgagaaaacattgaagaaagccattatattgtgggttttctttgaatcacttaaacatctggaatatgttctccatgaaagagcaaaccaagtctaattttattatgactagtttctcacaggcagaattttcagttcattaaatgttgtctgattatagatacaaaagtactgatttagaatgataggtaagtctgatataataagtttttcttcatataaaattaaattgcctgtcatatctttgcttatctttatgtagctaaggatttgttcaaatacacatttaaaattatagtcatctactacttttctaagaaaataaaggaattgtctattaacaagggaatcttatttttgagggaggaattttgacttgacagttaagagaacattcctactgcaaagcacagaaggtcagttggaaagactagaaagagtaaattgagggaattctgcttggaggggttttatttcctctgtgaagtaggaatcaacagacctggcatagtctgcagtgcctggcatagcgtgcagtgcctggtgtgcaatgaatagtcactgaatgaaaacatgaattaagggtaagtgggaacatttgaattaatcgtaatagagactgtgagagggagttgacctaagagatgtaatgaggttggcaaacagtgttgagggcccacttgaggatgaggttcaacattttttagcagaaccaatctgcctgactttctcattttctccaacagtgttgcatgtaagcatggggaaaacagttgatccaggtttggggtttcgtcagatgactgtggctcacacatttagggataagggagtttcgatattagccaggatgtaattgaaaaaatatactgtggaatctaaactggattaggaggaaagcaaagcaaaatgaagcttgtagatggagagaaagtagaggggtcagttgtagaagtccaggataatccataaaaggccacagcaggagtagctgcacaaacaagcgacagagaggggagactctgggatgctcagattagctctactggatttgccacttatgagtttatttataaatggtgtgatatatatatatatatatatatatatatatatatagatagatagatagatagaaatctggctatatatatataaatatatatagtgctactcagtgtttgaaaaacttcccttcttagggatattaaatattcctcctaaaatcttaacctgctaactcatagacgtcctatctcacttactaggaattcaaaattactaggttccaaaaatgaagtgttattcttgggctacatacacgtgcagagaaatttatgttacaaatattacttaagtagggactaatggcattgctgtctaccatgaatccttgtcaaacaaatgtttgttaaccaagactcttggaaaacagcctaaaaagaggaggtgctaggaaagaaaagtcccagcattcttcatgctgagctagtcatgagaaggcaaggatgagcaattagaaatcatgtcctataaatactggtgtttagtacttattccggggctcttcctcgtggttcagggaagccctcacagaatgcaattacccgggaattggcagcaggtacagcccagctatgttttgcagctcctgcatttctcagcagatatatcatcctcatggggccaagagagtcaaggactgtatcttgctttttccagaggatcagaggcctactggaatctctcaaatacctgggcggaatgagctactcaaatgctgttgaaacaattaaaaagaaacacaagttgagctgtaagcaagcccttcatgaaatgtatcaggctcagagacttccatcattatctgtaatttttgacttttcattctggttggttccctgactgctctgatgcccagaatgtaggtacagcttttctttcagatacctactgccttcagccaggtttaagagaagcagagtctgagtgctcttaagaaaaagggagtgagagaagcaggaagacagggcaagaaagttaagttgggatgtggtatgggctggagaccagcatcaatctggccccatgggaattcccagatcacaaattgtacaacagcaggtgccatgatgaggcaaaggggttttccctttgtacccctggtggttttaagagagaaggtgtggtgggacatgccagtcaaggtggcttccttttggctgagggaggttctctggaaaggggtgaaaccatgaggctttagcagctaatactcagagtcactgaggaatgggtgcaccaacccagtgaacgaatctgactggggcaccaacagcatccattacttagattaacttcatctgctttcccaatagcctttacccttgaacttcagttgtcaagcacttatattttgtttttttttttttttcaggagacttttcttttcttttcttccttccttccttcttttctttctttcctttttttatacaggagacttctttctttctttctttcttcctttctttttttcaagagacttctttctcttttttctttccttccttccttccttcctttccttcctttctttcctttttttttttttttttccaaggtggagtttcactcttgctgcccaggctggagtacaatggcacgatctcggctcactgcaacttctacctcctgggttcaagtgattctcctgcctcagcctcctgagtagctgggattacaggtgcccgccaccacgcctggctaattttgtatttttagaagagatggggtttcaccatgttggccaggctggtcttgaactcttgacctcaggtgatccacccacgtaggcctcccaaagtgctgggattacaggcctgagccaccgtgccgggcctgcaggagacttcttaagtgaattttcattactaacactatggggctatttcatagctctccaacaaaactgggattgtcaccctttctcgaaagttgagtccctcatttctgccaaattctgagggactgtgtggagctaagacaaaggggatactttgcagactgagcgaatacaaccctctgcctttagtatcacttatgcttctggtagagacattctcgacaataaattatgccattgaaacgtactttaaaaaaaaaaaagggatgtgattgcatttttttccagcaacagtttttattgtgatagcctgaaggcaaaatattatgcagtttcttttcgttgtctccttccgttcagttttcagggcaattcttgtaaactttcatatttgggcatgatcacttttgacgagtaaactgaataacaatataaataatgaaacagactcagaactaatggcctagatttagcataatcagaaacacttaagaaaggttaaagtcaaaaaaaagatcttgggaaaacaatattaagtttgtaggcatgaagaaatttagggcttttatttcccaagcgattatcagtaattatattttaactatggtttcttctcagactcaacacgcttccaaatttgtgacattaaaaaaatagcaattaactgctctgtgttttccataaagaatccacatctttttataaaaaacaatctcaaccaggtgcggtggctcacgcctgtaatcctagcactttgggaggctgaggtgggtggatcacctgaggtcaggagttacagacgagcctggccaacacagtgaaaccctgtctctactaaaaacagaaaaattagccgggcatggtggtgcacacctgtaatcccagccactctggaggctgaggcaggagaattgcttgaacccgggaggtggaggttgcagtgagctgagattgcaacattgcactccagcctgggcaacaagagcaaaactctgtctcaaaaacaagaacaaaaaactctagtttctctttacaatatcgaaaaagaatatatacccaaacataaaaggataactttttctttttaacattttctctttgcactgatcataattcttcatcttttaggacatggctttctatgaagcttgtaactccaatgttcttataataaaagccgaattatatcttggccatattaacagtgtctatcttctttcttttctgggtgctcacatttccttcatgtataaaatttggaaatgaggaacagggaagtattgaccacaaaggaaaagtttttatttttaagaacaagttgaacatagcaggagcaattgatattttgcaaaccatacacccggtaaggggtcagtattcaaaatacacaaggaactcctacaactcaatagcaagaaaacaaatcacctgactaaaaaatgagcaagtaacctgaatagacatttctccaaagaagatatagaaatgagtattcagatttatagacaggaaatagaatggtggtttccaggggctgggggcaggaagcaatggggaattactgtggttttttcttttttgttccttttgagatggagtctcgctctgttgcccaggctggagtgcagtggtgtgatctcgatctcagctcactgcaacctccgcctcccaggttcaagcaattctgctgcctcagcctcccaagtagctgggattacaggtgtgcaccaccacgcccagctaatttttgtatttttagtagagatggggttttaccatgttggccaggctggtctcgaactcctggcctcaggtgatccgcctgccttggcctcccaaagtgttgagattacaggtgtgagccaccatgcctggtggggattatcgttgaatagacatagagtttcagttttgcaagatgagaagagttctggagatggatggtggtgatggcagcagaacaacgtaaatgtatgtaatgccatggaagtatacatttaaatagagccaagatagtaaacttcatgtaatttgtattttaccactatttaaaaaatcaaaaataagtacaatttgtaaaagaagaaacttgaacaaattttattaatttccttgggaaaatgtttctataatcctaactgcaactgccagttatctcccctttatagacaaaaaacaagcaaaaaaaaaaaaaaaaaaaaaaaaaccacaaaatacttcaagctttccaatgacacaattaaaacaaataaaaagatagttcatgagtgtttcacagaggctaaatacaaaatatacacaattaacacaaaaaggcttttaatgagcacaaataagtcatttaagcaggtcatgctttaggttgctaaggaaacagaaaaaataccaatattttctgtctgaaaaattttaattatatgtgacaaaatgaagcaaaatggcagttaatgaaacctattaacttccttaaaagtaagtaataatccataaaccattaaaatatcaaccatgaggatgtttatcttcaaattcagaagttacttcagacagatgaagttttactttttttttgagatagagttttgctcttgtcgccccggctggagtgcaatggtgcgatctgggctcactgcaacctccgcctcgtgggttcaagcgattctcctgcttcaacctcccaagtagctgggattacaggcgcacaccaccaccatgcctggctaatttttctatttttactagagactgggtttcaccttgttggccaggctggtcttgaactcctgacatcagatgatccacccgcctcggcctcccaaagtgctgggattacaggcgtgagccactgcgcctgaagttttacatttaacaagtttttgggcttgcaatcatttcttggtctgagccacatgtgttaaccaccattgtccctgaatgggccctctccctcccctaaatagctcaaaacatcagtctaaggcagtgattctcacacaatagtgtgcatctcattgtcatgtggaaggcttgttaacacagagactgctgagtcccacttagtgcttttgattcagtgggtgtaaggtgggcctgagaatttggcatttctaataagaagttagaaaatgttgagttcctagaactcatcaagctttttatttctttatttatttttattttatttttcagacagggcctctttctgtcgcccaggctggagtgcagcagtgcgatcatagctcactgcagcctcaaactcctgggctcaagcgatcctcctgcttcagcctcccaagttagccaggactacaagcacacaccactggcattgatatatatatatttttaagttagttttttctttttcttttttttttttttttttgcgagatgggatctctctatgttttccaggctggtctcaaactcctgggctcaagtgatcctcccacttcggcctcccaaagtgttgggattacaagcatgagccaccgtgcctggcccaagcttactcttgacttagaaccttcagatacactgttccctctgcttggagttttatatatccactttatgcctagctggctcttattcatatacttctgatctcagttagatgtgacttttaaagatagcctattcccagttggttgccctacgtaaagtgtctcctttttccttgactctcaacaccctattttccttctgaaccctgatcacaatttgcaagtacatatatatttgcctattcatttattcattgtctgttccttcccaagaccagaaaatttattaaggcaatcctacattattgtttttcaccagtatatgccaagccatagtacatgataatccctcaatacatttttattaaagaacaagcagtcaagagaattaggcacttctgtactaattactaatacttcagaccaatagctattgtcagactgcttcgtaaacagtttctcacagaaacctgacatagagttcctaaataagagaaagctacccattttccttatcccatatctgaattatttatatctatcacttgatttatattggagcatttgctaatttctgaagcatctctcattctttgggcaagaatataacatttcagtttttggtctctaccagggatttttaaaataaaaatggagtgagtgggaaaaaaagaggaagtagcctattcaaggaaaatatattctgcttggtggtggtggcacaagttagtgcatcttttggagggcattttaacaacactgaataaaagcattaaaaatatttacatatgaaaagactagaagactacaaaccaactgaaatccagcctgggctctactaccaaattggttaggcttggcataggaccggggatctcttcaaaaacacagtgcctttttcttctttgcccaaagaggcccttgcagggattgggattatagatgctggggctgagattacagatgatccctctctctctctctctctctctccctgcctccctaatttttgggcttttccactaaagaaaagttacttaaataatgatatgaactaagaagtcatcaaatattagactgtaacgaagttcatttacaaatattttccacttgtgtagaaaagggatagtaacatgcatactttagggctgttacaaagatggatgagaagtttaggcatatttctccttcttttagttcacatatagtcacacaagttcctattcaggctagtccagggagactctgcaaagcagtaggtaataagttcatccatgagagagtcacagactaagatcctttgccgggtagctacctttttggagctgatttctcacatcgccccaggggcaacctctatcatgtagccttataaacgtctcctcgaactagacattggaaagtaggtacatgaaactgataaagaggaagcatagtgtggggaagaaagatatgtgttcagaacttgaacaaagggtaagaggtaggaaagtttaatgtgtgtctgaggaaaagcaaatagcctttaataacttaaaatatgaagtacagggcagctgtaaaagatgaatcatgggtgttttctgggatcaagattgtggtgggtcttgaatgaggtggcctttacaatgtagaatgaagatgtccacaaaacgggaatggcattttctcggcaactcttagatttaattactactcacttgaaaacacttactttatatccactagatactgtgcccacatatatgtgtgtgtgtgtgtgtgtgtgtgtgtgtgtgtgtgtgtgtatatatatatatattatatacctatcatccactggaaaaatggaagtctcaacacactcacaatcattagcagaggtacacaatttaatgggtcattaaaaaaaatgcaatccatattatgagaagttgagtcataggggtttggaaggtgcagagaaagatgctgatggaggggaagagagacctcctgagtagataaggtgactgaaatcattcacagaggggaacactagaagaggcatgttcctctggacatgaaatagtcacctggaaaatctcaagtagatcagtataacttgtggtcattgtggaaaggagaagagacacagagtgtttgtatgcagagacaagaagtaacaatggccagaaataagctggtggcaaatggagcaaattatttgcaaaataatttttaagggtcacgctatctaaaagatagcattttgccctatgcttttgcacaaatttgtttattcatttattccaaaaactattattgggtacctattatatgccagggaatgttctaggcactggaaatacagcgtaagatagaccaagtctctgtaatcatgcagcttaaggctaatggatatcatttcatttaaatgatgactattaataactaggcttataaagaagcaaattccaagccaaaatatatcatggctataaaatacaatttttgaccaagaaaatgcaggacaaagtataatattgcagatagcagtctcaaagagattctgttttcacttattaaagcaaattaagctacctctgcatgtctgaataatgattaatagaggaatctagaattgtgagttacccgtgcaatatgctgtacctggtttgctttatatggagcacatttatttagttttggttctagggggaaggcactcactactgaaacaaaatggatttttactgatttgatttttcattcaatatattattaacttagaaatactaaggcagaaatgaaccaaagattaatacaaatttttaagagcagtgataaaaataatacacagaagagggctaaaaaggattgcaaaaacgtcctttaatatccaattttactttcagattattgtagttcctaaatgtaattaatgtttttagcctttctaaaatggtcttatttcttgcaaacaaaataaaaaagcaggatgttcaactacttaaagtcaaacgaaaggaacagaaaacgaattttcttcattaaaatctatgcaacatcataatggttcatcttcttttcatcatattctgaggctgaaaagaaagtcttatgtattcatttctgagcaatgtgggccctctggacacattattagttgttatttttacttctgtgaatacatgaggttgtgaaaagtctagcttcttgagtcaagagtttattcagtttgtcatttttctcaccataaaattgatattttcaagatattattctgatttttatgatcacatcttaaggtaatatctaaattcatatcctgtaatagtctgttatgacaactgctatcatgataatgtccagttaagtacatgcaaatgatgaataaattactacttacacaaatgagtctaagtgtcaagctgtctaaacaacgttctcagatgtgatttccaaaaaaaaaaaaaaaaaaaaatcactcattggccaaatctaccctttagaaaaagtgattgatattcaactaacagatatatttaatagtaatagacttttttctttttcaaaataggagtatgatttagtgccctcaaaaatctgtgggggtgatgctgcattgattatctaaaggagaatacaatttcagtaggaaaaagagttcaaaactctttttaaaataatcttttcactaataattcagtaattttagattcaaagtgggtcagatttcaccaagacccctcttgcatacaacaatcaaccccaaaccctaggcagttttataggagaaacgactttgcaaatgtcttccttcaacctttatacaaaaaaaaaattgagatggttccaaaggtaatattttattcacagcataagccaacggagtaatttatgctcatttgtttagcctgtatttcttttaaccttatgctttattggatgcacaaaagtcaccctgatattggataacctttgtggagattctagtatattgggtttgtgaaagtctaaaacaatggaccattctctcccttgctttagccccatccctgctagaaacatgtgaagaccaaaaaccaactggcaagcagaaggtgaagcaggtaaaatgccgttgcatacagtctgcttgcttgggggcagataagaaacttaaatcacaggtcagttaaatgggtattatttaataagacctaataggctttaggttcacaacaatggatagatctcaaaatgggttacaatgttttaagagtaggaaaaaagtaaatgaaaggaaactcagcagtagtttatcattggttctaaaaaaaacacatcaatgtattgccaaagactctcattcacttttgtttctacttaattcctgtacttcggcatatattgccaataaattgacttcactctgttcactaacttgcttatgccgtgttaagatcatgatgatagaatgtgaatatttgatagggaaaagttctaaatgagtcatttgagtctataatgatgcataatcccggaaaaccaaacttctaaaaataagtgtgtttcgaaacaggactggcaggttcttaactttatgaagaaaaaaaattaccataaaaatcaattccttaaaagaaaatagaaatctgtcttagtgttagatcctccagcctcattctggttaagagaatttggcgtttcagggctgagcacactgtggaaacttaataaatattgaggtttacaaacaaaaagcataacaatgatatgtggaccaattttcaacaacactgaaaatcaatgtgcccttactctgcctaattcagttaactcaattatttaatgtacacttgatttgagtgggtttgaccatagctatttccattttccattgaacattaatcaaattgcttctaatgtaaaatttcattttttctcatccttctcctctcccagattctaggataagggaaaagtttaagtttcatgtctcttgtttaaagttaaaagcaaattttaagacatctgtttccattagtttatcccataattctcttttcatataccactcaccctataccacaaccatgaactttttcacagatatttaatacattgttttttgcaccattttgggaaaaatcctccttcctcaaccacttcagctaagactcttttctactttctcccagttgatcccacatcatctctatttcatctctatttcacctcatctctatttctatacacaaaaatataccctccccctgaacacagagcctcaaggggtggacaaagtaagttataaaatgtaggcactcctggagaagctgttagctattcatatctagcaagtagattttacttaaaaagtgttgactgatcccaactatttttaatatcctagattcagaaactctataaagtactattttatcatcagtatgtttggtagaaaagtgtaaggagaatttttaaatgtaattgtttttattggtaaatgcaaaaaatatttacacaaagtgaaaagttatgtgactaaatatatatatagtttgagacaaggtcttgctttgtcactcagcctggagtacagtggagtgaacagggcacactgcagcctcaacctcctgtgctcaaacagtcctcctgccccagcctttcgggtagctgggactacagacacatgccaccacacctggttaatttttgtattttttgtccaaacgaggtttcactatgttgtccaggctggtcttaaactcctgagctcatgcaacccacccacctcggcctcccaaagtgctgggattacaggcgtgagccaccacggccggccatgactaaatatttttaacgttaaaaattaatactgggaaggcaagttatgctgttggtcatctgaagcaaccccaaaattgtaccagtgtcattaaaataccaacaggaaaaaatgaaataaaccaccgtcaaagtcttccacaagtgagatttagaaaagaagccatttattcatttcaaggttcctaagcgaaacaatgctccctatgatgctcccatatctaaactattaatcaatccaacaagaggctgtgtgcctgcattcatttttaaactaaatcttctggatattgataaatataaaagaaataataaatgatatatttattacttgtaattgaagaaacgctaacactacacaaaatatgtcttcaggtacatacacagtagctttactatggaatattggttctcagaatgtatctctgaaccagcagcatcatgaacacctgggaacaagttgggacttcttagccttgccccagacattttgaatcaggaactctggggaaggggttcaccaacctgagtttctacaagccctccaggtgattctgatgtatgctgaggtgagaaccattgccactgaaaattcttgacattctcaatgatgtctggacatgtctgaatgcctagacatttacagattccataactataaagccaaactcacttatgaggccattttcttactaatagtgatcactttcttagactttttcattcattaactcttctcttccatcactaattctgatgaacagctatcaagctattcatggtagggtggagggtaggtggattttccataaagaaacaaaattctcattatttataaagaattactgtacatgcaaaaacaaaacagcattaaaaaaagccaagttgaatatgaagagtgagtggattactaggtttacttattagttgcaggggacactttacctaacctgggcatccatccttcagctgctgtgatggttgactattaatgtcttatagctacctgccttctccacatgtgacctctgcttatgggagccccctagcccaggaagtaacccatatcccaggagtggaccacagccagtggtgtgctgcagcagagcccaagagccaattgtgtgcatctcctcccaattccatactcagtggcattatgtcggtagctggagatcagtggtagagggagtatttacaccacgaaaactggttttgatacacaccaggattcatcccacctcagagctagtcgacaaatatttgccagcacttcagtgacacagacaatgactggtataaaggcacaactccggctcggtgttgtggcttacgcctgtaatcccagcactttgggaggctgaggtgggcagatcacctgaggtcaggagttcaagaccagcctgactaacatggtgaaaccccatctctactaaaaacacaaaaattagccaggcgtggcggtgcatgcctgtaatcccagctactcaggaggctgaggcaggagaatcacttgaacctgggaggcggaggttgcagtgagctgagattgcactccagcctgggcaacaagagcgaaactccatctcaaaaaaataaaataaaataaagagtacaactccacagcgaggtttctgctcgagggcttgctctctctctggatcagacacaatgtgaggtttcacctgaaatggcatacttgctgggctctttcttctcctgtattgtttccctaactccaatacaggcttctcctgagagcagaccctctataaatcacaggcacctagacccctgttctcagggtctgcgttcatggaacctgacttaaaatgccatttaactcattagttaagtgactatgcacaaaagcttgaaataatacatgttcaaaattaagagctgctagtcatggaactttggatcacaataatcagatgaacctgcaaaagataaatttgaaatagcaagggtctgctctttttgtctgtgtacataaaagacagaagttgatggaaaaagataaagcctgcaaaaactgggcaatcctttatactgtgattctcaacttacgctttcatgtccataggtgaatgtgctgaaagattccttacttcagaatttgaagaaaaagcatcttcatattaaaacatgatgaatccattatggaaaataccataaaattgatgtgagatttaaaaaataaaacaagaacatcaaagaaatttcatgctcatggaaaaaggagataggtaagtggaagcgggagatgtcaggctatgtcttctatgctgttaagataactgaagtaaataagtttaagaatcactgctctcggaagatgcttttaaatagaaaaacctgcagtaagtgtaaactataactaaaaatattattttaacatgaaaaaatcttattatgaaaaagttctttcttaggccccattaaaatgagagagacattagtatcacagacacaactgttcccataatacccagaaaactgatttaccaagaaaaattattcaatgccattacttaacttagttaatttcaggttgtgtaaggcataatactggtgtcaatgctaactgttaaattttgaaaattgtaattgtcaagcatgacaggaagaagcgaactccttgggttatttgatcttaaagcatttcctgttttactgaacggtaggagagtaacagaattgtgaactttattcttgtcacaactttggtagatgtcaaaaaataattaaaaatatatattggctgtgtgattccattttcttaggaaatatggaatttcagttaaataaataactcacattttagcactgtttctagttaatgtggtacatgcacatgtatacacaagctaatacaaattcttgctccctcagcttggtgctaaataataatattcccaggaaaactaagatgccatctatacaactctcaatataatttttgtttttgaaataaattaaatgttcacactctataatgagatcagacttctctgggtataggtttcaatcatatcatgaattaatgaatgagtgcatttgtatatcctctaatactgagagtatattacttaagttttttgaataatcttttattacccgagactcttgaggaatagtatttctagttattacccaccacaaacaaagctttcagaaaatcctagcaaacaggattggcatattataggatcagatgttgatatggttgttttcaaatagtaggaaggatggtattatttggagaaatttttattatctgattaaacacttcttgagtagaatcagatgaactcattagctgaacattttgattacccgtgttctcctaaatatcccatgaccagaagagtagctgtacaactctgatttaatccaataacaataataaccaattctagctccttcttttatcacagtccatcaaaataacacaaagaagtccaaattaaaataagttcaatgacaaaaagaacatgttccttttccaactgttctaaagccttttcctgtctttaagcaaagttcattcagtcattatctcatctatgaaagtaaaagcagaaggatgtttcccttattaaataaatggctttatgctttcgatgtggaaggcatttcataacagtcaaaaaaggaagcgttttgaatgccatcaactcatttcctcccacccactgttttaaatcgtttgtttggttccaatgtatactacacttacataagttgtttatgaagagccaaattaatagtctttgcaattgtttttgttggaatttggagagctgacaagtgaattagtagaaaatggcaattctacatgaattagcttttaagtctccctaagaggctgatgcagaacttaataagagacttattaggagaagtaggacaacttaattcagattgattatagacttcggtgaagacagctggggttcaaatgaaactgaaaaagaacttatatgcacttcaaagtatgctaagcagatgtctgaaacaattactccgctctgccttttcagaagtttcaaaggcgggatgggaatagcatggtaaacgaaggttctgtttgcctaagtcgaggtaggggcttttaaaacacacacagcgctatctaaaatcagatgctttggggaaagaaagtgatttgacattgctgtcctaagtaatttgcttttagctttataaacaaagcaggagatgagagggaatacatggtaactaagtaataagctctcctggcaacactaacttacaattaatttcacattgaataaataatttggtcaggattttttttttattattattatactttaagttctgggatacatgtgcagaacgtgcaggtttgttacataggtatacacatgccatggtggtttgctgcacccatcaacctgtcatctacattaggtatttctcttactgctatccctcccctaacctcccacccctcgacaggccccggtgtgtgatgttcccgtccctgtgtccatgggctctcgttgttcaactcccacttacgagtgagaacatgcggtgcctggttttctgttcctgtgttagtttgctgagattgatggcttccagcttcatccatgtccctgccaaggacatgaactcatcctttcttatggctgcatagtattccatggtgtatctgtgccacgttttctttatccagtctatcattgatgagcatttgggttggttccaagtctttgctattgtgaacagtgctgcaacaaacatacatgtgcatgtgtctttatagtagaatgatttataatcctttgggtatataaccagtaatgggattgctggatcaaatggtacttctggttctagatccttgaggaattgccacactgtcttccacaatggttgaactaatttacactcccaccaacagtgtaaaagcacacctatttctccacatcttccccagcacctgatgtttcctgactttttaatgatcgccattgtaactggtgtgttttgatttgcatttctctaatcaccagtgatgatgagctttttttcatgtttgttggccgcataaatgtcttactttgagaagtgtctgttcatatcctttgcccaatttttgattaggttttttcttgtaaatttgtttaagttccttgtagattctggatatcagccctttgtcagatgaatagatggcaaacattttctcccattctgtaggttgcttgttcactctgatgatagtttcttttgctgtgcagaagctctttagtttaattagattccatttgtcaattttggcttttgttgccattgcttttggtgttttagtcgtgaagtctttgcccatgcctatatcctgaatggtattgcctaggttttcttctagggtttttatggttttaggttttatgtttaagtcttgagttaatttttgtataaggtgtaaggaaggggtccagtttcagttttctgtagatggctagccggtttacccagcaccatttactgaatagggaatcctttctccattgcttgtttttgtcaggtttgtcaaagatcagatggttgtagatgtgtggcattatttctgaggcctctgttccattggtctatatatctgttttggtaccaataccatactgttttggttactgaagccttgtagtatagtttgaagtcaggtagcatgatgcctccagctttgttctttttgcttaggattgacttggctatgtgggctcttttttggttccatatgaaatttaaagtagtttttctaattatgtgaagaaagtcaatggtagcttgatggagactgcattgaatctataaattactttggacagtatggccattttcacgatattgattcttcctatccatgagcatggaatgttcttccatttgtttgtggtgtcctctctcatttccttgagcagtggtttgtagttctccttgaagaggtctttcacatcccttctaagttgtattcctaggtattttattctctttgaagcaattgtgaatgggaattcactcatgatttggcactctctttgtctattattggcgtataggaatgcttactatttttccacattgattttgtatcctgagactttgctgaagttgcttatcagcttaagaagattttgggttgagacgatggggttttctaaatatacaatcatgtcagctgcaaacagagacaatctgacttcctctcttcctatttgaataccctttatttctttcccttgcctgattgtcctggccaaaacttccaatattatgttgaatacgagtggtgggagagggcatccttgtcttgtgccggtttttaaagggagtgcttccagcttttgcccattcagtatgataatggctgtgggtttgtcataagtagctcttattattttgagatacgttccatcagtacctaatttattgagagtttttagcatgaaggggtgttgaattttattgaaggccttttccgcttctattgagataatcatgtggtttttgtcattggttctgtttaagtgatggattatgtttattgatttctgtatgttgaaccagcctggcatcccagggatgaagccaacttgatcatgctggataagctttttcatgtgctgctggattcggtttgccagtattttattgaggattttcgcattgatgttcatcagggatattggcctgaaattttctttgtctgttgtgtctctgccaggttttggtatcaggatgatgctggcctcataaaaagagttagggaggagtccctcttttcctattgtttagaatagtttcagaaggaatggtaccagctcctctttgtacctctggtagaattcagctgtgaatccatctgttcctgggctttttttggttggtaggctattaattactgcctcaatttcagaactcgttattggtctattcagggattcgatttcttcctggtttagtcttgggagggtgtatgtgtccagaaattaatcaatttcttctagattttctagtttatttgcgtagaggtgtttatagtattctctgatggtagtttgtatttctgtgggatgagagctaatatcccctttatcattttttcttgtgtctgtctgattcttctctcttttcttctttattagtctggctagcagtctatctattttgttaatcttttcaaaaaaccagcccctggcttcattgattttttgaaggatttctcatgtctctatctccttcagttctgctctgatcgtagttatttcttctcttctgctagctttggaatttgtttgctcttgcttctctacttcttttaattgtgatgttaaggtgtcaattttagatatttcctgctttctcctgtggggattttaatgctgtaaatttccctctaaatactgctttagctgtgtcccagagattctggtccgttgtgtatttattctcattggtttgaaagaacttattcatttctgccttaatttccttatttatccagcagtcattcaggagcaggttgctcagtttccatgtagttgtgtggttttgagtgagtttcttaatcctgagttctaatttgattgtactgtggtctgagagactcttatgatttctgtttttttgcatttgctgaggagtgttttacttccaattatgtggtcaattttataataagtgtgatgtggtgctgagaataatgtatattctgttgatttggggtggggagttctgtagatgtctattaagtccacttggtccagagctgagtttaagtcctgaatatccttgttaattttctgtttcgttgatccgtctaatattgacagtggggtgttaaaatctcccactattattgtatgggcatctatgtctctttgtaggtctctaagaacttactttatgaatccgggtgctcctatattgggtgcatatatatttaggatagttagctcttcttgttgcattgatcactttaccattatgtaataccattttttttgtcctttttgatctttattggtttaaagtctgttttgtctgagactaggattgcaacccctgctttttttttctttccatttgctgcttggtaaatattcatcgatccctttattttgagcctatgtgtgtctctgcacatgaggtgggtcttctgaatacagcacactgatgggtcttgagtctttatccaatttgccagtctgtgtcttttaattggggcatttagcctgtttacatttaaggttaatattgttatgtgtgaatttgatcctgtcattatgatgctagctggttactttgcccgttagttgatgcagtttcttcatagtgtgatggtctttacaatttgttatgtttttaccatggctggtaccagtttttcctttccatatttagtgcttccttcattagaagctcttgtaaggcaggcctggtggtgacaaaatctctcagcatttgcttgtctgtaaaggattttatttctactttgcttatgaagcttagtttggctggatatgaaattctgggttgaaaattcttttctttaagaatgttgaatattggcccccactctcttctggcttgtagggtttctgccaaatgatccgctgttagtctgatgggctttcctttggggtagcctgacctttctctctggctgcccttaacattttttccttcatttcaaccttggtgaatccgattattatgtgtcttgggttgctcttctcaaggagtatctttgtggtgttctccatatttcctgaatttgaatgttggcctgtcttgctaggttggggaagttctcctggataataacctgaagagtgttttccaacttggttccattctccccatcactttcaggtacaccaatcaaatgtaggtttggtcttttcacatcgtcccatatttcttgaaggctttgtttgttccttttcattcttttttcagtaatcttctcttcatgctttatttcattaagttgatcttcagtctctgatatcctttcttttgcttggtcgatttggctattgatacttgtgtatgcttcacaaagttctcgtgctgtgtttctcagctccttcaggtcatttatgttcctctctaaactggttattctagttagcaattcctctaaccttttttttaaggttcttagcttccttgcattgggttagaacacgctcctttagctcgtaagagtttgttattacccaccttctgaagcctacttccgtcaattcgtcaaactcattctccatccagttttgttcccttgctggagaggagttgtgatcatttggaggagaagaggcgttccggtttttggaattttcaggctttttgtgctggtttttcctcatcttcgtggatttatctacctttggtctttgatgttggtgaccttcagatggggtttttgtgtggacgtcctttttgttgatgttgatgctagcagtcaggaaccctctgctgcaggtctgctggaatttgctggaggtccactccagaccctgtttgcctgagtatcaccagcagaagctgcagaacagcaaagattgctgtctgttccttcctctggaagcttcatcccagaggggcacctgccagatgccagccagagctctcctgtatgagggtgtctgtcaacccctgctgggaggtgtctcccagtcaggaggcacgggggtcaggaccccacttgagaaggcagtctgtcccttagcagagctcgagtgctgtgctgggagatctgctgctctcttcagagccagcaggcaggaacgtttaagtctgctgatgctgcacccacagctgccccttccccgtggtgctctgtcccagggagatgggagttttatctataagcccctgactggggctgctgcctttctttcagagatgccctgcccagagagaaggaatctagagaggcaatctggctacagtggctttgccgagctgcggtgagctccgcccagttagaacttcttgacggctttgtttacactgtgaggggaaaactgcctactcaagcttcagtaatggcaggtgcccctccccacactaagcttgagtatcccaggtccacttcagactgctgtgctggcagcgagaatttcaagccagtggatcttagctggctgggctccgttgggggtgggatccactgagctagaccacttggctccctgacttcagtcccctttccaggggagtgaatggttctatctcgctggtgttccaggtgacgctgggatatgaaaaaaacgcctgcagctagctcggtgtctgcccaaacagctgcccaattttgtgcttgaaacccagggccctggtggcgtaggcacccgagggaatctcctggtctgcatgttgcggaggctgtgggaaaagcatagtgtctgggctggaatgctccgttcctcagggcacagtccctcacggcttctgttggctaggggagggaattccctgaccccttgtgcttccggggtgaggcgacatcccaccgtgcttctgcgccctctgtgggctgcacccactgtctaaccagtcccagtgagatgagccgggtactgcagttggaaatgcagaaatcacccaccttctgtgttgatctcactaggggctgcgcacctgagctgttcctattcagccatcttgccagccacttctttggtcaggattttaaagatgaataattcctgctttagtttctaagctgtattaaaccctagatattctattgaaaagctactgaaagtaaatcaatatatatgaattcacataatccataatcttacaatagcataaaatccttaatacagtactggtttagaaacccagtaacatctcttatcaccagtacataaacattctattaaaaatataccgtacttataaagtatggagtgacactcgctataatatggcctttgatagacatattttcagatattaaaggccaaatcatatgcttttaaacattgcaattgcatgctttgtaaactagataaaaccctggttactccaaataacaggaattagcttcatatttaacccagatttatgaaggattaaatattttttctttgttttttcttctccatcaaaggcttacttaatacacatagcatttttacaacaacaacaatgaaagcctccacacggcaattcatttgtagttctttaacaatgcacaaaacattaataaattttcctcttcctactataggcagtataccttattcattatgaagatatcacaagtttattcagagttgggagagcttacatgttttgaatgatttttaggatcgccctgttcatgttggttctatctgctcattcatcccctaattctataagaaaagataagttttccttacataactcatatataagaaatcaagtaaggttgacttgactcatataaatgggaagcataacaaaattaatacaataagaagaaaactttagaaccaaggttaagaagagaaaagcaataagggaagatagttgcatgaacatggttgcaagtatcttgcttgccaaagtgaagatgaaattctaatacattatatcacatttcacattatctattcagaggaaatatgcttggcttcctcaatgtcaaattctaacatagcgtttctttgacaaatttctcaaaaaaacccaaagccacagggactgaggatggtaagcctaaaaaggtggatttgccagttttcttcttaaaactttagatgtgaatgctgaagataaataaggatggcatcgtcacttcatcataatttctagcctactacacacatcattaaatcaatctcaatttgaatgccaaaaaaggtttaatcaaaacatttcattgtaggaactttaaagaaaaaactcatagaatccctgccctgacttttcacagtaagaaatgcaagttaaaagtttgacaaaaatgcgatatgcataactacatagatgcgacagatttgcatattccaagatggcagcctgggagagttatttacagtgtatgaaaaactgtgttcagagtcaacaggtaaactaagaacagtgaaatattcctggctcaagaaggacataccacttttggtacagagaaactatggtttatagtctgggcgcagtggctcacgcctgtaatcccagcactttgggaggccaaggtgaacggatcacctgaggtcagaagttcgagaccagcctggccaacgtggtgaaaccccatctctactaaaaaatccaaaaaaaaaaaaaaaattagccaggcgtggtggcacatgtctgtaatcccagctactcaggaggctgaggcagagaattgcttgaacccaggaggcggaggttgcagtgagccgagacagcaccactgcactccagcctgggtgacagagtgagactgtctcaaaaaaaaaaaaattaaaaaaagagaaaccatggtttattaaaacaaaaacaaaacattaaaaaacagcaatctggccgggagcggtggctcacgcctgtaatcccagcactttgggaggccaaggtgggcggatcacgagatcaagagatcaagaccatcctggccaacatggtgaaaccccgtctctactaaaattacaaaaatcagctgggcgtggtggtgcgcgcctgtagtcccagctactcaggaggctgaggcaggagaattgcttgaacccaggaggttcagcgagccgagatctcaccactgcactccagcctggtgacagagtgagactctgtctcaaaaaaaaaaaaaaaaagaaaacaacaatccacaaaccttttcaccttgggattgtcctgaagaacaaaaatcttgtatccagactacaggtttaaaagttattctactttattaaagcctttatatattccacttacagatctatgtggaacacctagtaattcaaaaagttattcctattccccattacaaggaaggtagaatatttgtctagtcaaataagcactggtgctattttcagtaaagtgaaaagtcatgatcttgcccttaaaatatttgataagcagtataaatcatgaattttaaaagtaaagaagcatttaaaacttaaatttgattctactgttttttcctatggaagctatgtttggaaggctgagattctcttagtgagcaatatagtcaatattaatattgtgtttccatttattaatttaccatgttcaccacccgcagatgatcagctagcaataatgccatttccataaaggccagggacttagtcattgttgtttcacccattctttaaatccaaaagccacatttgctaatacaattacagaatgctaaatctcacagaaacacatattacttagtttcttgaataacaagttatttaacacataagatcagaatggagggggggtactatgatagagtgtctaggggtaaggaaaatgaactgatatggatatataaaatgttcttctagctagctgcctagttatcagtgctgtaatccactttgggaggccaaggtgagtggatcacctgaggtcagaagttcgagactagcctggccaacatggtgaaaccccatctctactaaaaaatacaaaaaaaaaaaaatagctgggcatggtggtgggcgcctgtagtcccagctatttgggaggctgaggcggagaactgcttgagcccaggaggtggaggttgcagtgagccgagatagcaccactgcactccagcctgggtgacagagcgagactgtcgcaaaaaaaaaataaaataaaataaaataaaataaaataaaataaaataaaaaaagagaaaccatggtttattagaaaagttccctacagcatgaatcctctgagggcttaaattgctgagtggaaaaatgggaagagtggtttcaagtacacttctactttttttctgaaataaattttagttaataaaactcattctttgtaaactactacccccaaagcttcagagtttcaaacccagtgtcaataagatgcagtggagaaaaatgatttatttccactgcaaaattaaagaagagctaccgaagggagataaatatatatgaattcatgtaattcatagtttgaaacacgcataaaatacaacacagattcaaaagcccaatcacatctactattaccagtacataaaaattcagataagtaccataacttaagtgtatatatgtctgagaaagatagatgtgctgggttataaatataatttttcgaaaggtatgtttaatgtttatatgttttgctatcattgggatcagaatgagagttttaccaatcagggtatggaaaatgaagtttgtcttaagaccaagaacagataagacagggaaactaaaaggaataccgcaaatagggttgggtgaaggccagctgatacttgaactgttatgcttttagttatttttaattattaaattatgctgtacacattctcttctccatccatactcagtatcttacaaatgcacctgtgtgacaagtatggctaaaaatgaatcccttatgtctgctctacagcctatctattgagcaatttaattgacatattaactaatttagttccactgggacattttcctaacttatttctcatttttggagaagtctgtcaaaaaattagtccctatatttttgaataaaatcaacatatttaatgcttttaaaatactaggtaatacatttcaaaacccttagttttccagtacacagcaaggttaacccttactttaaatgttagacatggggtcataaaacattggggtagaagggattttacaagtattagagtcaaatttttaatcttttctttttaaaaattttacctactattttaatgaagagctatgcaattcaacattagaccataggcttcatgaaggcaatgatcaagtctgtttcttttataactacctgtccagcacattatataatgactcataaacagttgttgagtgaataaatgaaggtacctaatgagattcctcatatgttgctggccctgggctagcagcccaaagatgtacagcatgatccttgctcttagcaacttcactttctctgggagaaaaaaaaatgcataagcaagttgctacaatatatgtgaaatttaagtgtgacaatttagcatgcttggtgatctatgagagtaccaactgtaagcagtttcttctgcttggtgggagttgggggttgtagacactcaggaaagacaacaaagataggtaacattttggctggtccttgagggctgaaggagaattcgccaagtagacaacgtagggggatccagacagagagaacagcatttgcaaaggcagatatatctatatctatatctatgtgtatatatatgtgtatatctatgtatatatgtatatatactatgtatatatctaactatgtatgtgtgtgtgtgtatatatatatatatatatatatacacacacacacacacatactttacagacacacacattcaatacactctgcccatatcacccctttttcccaaatatgccatcacatatatatatatatcatatgggcagagtgtattaaatggtctggagaataggagctatggctgagaaggtaagtcaaggctaggaagaaaagggccacgtaatctccttattcattggatttcattctctaggcaagtattctcccgcaaggagtttggattggaattggaagaagctgggtaatgcaggaacatcagcaaagaaaccattcatccatccattaattcaccaaatgtttaaaatgcagtatctgagatatgccaggcacacagaggggtgaatgggatttaaagatgtatactgttatcatctaagtaaaagatgctggggattaaaaaggacattggttaaaagaggagagaaaacacaaaagagctattctgaggtaacatgagccatcatgtgccatcagtgaaaatgcagaagggtttaaggatgaacctaaagtttctagcctggaaaatttgttggatgatgattcattaactgaaataggaaacaggaaaaaaaaggtcagataagaggggacagaagtagggaaatggaaaacaggagaacaaatgaacttggtttcagaatagttgcatttgtgatcgtaatgccacatggattcagagatcagaagagagatgcggactagagatgtagatacatcaccatccaggccatctcaaacagggagggtttaaacaatcaaaagagaattaggctaaggttagaaacttgggcacaacagtatttgaggggtggctaggagaagaatctagaaaaatataggaagaagaacatggatggaacagttccatgaaagccaaggaagaggacaacttctagaatgaggatgctgagatgctggcaaacatgctgagtgcatgagggaatttaacttcttttgaattttaatctaggaggatttttgtgattttgacaatagatgagtagttgctgatttcaaaatgatactcctaaatatgtatttttttctacagaatatatttgccatctttgtgccacaagggaatttaactttggtcttatagacagtggtcttccaaatatataatgattttccctcatttctgcagtgggccaatgaaacttgaaactgtattacaaatgttgccttccaagggaagggcaacacattaacagccttatttcaccaaaccataacttacccaagtcatgtaatttggttagcaaaagggccaacacctagactcctggcttttgattaagtgttttatttttctgtattctgatactaagtaacacaagcaatacaccaatacacacacacacacacacacacacacacacacacatcagactttagtacaatcacttaatatcaaagtcaaagtgatttcttgccctgtaactgttttaatatttcatttcatataactgaagacagacaaataattagatcactgtcttctcttggagaaaataccatgtgaatgaagactgaatttgtgaaagacggactgatttctctagctttaactttgtgggaagataacactgcactcaagttcagattagaagctcttttgagtctctcaaagggccctgaagcaaagaagtagacggtaccttgactttctcgaggtgatcttggagagagtcaatgaggagatcgcccacgggctgccaggatcccttgatcacctcagcttggcgcagcttgaggtccagctcatccgtggcctcttgaagttcccggagtctttcaagggtctcatctatttttctctgccagtcagcggagtgcaggttcaatttttcccactcagtattgacctcctcagcctgctttcgtagaagccgagtgacattctgggctctctcctcaggaggcagctctaaattggcaatatgacaaggttttaggccacattctttttttttaaacattgtcaaaaaggtcatactggaagaaagaaagagtacagttgaacaagagggtaacctactgattaacggcttttttatactttggcataaattttgatacagcccagaacatctaaagtatatcttcctgagtttctaccttatatcaatccgacaatttaagattcacttaagctattgaggagaaaaacgttaggatgcataccacaagctctaatttacttcaggcaggctcttaaatggaaaattaacttgtagtctttgcaacaatagaattcctcctcacagataactccctttgtttattattttctaaatgttccaataactgattgctaatctcttttgatgtttatttatgaatgcacaaactgatttatgcatggtagtttatgagtccttatttttttttcagcatctatgtttaatttgaattgattctatttaaccaagaaaatatgagagctatccagaccctggcagcaagaatggatgggctgctccgtcaccactgatccttctatcaatatgttattatagttccacattcaattacctctgggctcctggtagagtttctctagtccttccaaaggctgctctgtcagaaatattcgtacagtctcaagagtactcatgattacaggttctttagttttcaattccctcttgaaggcctgtgaaatgagatgaaaagaagtgcttatttggcttgtggcattcttctcaaaattaatcctgggtgctcagaacttgtttatgaaactcccaggtcaatttctatctcttttatttatacactgatggttataaaatgattttttttaaaggctatatgggtctatctgttaatgaggaaagcgctgtgtttgtaaagctattctggggagatggggggagcattctggatagttaatgccctctcattgagataagagtgctttgtttatgtaacctgacagccatacttcaaatctacagctaaagtttcaaggtatatattgcaaaactctagcatggctaatgaggacttaaacataccccaaatagtggatatccagaacataatgggaagccttaagggccatttgcaggaccttaggctatattaaagtatacaatgaatccaactgacaatcaccagttaattctgtcaaaatgtctgacaaggtataaaataggtaagctaagagaaaagtctcaatacttttgaaaaatagtcattacatcatccattgtgacctctttgagaatagtagaaatgttttgagctattatggatgtaggaattgcggacactagtttctataaatgaacagatctagaattaatctttaatctgtaatcttcctttatccaggggatcaagagaaaaacaaaatgaatagtttctgccttcaaaaagtttctagatccaaagaagggagaaaattaacactagaagcagagtgaaaacagtaagttcacacataatcgagtgctaaaaggatcgtgaggtataccgtgagcctagaataacctaacggatactctgacaccattgaagagagttattgacccagattctttgatctcagaagtgagggtattaataaaagtattaagtgcatgctacataaatgctaatataactgtttaacaataacagtaatatttgccctgatctagggcttaatttttgtaacttttttcaactctgtcttttagcaatgttgcctgctgaatttaagccctgttctttcactggggaaaaacaaattagcagtattcttccttgaatttcagatatgccattatgttacagaagtgttccagagctgtattgtatgacacatttattaataaaatcttagcggtgttcaccattcaaaagaatcctgagtctgatactttgcaaaatgattcatcatccacagctatttacaattcaatagagaaagggaaggcgtttgaaccaaaatactggagttctgtaagtagaatattaggattcagcctacagatagggaagtactttctgaataatgggatatttctgtaccctaaaatcatgctagatacgtgagttatttactctgcttacatataaagctgattctcctgatatttcacttgaaatctccatgtttgtgtgtgtgtgtgtgtgtgtgtgtgtgtgtgtgtgtgtgtgttcagttgttgtattcttgtgttttttttcatacaattaagtttcccaaattcaagtaaattatcattttgcctagtttctctgtttggacctgaagggaggcaattaatactgacattactaattataaaaataataatggctccctctattgaactaccatgtgtcagtggttgtacctgaaactggaaatacaaagttgaatgcaaaacagccctttctatttaggaatatttaacatataatagaagagtcagacacgtaaataatttcaatacaatgtagacagtgctatagacttgcgcaatatggggaagaaaatcgggaaaagcttccaggagaagctagtaatcacatagaattcaaaagcatgaacatgacttattcaaggaagagtatgctagagaacattccaagaagaggaaaatgcaagtgcagagtcataggacatagtgcagtatggtatgtatcggaatctcaagcaggccagtgtttctagagcataaagaacaaggagagggcatgtccaaagatgaaaaagacactattgctatctggaaatacattagatttttaaaccagaatttgaagctctgcctctctatgatcacatatggtccactaagaggcttaggtgttgccttgaaggtaatcaggaacctttgaacggttttaaccaagggagtggcacaggaatatgtgtgcttcaaatagatcttcctgatataaatacagagtatgtatttgagaagaacagaaatggaatcagagagataatgaggcaattgtaagaattcagtgcaagattatgaggatttgactcagggcaatggtaccaggaaaaatgacagggataggatagggaaatgtctaaaaatctgaagtgtgaaaatttggtgactgaatagatgctggagagaagagagaaaaagaaacaagaatgacacttagtgtctaggttgagtagatgagcaaacgctgggtgcaattcaactaagtatgaggaaataaactttcctggatgtctcagttcacctacagaaagctctagcctcctgagaaacttcccacaccatggagattagatctgtagcaatttgtctagttcatttctctgatccaagagggtcaaacggttatagctcagggtaggttcctaagctgaactctatgttgttagaaagactggagtgggtatctttctaggtatttacatttcaaaaaatatgaagcccataccttggagacatttccagattgtaaaacatgagacacacagggctagctggtttctgcagaagctggaattaggactcaggcctgttatgtttccacagagaacctttcagaatgagagatggatagcagcctccttctcctttataagcagaaaaaatgatttttcctagtctcccacttatggagtacccagccactcaagtaggaaaatgtttcatcagcgttcatcatgttgccctaggggtaagtctttgggcaaaggaagggcacagcaacaatatttactgtaaggtaattaaatgaaatctgcctctgattcagaacccctcatgctcattcaggataaaattattgaagagtaatattaaaaatgcaacatgatggtgtgtgtgtgtgtgtgtggggggggtgttctgtgcatgggggacagagtaagggactgtgatatgctcagcttggaaagctaacattccttccacaaggaaataataaattctgaggtttgaggagaaaaaaaatacttaggagttattttctcattcagctaatatacgttgagtgcctacatatcaaagtttaatgggcaaacagaggaacaggatctcttgagagatagaaaaggaacaaataggtggagagattaggggaaatgaggagtgtagaaatttcaaggagagagtgagaattttgagaggaagagggtgaccaagtgagtccaatgaaacacagaagtaaagtaagatcagcattgcagagtgttcactagatgtgctgagagcaatttcagtggagggcagaagcctcagaagtaggcatagctgaggagtgagtggaagaaggagtaggtatttcaagtgaaaatcaaatgttcaattttctttttctgagaaggaaaagaggaagacacgacaggaggacagagaggataacaagacaaagggataagaagttctttttagcataggaatgatttgaacctagagtgaaagacggaagctagcagtagggtaaccaaccatcttggtttgtccagcattgagtttttcaggatgagagactttcgatgttaaaaccagaatagtttcaggaaaattggacagtctcaggaaaacgaggaaagttggtcaccctagatatatgttacgaccttgacagaaggtggagataattgttggaacaaggtctgtaaaataaggaaatggatcttttttttttttttttttttttttgagatggagtctcgctctgtcgcccaggctggagtgcagtggcgcaatctcggctcactgcaagctccacctcccaggttcatgccattctcctgcctcagcctcccgagtagctgggactacaggcgcccgccaccacgcccagctaattttttgtatttttagtagagacggggtttcaccgtgttagccaggatggtctccatctcccaacctcgtgatctgcccgccttggcctcccaaagtgctgggattacaggcgtgagccaccacgcccggccggaaatggatcttaaaggtctcatcaaacttaaaaacttaaggcactaaaaacttaaaaagtccaaggcactatttgatgatataattccattgttaaaactggacagtaaataattcaaagctaaggagcatccattgtgagagaccacgtgtttgcccatcgagttgttgccaaggacttagatccaccacagctgcacagttcatttcttaaatatgagtcattgaagattaaaatgaggccaaagaaaagacaaagaaagttctgttattacaaagacataagcaccattattttcacattgttgcctgaaattaagaaaagaaagtggatggaagagagggttaagtgattgtatctttagaatttcaaaagattcagattaaatacaaaaggataaaactcccacaaaaagagagaaatagttggttcaaggaggtcagaggttaaagaaaatggcaataattcttatcatgtgggaaaaactataaataacaatatgtaattttaaacatggttatatgtaagatcctctttaatttagtcacttaacaaacttcaagcaactactatgtatcagacactgttctaggcaatgaacatctgtggtctttgtagcatggagcttaaaacaaatggctttatgtagtaaaaaaaaagcaatgtagaatctgcattaaaataatggaaagccaatttttcagtatctaataactcaccataaactgcatgttgtagtataatttattgcattttaaaagaaagaaaaatgaagacttttttttaaaaaaagacaaacaagaatatttaatgtcaagagccttgattttgataagtgtcttgtctcccaaaaaggcctgtttgaaagaggtttgagaaaatatatactcatatatactgattttgtcatataaattttggttaatattttaaaccagagaagtcagttcctttatgtgatgatagaaaaggtatcagatatagatattttctcccatgtacatacagaatacgtatttacaatattcagatgttagcattcagatgttaagataattacttcctgaatcccttgaacagataaaattatctttgttaaaacacatcctcttccccatacctttcttttcacctttccaagacagccagacccaagggtccaaaatagtgatatgagagaattagaagcaatactaaagacgtagagcacctctatgaaaataaaatatgcaatttagaaaatgttaggaatactacacagatgtttgtccttgagcttcttaaggttcacaaaataaacttatatgaagtatgctactacactattatagcaatgataatctcaagataaatctatttattatgaaggttgaattatctggtagattgcacttaaaacaccataggtactggccaaccgggtgactgattgttgactcactaatttgttcattcaaaaaatatttattttgaacctattaggtacaaagttaggaaagatatagagacttaatctttgtcattaaggagccaatagtttggttgagtaggtatatttgtggtgtatacttttatattatgaatgtttcatccatgcaaattgagatacagataagttagggtttacctaaggccatcagttaattacacactttgaatctaaatcttgcaattctaaagtgaagctgaaagtgagtgataacaaaacataaaatctccctgacttagaataatttggaagccacataagtggaaaatcctaatggccatggaagaaatcagaaacttaaaaaattcctgaaagtaatagagaagaaccaagttattgattattattatttttatttatttatttatttatttttgagacggagtctcgctctgtcacccagtctggagtgcagtggcacgatctcggcttactgcaacctctgcctcctgggttcaagtgattctcctgcctcagcctcctgagtagatgggactacaggcacgcgccaccacaccctgctaattttttgtatttttagtagagacggggtttcactatgttgggcaagctggtctcaaactcctgacctcaggtgatccgtttgcctcggcctcgcaaagtgctgggattacaagtgtgagccaccacacctggccactgattatttttttctgtccctcttgcttcctgcttatattataaaaatatctaaataatgccataaatagaagtagctcagaaccacgtatggaggggatgaaaggtgagatattgatttgcttcatgagaggaacaagaggagaactctgggcataggtaatgacatgacagggagaaaagctatcttgctttctcctggggacagtggatttaggatcatattactatggatgtgagtaaaagcccgtgcttttcaaaacacagatgtctttcaatcatgtacagcttgcctggcgctgaattttacctgtattcatattgaaatggtaaatttgtgtttttcagaataaaatctgatggaatgactagaaatactacccatatttgtaagcagaacttcctagaatcatcctgggaggcaggctgaagtggtgaaaagagcactgttctgagtggcagaagccttgggcttcaagcctgggctgggccagaacctggctgcagtgatccagaaaaggtgataaactcttcctgctcctctgtgtcctcatttgtaaaatgtgggcatttgctaaaaccttatctaagttctaacatccagttctcatatactataatcaatttgttaagatcattaatcggccacaggcctgctctatggtggcagtttgagagtctctgctaagcatcgttattatcgatgcttaaaaaccatagccatagcttggcatatagtaaatgctcagtaaacattgttgactaagatacagaacacccagttagaacactagagtgtgttatatgaaggccaagttgatttagatgcaaaacaggcttgcaggggaaagcctggactcatgaatcataagtgaaaaaattaatgctgtaaattgggaaaaatggacagatcttattctaggtctactcatgttccagatccaaagctgagtgtcactgctgagttactgggtggaatttcctcaagaagtggtcccattagcattgccttcttcaacctagtgatttcttaaaggagattttcatgtccaaacactcagaagttccatggtttgaactgctgcttggggctttttctgtagtctgcaggattaggtaggagatgagaggacactagacaggctctgaaatgtaggatgatccaacagttctgttcattcaacaaatggataccgagcaggcatagaacaagatgttaacagtcatatctgtaacttgatctgtatttactagttttgccatcctacgtcatcattcttgttcctgtgttatttctaccttattttttatgtctcctgtattgtttctatgtctgacaagaaagttgctgaatatattctgtcaccaaaaggaccttctttatttaaagagccaccatatttattgagtctcaaacacataagaatattttaccaaatgctcacttcgggacaagcaatgctcagttaacttaaaagcgaggtcttggaaaagggcaagcaatccaggatgtacatggcagggtggcaagaatattgcccccagtaatctaaagcaaattcataggggttcatggaagaaaaaaatttgaagaaagaggcaatggagcaaacaacagaaagagaggtttcccttaatagtcatttgagacagctagtattacagaagttatgaacatgggtatctgggctataaagaaaaggccataatcatcttttcttattgagataagaacacttaatatgaactttaccctgttaacacatttttttttttttttgagacggagtctcgctctgtcactcaggctggagtgcagtggtgcgcgatctcggctcactgcaagctccgtctcccaggttcacgccattctcctgcctcagcctcccgagtagctgggactacaggtgcctgctaccatgcccggctaattttttctttttttgtatttttagtagagatggggtttcaccgtgttagccaggatggtcttgatctccggacctcggttaacacatttttaagtgcacaaatcggtattgttaactataggcacaatgttatgcagcagacctctagaactttttcatcttgcataactgaaactttatatccattgagcaacaactcgcccttacaatgtatggcaaccatttttctactctctgcttctatgagtttgactaaataatcatctaaataagatgacaaaaagctccgccttattttcactccacttctgaataaaagtgaagataagggattgaagtatcagatacatccattcattgtttcagatagtcaacaacatgaacaacaatattaatttataaatgagattgaataaatttgatgtaaaattgaaaagtaaatgaacatatttcaggcctgaaattatgttttttttttaaaaatctaattatagtcaatgaaaaaacatttttgagtgtataaggggaaaatgtgtttaacaaactctgtgttgagatttatttttctggaagtctttgaaaacaaagattgtattctctgagatcaagggcacgggctagaatagtccagcctgcttgcaggtctgtgatactatggaggaatagtttactgcgcacacagcatcttgaacagctgtttgactcttaattctaaggctgggctgcttccaacaatcactggggaagttacttcctactgacaataatgttgttaagttctgagctgaccttgagagatcactggtgaaaactcaatctagttcccgtggccatttagggaattaggtcttaggtcattaagcctaaactttaagatttggaaattacttctgaaatgttagtagaaatgaatggattattagaaaaccctgtgacaaattaatttgtgtatgttctcaagatactgagccaaaatttgagattgtcaagtataagtggtaaataatatctgaatcataccctttgtgtctgtctatcaacataatccaaaaatggaaccctggttcattctaagcacatacactcaaacgtgatcattcccaagtctttctcagatggcaacatcattattttatttgttcaagccattgacctcagaattttccttgactctttgcttcctctcaaactccacattctatctatcttaagttctatcaattctaccctccaaatatatcttcgatcaaataattattcaccatacctatcatttccactctagtccaagtaatcatttccttctgagatgactccaccaccctccttttctgtgtcttcagtttcgctctttttatagtcaattctccatagcagcaagagtcaacttctaaacacataaatcagatcacatcatccctgctgagagccttccagtgatgtttccttacttccagtgatgtctctttactcacagaataaaatccacctccaaactatggcctgcaagaccattcattatctggcctttccctctttctagaacctatcactgtctactgatcttatttcccttgagatacacagctcatcttgctatttctacaacactcaaaacctgttcttaccattgggcttttgaatttggtgcttcttctgcctagaatcctcttcattcaaggtttttgcatggtttactcactcacacaggttttgtttgtttgtttttttgagacagggtctcactctgccacccaggctagagtgcagtggcacaatcttggttcacttcaacctccgcctcccaagttcaagcgattctggtacctcagcctcctgggtagctgggactacaggcacgtgtcaccacgcccagctagtttttggtagaaacgtagtttcactatgttggccaggctggtttcgaactcttgacgtccagggatctgcctgtttcagccacccaaagtgctgggattacaggcatgagccactgcacccggcctcacacaagtctttaccccaaaataacctcctcacataggccagtactcctcaatctttctctattcatgctttgtttattttctcttcatagcacttactacccaacataatttcatatattaatttatgggtttactatgtatttctgtcactaaaatctaaacatccataggggcagagactcattttgttccctaacatatgcttaacatagagtaggctcttcataaaaaaagttcttgaaagaaccaataaattctaggaatctgagttatggtataatttttcctaaaataatgtttttgggggacaaaaggaagagcacagaaaaaaatcaaggggatcatttgtaattaaatgaataatgtgtgtaaaagtgctttgtcaaggcaaaacactatgcagatactgttttaaagagtatttgtcaggacatcaaaatattttgacaaagtgagagagaagactggtagagaagtcagtttgtaaattattcacatctcatcttgttacagtcattaaagcaaagcagcaattcctagatgactcagttcttcagttttgatgataaagctagttttcagaagacttagacttagttttcagaagactcaaatgcctagaaatgcagttctaaaaataatttttaagtcatttctattcagcatccctaaatatgactgcataggatatcaaacttatacaaaaatgatgaagaatagatcaaaaagacgtctatttcctccaacgcggctaaaaagacaccttagagtagatataactaacagtcaagtggtttagaaactctaagaggccaggtcattgaatgttagaatgaatcactctggccgggcgcggtggctcacgcctgtaatcccagcactttgggaggctgaggcgggtggatcacgaggtcaggagatcgagaccatcctggctaacacggtgaaaccccgtctctactaaaaatacaaaacattagccaggtgtggtggtgggtgcctgtagtcccagctgaggcaggagaaggagaatggcgtgaacccaggaggtggagcttgcggtgagccgagatcgcaccgctgcactccagcctgggctgcaggcgagactccatctcaaaaaaaaattaaagaaaaaataaataaaaagaaaagaaaaaagaatgaatcactctatcgcaacttttggttgtttttcagaggtgatagggaacaacgcatttttcttaacacagagctgacttaaatcttaacattcacaaatgacatccaaagatattttctctttctgtaaaaagaaaacacagaaaactcgtcaagctaacatacatactaaaatgtatcccacgtaagcaggccagcactgataacagaatgagcctaaataaatgtataatctacaacatgatttcaggataattttattgaatttctcagcctgtctctcactttgtggtgacttctgaagaaatcgaacatgcataatatatgacctgacaaatgaacaagtaaactactttattcaagccttttcatttgtcaacagcatccaagcaataatggctttctgtccactcttttaataatgtatgtattgattacttccatctaaatcttaaccagaaaatctcgggaagctttgaaggtatccttaatgatctctagggaagggattatagagatttttttaattgaaagatgaaaacctagtgacaaacaatttcattagtaaaaaggcaaacaaaaagtcattacctacactgttgttacaatcaagatctaatctccatttggatttggggtaggaggaagggagttgaataagctgatgttttattgcagttctccttagaaattccccactatgatttgctcctttaaaactctctctaggttaatcacagaagtagacaagtaataaatatcactttagtgactgctcaagtaaaacaaaggaagtcagtttttaaaatatatctggaccagaataacacccactaattgaaaacgagtcagtctagtgaggcaagtaatgaggaactgtaaaagccaggataatgtattcaaaagacataaaaattggtcagtttatatttgctaaggcatatttgagctttaattatttataacacttcaccgcatctggagcattattttattaattagtcttgagagccattcagttgcagttgttatgctgcccagctggtttggggagcacagatctactcccatgggtgtgaaaattgctttgaggagtgagactatggtccccaaatatgtctgtggagtatcttggaattttacctacagaagaaccatatatctctccatgacagcaattgatattgactgtatattttctctacaagaaaagagtacaagatatgtaatattttgctacaaaatattatcactaatctgaaatggtatacaaagaaaaacacaaattacctgttttgtaaacatcctgatttatagaaaatgaaagtgaaaatgaacaacatttgattttagtttcaactattgacattttaatgggatttgtatccccataaaaagcatcagcaaaggatattaataatttagaatagagagtaagcagatgactttttaaaaaagtggcactctaaatacttgcggaataagtttacaattacagtgacccatcttgataccaaggattctatacaaacaacaattaaatcaagaaacccataaagagcaatacaatgtacaattctggaaacatggcaaagtaaaacaaaagtccacaaatataagatctgtcaactattagatcttgatggaattttgtactgattctgttctttttctctttttctaactgagttcaggagatctgatacgcagatccagtttcaaggattttccattgttcttttgcccataggcttcaagagcatcactaactagacagtccatatatgaaagggctaccacatacatgtgacaaaactttgagtcaaacaggctactaaactgttctctcatcagcactcaggagcgatgatgttgtttgaggaaggagagtgttttgtgtcaagaatttttcttaaagataccaagagaagcttgaaaaagcattgcgccaaactacaagtaaaagctgtatgtcgtatgtttattgaagcaccattcacaatagcaaaggcgtggaaccaacccaaatgcccatcaatgatatactggattaagaaaatgtggcacatgtacaccatggaatactgtgaagccataaaaaaggatgagatcatgtcctttgcagggacatggatgaagctggaaaccatcattctcagcaaactaacagaggaaccgaaaaccaaacactgcatggtctcactcataagtgggagataaacaatgaaaacatatggacacagggaggggaacatcacacactggggcctgtcagggggtggggggctaggggagggatagcattaggagaaatacctaatgtagatgacgggttgatgggtgtggcaaaccaccatggcacatgtatacctatgtaacaaacctgcactttctgcacatgtatcccagaatgtaaagtataataataaaaaaaaacctgtgcatcaaagtagctctacacactttacaaaaagatgcttaattagaaataaacagaaaactcctgtaaataagaagggaataccactctattctttctttccctgctcttggtctcaatagccttcctttatctaaccagtgtctactgtatactaggcactttggaatgtgctgagtagaaaaatgacagctttccccctcccaaaaatcttcttgaaggacatggtttagcaagagtagtcgatatttatcaaatagtaacacatgtacgtgatgacaaacaacgctatgttatagaaaagtagacaattttagaagtgtgtaaagaaagatctggtcaaatgtagacaacagggaaaagtttgcacaatgtccgagccaagatgtaaaggattattagatgataaccaggatattatgagtgggtgggtataggtaaaagggtttgagacagaggaccaacatatttaaagccccacataagagggacacgcagaattggaaaaagtaaatggaggcagtatggctggcatccaaacagcaagggaagagcatctaggaaagaggaggctgaggccagacaagccagatagtgccttgtcacccttgttgaggattttggtctttttccaagagcactgagaagactactatagtgttaagataaggactgatataattggatttatgttttttacacagattattctgactgaaatgtagagattgcattgtagggtggcaagagtagatgcagaaaggttaggagaaatggtcttctataattatgatgataacaatagtagacagtcaaaaacaattttgaaggtaaattggccaggtgcggtggctcacgcctgtaatcccagcactttgggaggccaagacaggcagatcacgaggtcaagagatcgagaccatctggccaacacggtgaaaccctgtctctactaaaaatacaaacattaggtgggcatggtggcgcgtgcctgtagtcccagctactcgggaggctgaggcgggagaattgcttgaaccaggaggcggaggttgcagtgagccaagattgtgccattgcaactccagcctggtgacagagcaagacccagtctcaaaaaaaaaaaaaaaaaaaaattgacccagtgatgtcttggtagtggaaggctgaaggctggtcatccggaaaaggtactgtaccagacaactacattgttgtctggtatgagaaaatatttagttagagtctcggaatatttagctagagttttggagttttgtagattgcagcaacaaaaagataaagaagcaaagggtttcagacttttgaaaacaagttattaaaatttagatgattgaatctaagttgtatttggaaggaggtaaatatggaagggcagaggaactaatgtataaaacacagagtaatcaatgggctggaagtcctgtgaaattcacgaaaggttaacaggtagctatctgagcaagcacactaaccaagtggggacggattaacttcattctggtgagtatcactcataactctagcatcaccatctccccaagtcatgttctttgtcatgagattcctgagtaaggactgcgttaagtacagacattttaccactcttaacaagcaaccaaaactaataaccaggaatagtgaagcagtatttataacaaaatactggctggaagaaaccacagcaattatttggaccaatttcctcatattacagttgaagaacaaaatagcaatcagaatccatcttatgaagaaatatgactagaatctcagtctcctgactcctagtgcacatgtccagtgattcattttctttggtttctggaactagcataaaattcatcttttgtagaaattctgtctcatttcactatatcgcataatgcattttttaaaaaaggcccatccttctcaatgagtgcttttctatatgtacaccagagtgttttggctgtttattcaaagtcagaacatttaaaacacatagcaccattacatttcaccctaccacaaaagctaatttaatattcagaaatatatgaaggcaaatggctaaaggagaaactggcagtttccctggcatttttttttttttttgcaaagatccctgggtcttctttcatgttctcttccctttttataatttcctatatcctcttctccagaataatataaacccttgacctttcctcaagatgccacctttggctgtatctccacagagatctttcctttacatgctcaacatacaaaagtggtaccattttatcaagtttttattatttggtagtaatttgtttggtttgctattcatttctgttcttgtatcttttattctcatttccaaaacacttatcagtatccactctacaccagacactttactagactctagggtcttggaggtgaacaagacaaaatctctgcctttttcactcagagcttagtagagaagatagaaatgtaaataaaaataaaacaaacaaacaaagaaataattggtcatcgttggaggatgctagtgaacaagttgttattataaaaattggtaaaattgaaacgtattttgcttgttcggtatgaaaggtatactgagtaccaaaataggagacaagtgcaaaacatttttttcatagacctaccccagtgaataaatgaagaaggaatggtagagataggcaattatcacactgcaacccctagccactgatcgtgaacagctattaaacatcacacaaaaagagaaaacaaggcattatataccacctcctgatgatggaagaatacacgaacacctgtgaagcagtcttgccaaaaaaagccaaacccaaatacaatcaaactatagaactgcactgttcaatcggtagctactggcaacatctggctactgagtacttggaatgtaatgagcctgaattgagatgtgctgtaaatgtacattttttctattgattgcatgttgaaatgacaataagaattgtactacagttgcatgacatataatgatgaaaagaaacagggtgaaagatacagggaaactattctattttagaaacttactgtgaatctgtaattacttccaaacaaaaagtaataaaaagaccaactaaccaaagtaaggtgtgggtctgatttcaatttttatttaaaccaaaaccagaaaaagtttaaaaaatgcataatatgtatgagaaaaatggaaatttgaatatggactggatatttgatatgatgaaattattgatatttcaaaagcattatagtagcaaggtgattaccttaaaagagtgaatcctatcttttaaccttttgaaatattaacaataaaataacacacgcctgatatttgttttaaaacaatctgggaagagctatagaataaataagatctgacgtgatttgataattgttgatgtcttgatgagtacgagttttattatagcattctgtctacttttgtatatgttcaatatttttcatcatgaaaagcttttttttatatagccaaaagagatggacgatttcttaaagggtattattaacacaaatgtgtttgacatttacagtgtaatggcttagattatttataattgacccttgggtgagaagagtaaaaaagatttctattcaacttaatttcaaacaaaattaattttaaaatagtcactggattactatgtgcttaacatgtgcaaggcacgaggcttaaaaatgtcctaccctatgtacatcgttctgcttctgaactgctggaaagtcgcctccaataggtgcctgccggcttaattcatcatctttcagctgtagccacaccagaagttcctgcagagaaaggtgcagacgcttccactggtcagaactggcttccaaatgggacctgaaaaagaacagcagcgtaccatgtcagaatatctagaagtgtaattgatgattctaacaattccattgaaaaagtacaataaacctattgtgaactacaaagcagtcttgaataaaaatctggctacttacttttgagagccacaaaacagaggatagtttgatggcaattttgagaaaaggcagtgtttagccatatgtttatttccacatgcagaatgctgagacttttggcatgaaatacacactggaatctattgcttttccatactgttgtagtcaacaattcttaatatttctggtagaaaaaattggatgcagtgactaatgaaaaacacttcgttttcatgtgactcatgctagtactggaattctttttgccttgagaaatggaaaggtctctccccacattttgacttttccatttctacaccctaggcagccttttccattgagttcttccatctggcgtctgttcctttctgctcctcttcccaaatgcgtctcctttccccctacccttctttatttgtgtgcacctgggatttgtcttcaccaagtttcaacattttctgctttgtttcctttgtgtaaaaagtactaagacaacaactcacatggaagagtaaaatcagacatttatctgaaagcttcccccgaacatgaataatttaggcaggagactgagtgctttaccgtcaactgtatttagaacacgttaatccttagaagccatttaagaatacacaaatgaatgatctgtgctataaaatccacatttcacttgaagatgagaagctaaattaataaaataaatcatcatccagaaaacaaagaggaaacgcagtgttagcaaagctttatcttcaggtaaattagaaattatgctcaatcactcagctattatcagcaattactaattaattcataataacgctacctataacataaatataataaagactttaacgctgcaaagattgaaatgtaaagcaaagcaaccaggtggagcaacatttcccttagccatttggtaacttagcttgacattacaaatacaattctccttttggccttagtcaaacagaatcaccaaagaatacttatctactgaaattaaattgttccaaactttctgaaggataatttgacaatacataaaagtctttaaaatgtgcaaagacaatgacccacaggcttaaattcaaggaaattatactaacaaagaaattggaaaaagatacaaagatataggtggaaaaatgttatatatagcatcatttatgattgataaaacaaaacagaaacaacttaaatattcaatatgagggaattgcttgagaaatgcaaaaccccaacctactgattgttttcaaatgtaatgaaacttgtatatgctttaaatttagaaattaatgaaatttatatatgaatttaattaaatagctcttaatttaaaagggaattattacatatataatggtgcattcatacagtaaaatcctttgcaaggttcaatatgatgacatagccaaatatttatggatatggaaaaggtcatcatcccagttactaaatgagaaaacaggttacaaaacaaatacattttttgaatttttctaaaacatttgtgtatgtgtatgtatttgtatgcacatgcttgactaggaaaaaattttgtaatgacaaccaggttatccctcagaggtagatttacaggtgatttatttcttaatctttctacttttccaaattgtcaagattttctttctataattgcagtataaacaatatgtccaggaaaaatgaaggcatttccatcaaataagataaattaaattgttccagactctaagggtattatttcccaagaactgaatcgtgaaataccataaatgtcatgaattgaatataatagtgcatgcagattgcatacaattagaggtcagttcttttatgtttctgtaccatcctttcagttaccacttttccatgataagcctaagcgacaattccccatgcaagattttagctgtttaatagcatgtaatgtgtaatggttaaacgaattccttggggtgtctggaattcacagcttggtccctttgagagtgaaaagaggctgtcaagcaggacatattgaaaagtaggtggagagaggtagggctcagacatggaaaagcagcaaatggtagaaaagacactgattaaataaatatttattgactgcccctaagtctctaggatacattggggagtagggagagaggaagggaagagagaatataacgatgactaatgtttggcctctgtctgcctggtagaggaaacaaaatatccttgtggcagagaggtctagaggaggatatagtgaagggcaggctgcctatgttaagacctcaagctgcggctttgtttatgtaaggaagtgctaaaattccagttctaggttaaatggtgctgactcattattagtgggtcaatgaacccctttaggtcccctaagagagagcaaaataactgagacctagggaattcagttcttttttttttttttttttggtgagacagagtcttgatctatcacccaggctggagtgcaatggcacgatcttggctcactgcacctccacctcccgggttcaagcaattctcctgcatcagcctcccaagtggctgggattacaggcgcccaccaccacacccagctaatttttggtatttttagtagagatggggtttcgccatgctggccaggctggtcttgaactcttgacctcaggtgatccacctgcctcagcctcccaaagtgttgggagtagaggcgtaagctaccacacccagccgggaattcagttctaaaggatctaagagaaacttaatagcatgaaatagggaagttgttagaagccagggacagaggacagtcaagagagctaatacagcagcagaagacggacctggaacctcaaaagacgaaaagctctcacatatctgggtaaggggacttcctttaatttttttctaagctgtggagttagataaaatttcagaatgtttgatcatcctaactacatatcaaattgcttcatttttttcctctcctaaagctcaagagtgaaaggaaaaatgtgataggaggacaaaaactgaagcgaaaaacttacaaaggacagagaacactgagtaagaactgaagaggtgaaaggcagccagagaatgaattaaaacagcatatacaaatgtattcaacctaaagctctgggtctcaaactatagtgtgtataagaaacatttgagtagcttgtttaaaattgagattgctaggtgccacctccagactttctataattctatcaacaatctctgctttcaacaagaaccttcacaattccacaggtaagctccagaaccattctttgataaagcatttattaaagcatttctgatatgccccaaacattacttcttggtctccacagggcaaaggtggcatttgtcagtgacttgattttgaagatctaaatgtaaggaacattgtgagctcaaaacattttctttgaccatgttaagcccgtgaaatgttttcaagtcacatttctaatacatttatcggaagcagttgccctatttttattttcatgagtgtatataccagatattttgaaatgattaacctatgtttgcatgtggaatatctcctcctgaaaatgtttctttgtatttgtaatgacttttttttctggttatatcatacataggctgttggggttggaaggaacctgagagattatagttcaaccttcttgttttgcatatgtagaaatcaagattgcaaaggtataaaacagctgctgaaaaacataacttgagctgtcctatttagatatgggaaatagaaattacaaacctttgttagatgagaaaatccttaaaccttagtggttttaaccaaatgtttttgatctctgaacaaaaaggcttgttgctgttaaattaaattaaattgggcctaaagctgactctgtacatagcaaactgcaacccagcttggcatgtaagcaatatgcaacttaagagtacattcttgtaacaaatagctgagcctcagccaatcccagcagtcaagtttcagctaatcacaggctgtaaactgatcagctcatgtccatataaggcaaatgcctatttacactatgcccaagtaaggcaaattctaagctgtaaccagtcaagctgtttctgtatgtcacttcctttttctatctataaatactgcctgcccaccttgctgggtggagctttctgaacttctaattctgagtactgtctgattcatgaattgttttttgctcaaataaactctgcaaaacggaatttgtctaaagtttgtcttttaacattgctaattgtcaaatatattctgcttactcctacccactcaacggaaaataaaagaggtggttcaaaggggcatgcttagcttctatctatgtctattaatctttattagtgaagacaagagcttaggggttactaccgtttaacaaggcaagtgctaatctctaaaaagctgataatttccacaatttgtaaggtttaggtaaaacgcagagcctttagatgtgctggagtatattgcttggtctttaaggaactcctcagtgtcaggacactaagaattataggggctgataaagtgattgttatttctctagacacagatatttcaactgtgatttggttaatgcctagtttgaaatccttaataaaactttactctgaaaggcatgcattcttaaagtgaaatgtgttatattgaattcatttttcactttgacttcctttataaaactaatgatatatccctataaatctttagtaccctcatgtaataaaatagcacttaaacatgcagaaagaaaagggaggaatgcagaaataataaagaaccacaatactgccataaaaacagacacaaagacccatggaaaagactagagaacccaaaaacgaatccacacacctacagttaactcatttttgacaaaggtgccaagaacatacagtggggaaaagacagtctcttcaacaaatggtgcggaaaaactggatatccatatgcagaatgaatctagacccctatctctcaccatatacaaaaatcaaatcaaagtagattaaagacttaaatgtaagacctcaaaccatgaaactactacaagagaacactgagaaaaatctccagggtgtcatcaacagatgaataatttgaatttgtacttcagaaacaaaaaaaattaaagaaccacagaattaaaatgggagctatctctttaaatagagagaatcccaaagagaagtcaacattttttttttctagacaggtcttgaactccaacatccaaacataattaacattctaaaagagagagaaagaaggtcagagatattcaatgtccaagttgcagttttctctcaaaggtagaccccacctctttttgcccttcttttgttctccattatacaaagacactaactattctaacctctaatagcaagcactccccaatagatttatggcttctacagactatataatgtcagtgtccttgcctcttaatgttcacaattgtataaatgtgaacattttatataacatttacaaatttttctgccaaatataaaaatctcacataatgtaaattctgctgaaattatgttgataacatattatgtgattttcatagttaatagtatatacaatgatctggaaaaataatctagtagtagactaaattgaaatcttcatatatatttcttatgtaaaacaattgacttgaccacttctcaagttattaatattctaaaattaaaaatgcaaggattgtggatatggaattttagaatgaaaaacactttctttgactaattaccatcttaatattggataacgtcatcagtaactgtgtgtgtatgcatgtgtgtgtacatttaagtaaataattttctctttttctcccacttaaagcagttaatgttttcgttttgtttgatggaacttaaattatcactgactacttacttttcttccttatacctcttggccaacatgtgatgtaataatgcatgtggaatgatagcatatacttttcttgaattaaattatgagataggattatacaatttcaattaaatttcttttctctcaaagacatcttaattactttatataatgccttttaaatcaatcagttctattttaattaagaaaaccaaggtagaaaaattaaacaattttccaggttcataaagtgtgattgcagaactaaaagaataaaattgtacgattgcaagagaactggaagagactgtccatatttctggtcaaactcttcatttcagtgaaggagaaaattgaagtctgaagcagttaagtgacttgatcaagattatatgctaagacagttagtgacagaatagaacagaagggaaactgggttgcccagctgctggcccatgtctttctactctaccatactcacatatttcgagtttgaaatttttgtattcatataagttagctggaggcagtaagcatagccctataaagcaactcttgaacacttgaagaaacatgttatcaagtgtaaattagaatagtattgggaagacctagtgaggaaacagccagaaaagaaaagatttgttatggaatatgaatcaaaatttggagaataagaggaaagagaatgttgcaagtgtgagaaccagcaagggtacatactcatatgggagagtgaggaaattgttggagagtaggaatggggttagaaaatagaatttattgattctcttggctcagagaatctatgttggggagtaacagaatgatgcttggtgagaaaggaactggaggcagaaaaagaaaagagaagggaaggagttagcaaggacttattaggcacagttggcagagagagaaggttctactagattctaatgattaaatataacttcattagagcagtgattttttttggtatgttttattcatggttgcatcctccgtgcccagaagagtgcctagtacatagtaggcattcattaaatatttgttgaatgaacaaataaatgaatgagggagatatggagacctacaagattgaagctttgaacaaaagagtaatatgatataaacagcgtccaaggtagagtattcttgcaaatgtatcaatatggcataacatgatgacttaaataagaatcttaatcacaggaagagaaaagatgtatggcagaagaaaaataaatggaaggaaaacgatacaatatggacttgtatttggaagcacaaggatatctcttatgagccaatggaatacaaagggaaacttcgaaatcatttggatttaaattcaattttgtttctttaaaaatggacacattaatggttttatttttttgaaatataagagcagtttcagaatcgctcaccaaacaatgggccaactgtaattttttataatatgttataacttgggcaaacacaggcctatttttccagtatatcattgaaactattttttaattgtggcaacttttcattttaaaataacccccatggaagaagtgacaagattcataatgcaggtttatcagtgccactaatggttctatatctaactcttccagtgttattctattctatttcataatcatccctaattactgcctatactgtacttctctcaattgaaccctgccatttgctgtagattgatcaataccctaatttcaatcaagtgtcaggaaataagctaaattgctttgatgtggagaattacttctttgctttttatgagtgcttataacatatcctgtattattacataggcctatataaaagccaaaaccattgatctgaatatttaaattctagaattggcagcaccttagataagctaactgttttctacctgattaatgacagcaagaatcaaactgcggtagctgacatgggaaactgctgagaatgaagagtccatattttggctgacatgctatttgccactttcaattctccttttattttatcaagttcacatgaggcagagaaaaggcactaagtgatactcggaacaattatagcatctttctttttcttttgtgcagaaaagaataacttaacttgacctgccaatattttttccatctcacattttcattcttttttaatgacgaaggttatcaaagtggcctacgtcatcacacatactgacctctcttaagagtttaagctgtagaaagctaatagagcctccctatctttgaaaatgctattgccattgttgctcccagtgtaccaccaccaagttgacacaaaattcatatacaaaatagggagataaggaacaatgtctgggaagccagggtgcaaacttgtgaaaaacaaaacaaaacaaaaccttatacataaaaataaacctgttctactcctagcaatctacttctcataaaaacaaatccttttctactcctagaaaaaatctactctctatttcatcctttcaattagtatgcatttctttgtagaagtttccttctttctttatatgctacggtatcatatggtggttaaaagttcagactctgaagtcagactccctgatttctttttcttttacttttttcttttttcttttgagacagagtctcactctgtcccctaggctggagtgaagtggtgcgatctcggctcactgcaacctccacctcccgggttcaagcgattctcctgcctcagcctcctgagtagctgggactacaggcgcgtgccaccatgcccagctaatttttgtatttttggtagagacgggatttcaccatgttggccaggatggtctcgatctcttgacctcgtgatccacctgcctcggcctcccaaagtgctgggattacaggcgtgagccactacgcctggcccacccagactccctgttttcatcttgtatcttccacttgctaagtgaccctaaggaaattatttagcctctctgtgcctcactttcttcaaatgtaaaaagaattcaataataaaatctacctcttagggttgctgagagcattaaaccggtcaatgaatggaaagtgcttatggcattgcgtggtatgtaggtacatcatgtaaatattagttgctatcattatttcatacttgatgcagacatttacaatagtgcttctgaattactaaaaatgcagattttcctccttatagaagtatatatgttaaaattttggacaagttagaagaactataaagaagaaaaaaaatctcccttctgtaatctttctacctagaggtagtaactactcccgtcatttagtgtatactcccataactattattaagtccatttggtcatcttctacctcccttcattatcactttttctctagacacagaagaaagcacaaaatatttttaataaagagaaatgaattaagaaaggcaactgcttagaaagcaggaagcctggctttcattccccgcccttgctagatcatttaagttacaatgggcgttttacttactatctctatccttttgttcctccacggaactattgcaaaactggtataacaagaacttccctctgccctttttacaaagatgctatgatgcatccattaactaacttctccaaagaaagctggcacatagaagggggcaaaatataaagtatgtgagtatactacaactaaaagcttagtttacagaggatgtgttttaacaaaatctgagaggaagcaaaagacaggaagttgctatagtctctctttaactgtaggagctatctcctctaaactgttaattataatgtgttacaggttttatattatataattgtaatgtgttataaagggttttaaagactgtcctctggtatgcatttagactaatgccaaaaataattccataatacatatccgttaattttttatcactttttgtataaccctgtgatatgccaagagagaaatttatgaaactagaatagctgcactcctcatttaaattcactctgatgtcttaatatgcatgtctcctatgtttataaaacattaccactttaatctaatctgaatcctcaagtatcatctccataccaagcaaataaatgattcatttattcaaaatacagtgaatcattctgaaattggatgatttacgtagacatgtgagataccagttacttgtgctaagacaatgaggaaaatttggccattttaattcatttgtggcctttttgctccacatcttttcctacctaatgttgagagactttttccgaagttcactccacttgaagttcatgttatccaaacgtctttgtaacaggactgcatcatcggaaccttccagggatctcaggattttttggctgttttcatccaggttgtgataaacatctgtgtgagcttcaatttcaccttggaggtcctacaggacagcaggaagaagaatatgtgcagaattaccaaacaaaagaaacaagcgatgaatgtgaatttggagaattgcaaaatataaataattattagttcaaaagacatttcaatcaggctaaactaacaagaagatacatctcaaatcccttttcttggcgtattgccttctcctgttattatgtagatttaaaatgggcatcttattagttgtaatagatttattccttgccattatgagttggaaagtaatgtatttataactttataaagttcacaagttatatcttctagtctatggacaaaatgtattattttatggaagtgataggcaataaaattctatgataaagtgtaccccagtgccaataatttcattactatatggatcaagtcatattttctatttacgtagtaatctgtagagttaactctgaccataaaagcgtggagagactaataaacaagattgcacttggcccacagcaccagcacattcctgggagtctgtcatgggagagaaaatcttcttgacaacacaaattaagttcaccttggtattatagcatcatacatatagtacagcatcatacatttattagttttgatttcccatttaatacacatttttaggcttgacaggtggaaagtacataggaccttggtaagagttatgataagaggttatgcattcaacttcacttgtatacacacagatcaagaaaattattatagtagaagaatctgacctttacatggtatgtcttcctgtgtaacattttcagcttgaaccgggcactacagcactgatcctgttgcatagcaatcctgagaaaacccagaaactgaaagagccctgctttaaaatgccaactttgcttacattctgttgacagaatgaattttggagcacaggcctcaccagtcaataataataaacggccactttgtactccgcactaaacagtagccaggcgtgtggatgtgggaggaacctcaaagagaggaggcctggaatatgcaactgacagtttatattaaacagccaacttttcttatcattctgccattacaagccagagacattataaattcattttatatatgtgtttccttccttgttcccagcagaatagtcaaagccaagggaacattcctcagagagctgccgggtaccagcattcctttctgcctacacaatgaatggaggctttgtatattatctgacttgctcttagagatttgtatgcttctgttcaacaagtttaaaaattcattctgaagctccaaacaattggattgatctgtgtaactagaaaagttttttttttctctctctctctcaaattgaattaaattactctgctaaagtaagggagaaaaagtggcagaaataacatgttagaaattctgaagaactggctcaagttttcagccacagcctcttaagatgcagaattctgaatgttgaacaagtaaggtagacagacaatgaatgtctattgtcactatttttggcagctaaagcatcactgatggactctaaagagagttgtgtcccattctctttgactgggagacaggcaggggaatatggatagaatcacatcagaagttgaaagaagggaaatactgaaagtatttctgagtagtatctctgagtagtacaaaccaggtttgtactggaaggatatagcctgattttgaaagtagtttatatggtagaaggttagtattgggattcttgcagaacgaagtttggtcaaatatatagccattttatgtttttctttcttttttccttttgcctacgtggaataacatgcctgcctaatttgcacttcttcagcaaaagagaaaagtgagttaatttatctaagtacttcaggagaaaaagccaaccagatctaagttccagataattccttcacttgtcttttactttacttcttctgttgtacttgatttgtacagtactttccttttgtgtatgcacttaggggattaaagacaaacttttagttgttcaagtaaaagtattctcactagtagcatcagttttctatgtttactacattaacatacatataaaggatagtacatttgaaatttatatcctacattgatagcagagacccaggctcaatcacgagctccttaaggttatgtataccatgaagtcaccaacactttctttgtcttctcaagcataaataggatgttgattcatgaatttgctacttttcatctttgccatatatattatactgcatataaacatctttgttgtattatcaacaaataaatgaatataaaattgataaacaagcatttattgaggactgatttattgtctagttttagcactttgggaaatgtaagaggagtacaaatgatagttctgtctttaattttcctaaaacctagtgtgcatttttgtttaattcgtttatattaccaactaaatattgacggcaattcctgccaagtcttcatagatactgggataaagactccttcctttagaaatgcagaaatggctaaagttatcttagcattggcaagaagataagtcttctgtcagtactgcttttctaggtcatgatggtgatacagagctgtaaatgacacgtgtacagtaaagggctttacaggttacaaagcacgtacaaatgtaccaccttagttattcctccccctggctctgtgaagtacatcacattttctgttttgcagatgagagcactgagactcggatgtttaactgacttgcctaaaagccatatagctgataagtgttagaactgggaaatggatccaattctcttgattctagaagatcttgggctgcctccaccaacccacttgccagaagcattggatataatacacagtagtcactgaacctgaacgaagatactacttgcaagaggaaataagtgactgttgagggaaaagcaccctgaaagacagcattcttgagtttgataaaatgtttacccacgtggattgatttgttctgaatgaaaaattgaattctgactgctctttttttttttttttttttgagacagagtctcgctctgtcacccaggctggagcacagtggcgcgatcttggctcactgcaagctccgcctcccaggttcacgccattctcctgcctcagcctcccaagtagctgggactataggcgcccgccaccacgcctggctaattttttttgtatttttagtagaaacagggtttcaccatgttagccaggatggtctcgatctcctgacctcgtgatccgcccaccttggcctcccaaagtgcttggattacaggcgtgagccaccacacctggccctgattgctcttttcacttctcatttagcattgggcatcctggaccacctgtgagcaaaaaatgttcacactgaaaaggtctcctttctgcaaatttccctgttgccagaacagaaattctgccatcagtaattcatctctttgtctacaagagccatgtggactactatgaaccataccaagaaatgacttgacacatcagcataaacatagttcatccatgttcctttgggatggcaggctggtaggaaatctttcaagctacaggactcagataggttgccctaaaaggaaggtaagtattgggaaagaacccaaggctctctttcaaaagctggcatgctgtagtggagatttttcagtatcaataaggcagcatgagtcatagattgggaatgcagggcaggctgcaaggaatatacattatacataatataatataatataatataacataacataatataatactaccataatgatatttgtctaaactcatcattttttatttatttatttatttatttattattattattatactttaaattttagggtacatgtgcacaacgtgcaggttagttacatatgtatacatgtgccatgctggtgcgctgcacccactaactcatcatctagcattaggtatatctcccaatgctatccctcccccctccccccaccccacaacagtccccagagtgtgatgttccccttcctgtgtccatgtgttctcattgttcaattcccacctatgagtgagaatatgcggtgtttggtgttctgttcttgtgatagtttactgagaataatgatttccaatttcatccatgtccctacaaaggatgtgaactcatcctttttttatggctgcatagtattccatggtgtatatgtgccacattttcttaatccagtctatcactgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtagaagtgttcctatttctccacatcctctccagcacctgttgtttcctgacttttaaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcacccactttttgatggggttgtttgtttttttcttgtacatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattctggcttttgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgttaaagatcagatagttgtagatatgcggcattatttctgagggctctgttctgttccactgatctatatctctgttttggtaccagtaccatgttgttttggttactgtagccttgtagtatagtttgaagtcagctagtgtgatgcctccagctttgttcttttggctcaggattgacttggcgatgtgggctcttttttggttccatatgaactttaaagtagttttttccaattctgtgaagaaaggcattggtagcttgatggggatggcattgaatctgtaaatcaccttgggcagtatggccattttcacaatattgattcttcctacccatgagcatggaatgttcttccatttgtttgtgtcctcttttatttccttgagcagtggtttgtagttctccttgaagaggtccttcacatcccttgtaagttgcattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagatatacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccaataaactcatcatttaaagactacacctcagactcaggtagcacaaaagagcaaaagattgatatggagaatcaagtggagttctcagtgggtagccaatctggacaaaggataattttcatagaaatttttggatagttttatttcacttctgacttaactagaaaagatcattcaagccttcattactgcattcactgtatgctctctaatttttttcttcttttttgtgattgtagtctttaggaaaagcaataacgaatgaacaaaggggaaaaggtagttgttacataacaaaaaccatagcagcagcagcagcagcaagaacaacaacatacatgaaccttactgtacatcaggtgctgtccaaagcactgtatatacatgagctcattttctcctctcaacaaccctctagggtaggggctactattatcttcattttccatataagataatgaaactactgtaaggttaactaaaaatgcccaggttcacacagctaataaatgcagcaagatttagaacctcgtcagtcagacttcagggattgtgctcttagccactaggctatattacctttcaagtttagttgttggtggtagtttttcctattaataatgctactacctaaattttagcaaatctagcactgccattagaaaataaaggataactatgtcagcacacaaagagcaatttcatggtcttattaatataaagactattaaacagatttgtagcagtggatagagatgcatccaatacaacaagagaaaacacaaagtaattgagaaaatgggtgcaaacgaaacaaataatgtgtgtccccataaaagaaacatttggcctaaagttctgtacaattatagagcaaatttcagctgagagtaccaaaaaagttcagttatgagacaagcaatatgttcacagtatagcagttttaggagtaggggagatcctgttttctgaagggctttttcaaattccacacttccttcttatctgagtctcatctactcttgttgtgaatctcctttctcagcttccagagaaaactcatggcaaagtgcagttaaatagacataggtttgacccttctcttctctttcccttattagccacataatgatgaaaactctttcattactttggtttcactaaacatgaaataataatacatacctgctgaattttttgaatattacatggaatttttgtaaaatactttgaatagcgtctagaacacaagagatctttaataaataatagcaaatgcagggcttactattacaagataatccatgtggaaatcagatgttagaaatagatttcatgaagttacaggacttggcttgagccttgagggatgtatacgattgggaaattggaacaaaagaaaatattccaggtaaaaagaatagcatgggaatggagtaaaggtgaaatgaatttggtttatgagcagggacaatgaattgcacaacctgattggaatggacaatgagagttgagagaaataggtagaatgcagaccaactgcttaaaccaagtagaataaagtcttcctttaggaagccaccgagaataaaagtttagaaagaaaagtacaaagacaagattatcgaatattaaatttgtactatttcattcaaaaagtagaatgatccatggtgttcataagtaataatacaactggggaagaataggaaaagttatggatgttttactagaagaaaaataaagaagggagatgtcaagaattagtgctgtacccttctttttattattaaccattttattaaccattaagcagatggttgtgatactattctagaacatcatgaataatcgtatccacatatttcctttcctatgtaaatggaattattggtctctaaaataggactcagcaaatgaaaacttccccattttaatatagctgagaagtaaggaaacaaacacaatggtgtagaaagaataacaataagtgaccaaatctccttaagaattttattatagacagattatctctaagcttttctgaaagcagttagtatatgaataattataaggccattagttcctccttactgataatttttatctaatttaaattagcttgatgggaaaaaaagtggtctgatttctaagaacttagaaggtcaggaacatacaattcaaaatagtaaagaaattatcctaagtggctaaattgagagtaggaagaagtgacaccttacagagaatcagaaaggtgtaaaaggagccatgggcatgcataattgaccagggtcacacagtgtggaaactaacagctctccatgcatcagtagcccttgaaggcatcacctcgttttatagcgaagcaaaatagttaatgctcaggatgatgatgctgaattagccagggaaagcagatttacattcagtaaaatctgtttaagaagaaagcagtgtatgtaaatgcttcaaatgaccaaatgactgttatttgatacagttgttttgaaaaggtgttaatgatttaaataaaaataaaacaaaaacaattatatgaaagtagaactcccttagactggttatccaacatgactcattaaacatgagctctaaatagtagagcttttggagcacacttgcatacactcatacgtatacacacacagaaacagatattctattatgaagacataagaacagaaattgaaagcaaatctttagaaacgtgtacagcaatctaaaaataaaaagcatcggcttaaattttgtatgtctggtatttgtaatttttaaaataattcatttttattgcatgttacaaaagtatcagtctattatggattgggaattaaaacaagcgcaaaaaaaaaaaaaaaaaaacccgaagtggatctttcctaacaagtttttcgagaagaatccataggaagaaattggacccacagtcttggccttatcaggattctaatctaaccaccggaggttcctaaccagatcagaaaatgcagttggatacagactcacaagagggtgtgactgttttttcccttcttattctatatgtggccacgcaacacctttaaaagcagcagagttgtcgtcccaagagaaacaagagttaatttgaggactgctgtttggcttggagcctggttgctctaggtagataaggagtatgttttcaggtccactgcattgcgttgcatcttaaacgagcagctatggatttaggagtccacaggctttgctttaaaaacggctgttattaaagtcctcagagactattatcctgcagggtttgttgtctttgctttcatatctcattcgaaaattctcacacttaagcactgcaacagcagagagaagggatatgctctctcagcagggagaagggatatgctttcttgcctcagtatattcccaagtgcaaagcttcatttcaaaatctaatctttaaaaatgcctggcctagggtggattacccccggaggaaactgtcaaaccgccttaagcaatcccgaactctggtaatacgtgatgctttctctccttgtgtgaccctctgactccattcttaagattaccttttaaaactgatgagttcatttaagatctcctaggttggaagtaagatgagaggtatctttctcatctacgtcttgtttttcctagtttcttctcatccagtcacaatgcaaaaattcccgaatatttattcatcacaaaaatgtgcattaagtacctattgtatgtctataagtagggccgataatacctaccttttaaggttttggcaaagattagatgagatgatgtgagtagatcaaccaagtacctaacccaatgcctaacctattgtgaggtttcattaatgttgcatccttctagtccccctctcactttctgccatgactccaatcctgctagcagagaagatatgaggccgttcaaaagaaaacgaatacctactgcatgaagatgggagccagagctacaggcaggagctaagaggtagttctcaggaagttcaggttcaaagggtacagtgtagccaatgagagcttagaatgccgcctggagatttttatctgattctgtaaggataatattccactgtagcttcttgtgtaaaggtgtaacattgtgaaaatagcatctggtaatgattattgggaggatggtgttcagggtaaatgtagcagggtcagagtgaaggcaggaagtctagtggacaggcagtcccagccatacaggaaccaaaacagcagtggcttcagaatcagagagaaggtaaagaagagggatgctaccatcattgagtgctcataagttataaaaatagctgcatgtgtgatttaattccatccttctcttgtcctacctttggaaggtagaattcaggaaagtgataactattcacaagtacattttaaagatagaaatgttatttaaagttctatttctcaaggagtaagaaaaaaatacatatgctgtgtttcaaacacacacacacacacacacacacacacacacacacacacacacaccttggggccaaataaattagaatgacaaaaccattgacaccaaatgacaagggcattgacatcaaagctccatataggcacaggtgactcccacctaaaatataccctatcaagcattcctaaactatatgggtgccagttctaaaggacacaatttcctgagaaaaagtgggtagagtaacactgcttcagatatttttaaaaagaagccgtggacccagtggagaactaatgttgatattcatttggctctgcacataaactttaaaaaagaatggcatgccttttaattctggtgttgaaagagaaaacgagtcttaaagacaggctgagttttctttttttaatactgcatctaaaatccatagaaaatactgtgctgcaatattatttctgatattgctatacagcctcagtgctcataattgggtgagcatttcctgcatgagacatctttcagatcagtgccaacagtaatcttgaaagaccttaacatgcaaaccctagattgtacatttaagtcacagagacaaccacatatgaaaagtctacaatgttgaaggtacttttggttttttatattatattttatgtgcaggaatcagtctgtttgaagaaaactacccttatctgagaaagaccagatgggtctttccaactctgagacatatttgtttttgcagagccatgatgaggggtgggggtagggtagggggatgaaacagggcaggaactaatacttacagcccttataaatcctttacaccaactctatgaaataggccttctttatcccctatcgaggaaaccacgagtttgagaggtaaagtaacttatacaaatcatagagttgttgttatgtggcagaagcagggttagagcatagatcttcctgaaactaggttatttttattctcttccctccaagctccagtgtcttccccatccattaaatacaaagcaagtgacttctgacttgggctacatgtatcacagcaacataattataataactcattaaggcatctgtgagatatttagtttcagagcactgataggaatggtcaacaactgaataattttccaattaggtattgcttttaaaaatttatccttagtcaactcagaactaatatcattgatgtttctgaatggttctaaatgaacacaatacactcctattcttcaaataggtaactctcttcccatggaccaatacatatttggttatattaatctgtgcaatttgtctatattacatagagagttaaaagctcgaaaagctcttatttctggaatctctttgtcactaagctattttttgtcctccagagaatcactgtggttcaaggttgtatattagaaaaaagcaattagttgatgtcaagtctcatcttttcccaataacacatatctaagaagaaagcaagaacatatggcaaagtgccataattatttttgatcatacactagaaatcacaacagccatgtaggtaattccctctggcttgttttaattattagggttgtaaatgcaaacaacaacttcattctatcccccactttaccccctaaaaacctcaaaatactcccacgcaaccacaaaacaaccctacactgatgtaattgtttacaataggttaatgataggaaaatctaagacatttctatttttttcattttaaatagcaggacaatttccaaaataatcacagacactcatcagacacaactgtattcatttgtgggtactctttagcccacagcatagagatattaaccttaaaactatttctaggtattcataagttttgaatgttaaagaaggttctagtaccatgatgtaaactaaagtcctgctgatataattggatctgattctctggtgatcttcagtgagttaatttctgtctactaccaagtagagcaaattctttcttctggagagtgtgacttttgtgtgtgtgcctagatagttctttcatcctattttgcttttcttctcttatacaatagggtgaacagtgatggggagaaaacaaagttactcttttgttaatgtatgaggaaaaggaggaagacaggggatatgcatgtggacactgatgtaaaggtaggtaatatttggcatatttgccgggaaaaaaatgtcataaaggaaaagtaggcaaaatgctaaggtacatttcctcattcttagaacccattcatgagctttccattgtgatatggtttggctttgtgtcctcacccaaatctcatctagaactgtaatccgggggaacctggtgggaggtgattggatcatgggggtggcttcccccatgctgttttcccatgtgatagtgagtgagttctcatgagatttgatggttttataaggggctcttcccattcactctttctctctctctcctgctgccttgtgaaggtgcttccttcccctttgctttccaccatgattataagtttcctgaggcctccccagccacacagaactgtgagtcaactaaacctctttttctttaaataaattaccccagtctcagggaagttctttatagcagtgtgaaacgaactaatatacatcgtgtatctattaattcttcccaaagcattcagttcagttcagaagatgctagagacccttagaccatctcactgaagcaggtccagggtattttttgtgtccttgtgccatgatgcaatgttcttttcttcttctttttttttgagacggagtcttgctctgttgcccaggctggagtgcagtggcgcgatctcggctcactgcaagctccacctcccgggttcacgccattctcctgcctcagcctcccaagtagctgggactacaggcgcccgccaccacgcccggctaattttttgtattttaagtagatacggggtgtcaccatgttagccaggatggtctcgatctcctgacctcgtgatctgcccacctcagcctcccaaagtgctgggattacaggcgttgagccaccgcgcccggccgcaatgctcttttcaactgagaacaagtacatttggaaaatcatccccaaaagagcaaggtttgggaaggcttaggcctttccatgcccatatgacatgttatataagtcttatgaagaactagaacagataagaggatgactttacagattattttacaagaatttttacatgagaatgacttttttttttttttgagacagagttttgctcttgtcgcccaggctggagtgcaatggtgtgatctcggctcactgcaacctctgtccccctcctgggttcaagcgattctcctgcctcagcctcctgagtagctgggattacaggcacctgccaccatgcccggccagtttttttatttttagtagagacagggtttcaccatgttggccaggctggtgtcgaactcctaaccttatgtgacccacctgcctcagcttcccaaagtgctgggattataggcgtgagccactgcacctggactacattttaataacgattaaagaacagtggaaatctgcttcataacaccctgagtaagaaatgagaaattgtagctgcatatcagcattgtcgctgaccctgagtataaacgaagaagcctcatggtgacccaaacagagaattgttaactaagtcatgtccatagtgctttaccatggacaaatgtttttgatccacccttctaaggcaggggtagaaaagctgttgaaatgttgtaaatctctgcttgagtttgtgatacggttttaaatttagcagaaaaatattcaccaacaggagaatgagaaaccaacgtggataattattaatgttatcctgaacagaaaataaaaagacttgctgaaaaacctttctgcctggttttgtcagagttctcttccttttacacattcactttttgatgttttccttttgtgggctggcagaaagatgggggtcactctaaacttttactaaaaatactcttaaaactacaagatgtaagttctctattttaaagagcccatagccttctgaaaaagtcttaagcaaataaatgaaccaaaataacatgtgatcatgttaaactggaacacagccctgtgggaacaaagaacaattagccttgccccccaagatttgcagatgccatcatacaagtgatgatatttgatcagggtcttgagggatgagtagcagctggccaggggagaagtgggagagtgaaatttgaagcagtgggaaaaacatgaatgaagttgaagataagacgagataagaatacacatcagagctaagtaactccggagggaagaggggaagacccatggcgggaagagagacagagtggtaagatcaaaatttctctctctctctctctctctctctctctctctctctctatatatatatatatatatatatagctgcacaggaaggagggcctggattgtgaaggggcttgtgtatcaagctaagggtttggactttatcctgtgaagatgtctaatctgtttaagattttttggtaacatcatcttggtggcagtgaaaaggtacattagaggcaagaacattagaggcaagagaatatggagatctaaactgaggtaatagacacaggatgagaaaaagggagatatttttgagagatcatgaatacaacttagagactgactgaatgcaaggataacatatagggaggcaagttgggtttctggcttagagaagaagatgggggtgataatgctacctattattaaagtgttgaatttccaaggagatgtgagcagtttaacataggcttagcctgtcacttagtgatagggtgtggaagggagagtggtgttgacctttgtcggggggtacgtgtcatccactcatgggcatggtagcctgaaataggggcggtaaagaagggcccagcagggagtcagacagtctatgttgtctttcttgctctctcaggcgtctgtgttctttgtgtcattcacacgtgcctgtgagcgtgaacttgcatcatgcatcagtagttcccttagtacagtggttctcaaacttgagtgggcttgagaatcacccagagggctcattaaaacacaggctgctgggctccactctgagagatcatgattctgtatgtctggggtagaactcaagaatttgcatttcttagaagttcccaagtgatgccgatactgctagtccagagaccccattttaagaatgaaacactgttctagcataacagcccttaatcttctggaggtcatgaatgcctttataagaatgatggatcttctcctcaaaaacctgcagaaatatttataaacacaaaatacgacctattacttcacgggcttctgctactgccacctccacctccacccccgggacatacaatggattaatgaagacaacgtatccttccagtaccattttaaaggagaacccccaagaagaagaatacattggaaaatggcaccaaaatgtgattttacttatttagttgtcttagaattactcccagtgagcctacgtacaaaatgacccgatttggggaaggagacctgtcaaaggacagttcttgggtgcaatgaggaaattcatttcactctaaccacattcagataacctgaccttttcccattttaacctgccattcacttgggaagtaacaaataacagagaggtgggtgggtaaccatggagaaaagggtgcattcagccaggggcctgcctgtggaaggacggagcagtttgcacctcggggaaagcggaggtagggctctaggctctctgtctggtagcccagggaaacagttcaagatcaaaggaaaagataattaagaatgtgcttaaaagaaaacttcaaatcagctgtgctacacaaagatatgagacaatgcctgttgtagagaaaagagcattttgactttaccctaagaatctttcttatgtgctttccatagcccagcggtatagttatttttaaatgaccctggaaaggaagcagaggtgttctttattgcatgaatagaaggcaatctttcatttaaagaaccttaaccccgctctgcatgcatgcatgaagtcaggaacacaagggcaatactgtattattcattttggcaactataaattcaaatgatggctctgaggttggggagaaaaaggcccgctgagctggagagcagaacgcttccttcagcttatcaaagaagtgatagtgctacaggcaggagtgccccataataatctagggaaaatacgcctctgagtcaatgaagattttctgttattgcatgggctgttttgcctacagccaagaaaattctgtctgatggtaatgttttagctgctgattcatctcctctgtcttcaattcttctcagcaaacttttattgggtctcatcctgggcacatttacagagcaatttccataatgataacatctcttcaaatgagatttaaagtgtaattaaaaggcacatgtgttgtggcaaaggcgttgttgtgcagtgaccatacatcatcgtgccatggagctctcactcagccagcctatggaatgaccccggtttcactctgataagattccatggctttgtttgaggctaatggcttcattagaaaaaataaataaataaaagaagataaaacaagctctttattggagagataagtccatgaacatgcgttagacttctgcacccttctcccttcgttctgtctcttagaactcagaggcaacaagaaactccttgagcacggaagtgaacactaacaaacggacaggtgaaagctgaaaggatgtgcttgccctgagaagctgagctccttatgtcctatggcctactctcatggttttaagtgtgattgctagaaaagtggaaactacaggttacaattccctgaatggatgaatgcttgctcctgaaaaactgcctggtgcctgagaaagcaaggaaatactccttgagtagtcaatgtttgaaacctccaaagtagctaagactatttcttcttcactgtaaaatcaatataagatttttaagctttggaactactcaaacccgaaaatagcttgcctacccagatcctgactcatagtattcattaaatgatatgaactgattttttacttggctgctggttttaagtattgatagataatcatatcatatgacagggaaatcatattaacacatggggcgaataaaatctttcaaaagatcagttttgagatccaagatgatcattaaataatagattctgaagcatttaaaagaggacttggaacttttaaatgccatatgttcgatcacctttttaaaacataacatgacaatattcatggagactcaatatgccatgtaatgtctacgttacttacagcagagagttccactaattttctgtgctcctttctttgcctaaatgaactatttcatttagcacaatattttgtttgtagaataaaatttatccttgtgatgttgggagttatgaaataactcatgtgttttaaaatatcattaaatgtacggaattaaactataattagtagaaatcatttgagggtctttaatttactgatgctgacaaattctcatcaaatagttactgtgctttcaagtaaaataacatctttgtaggcagatgtaagacactagaaaaataatgtacactttcaaagagaaagtgaacctcccatacctctgaaataaaagcaatttagaaatctgatatattttaaaagaggcacataagttaatctgtaaatttcactttactcgttgacggtgaaatgctacgttcaatctgttgttacagcaaaaagttaatggaaagtttgacttcactgtaacaatatcctcttttaaccaaataaccttccttaaaccttggataaaattcccctgtttcacactatcaccatcacagataaacggattgaaaagacaacaccattctcagtagaactgtttgcttacactcagttagccaagcttctactacctgatttcattgccatggaaaatcctccaggataacttgggtagcagctacctctattacttctcccaacatcccactgcttccagttgctactgtttgctgttacaatcagtggtagcctagaaacttgaaccacccaagtgttttaaatgcggaagagaaaatctgagggaaaattgggaaggaaaaagtgtttccatgtttccgaagagcggcattgtgcttgtatgactgtttttcatcagctttgactttttggagaggcagttttacttttcatagctagtctaatatttcttctcactaaatagtgaattaacacagtgcaaatttagcagtcatccttttgacatctttactcataaaataagtaaaagcaatccccaacttacaaagagttctctaaccaaaaatcacttgcaaataaatggtccagaaccccaaactcaaatttccatggacacaatagtcatatacatgtctcagaccagcatatacatatatagctatttaacctataccatggatgatttatatcattttgatagcatgactttgggttatatgatttgggaaatatgcatcttttgggatatgaaagattcaagaagtacggaaaagaaatacttcctattttaagacctggatttgtccaacacccaacaaaggagatatataaatgggcatctgctctctccttccaccttctggtgcccatattttctactcccaaacttccttatgttttaatcctcattctcttctatctgttgaaaatcttattcccaaagtatagactgacaactttcacattctgggagatttttatattttaaaaagaggggctgggcatggtggctcacatctgtaattccagcacgttgtcaggccaaggtgggtggatcacttcagcccaggaatctgagaccagcttaggcaatgtggcgaaactctgtttctacagaaaatacaaaaagtagcggggtgtggtggcacgtgcctgtagtcccagccacttgggaggctgaggtgggagggaggatcacctgagcccagggatgtcgaagttgcagtgagccatgattgtgccactgcactccagcctgggtgacagggtatgaccctgtctccaaaaaaaaggggaagctgagttaaaccaaaccaatctgaatcacagattgataggatttccaagaatataagaatgcaaagtaaaaatattcagatggtagcataagcgtctgggggcagaaaggctttagctattcttggtaggcaatctactttggttaatactgtgaactggctcacctaaatctacttaccatccttccagttggacaggttggaaattaaaaactgtatttgccagacttccatgcagctagtgttctgattatgaattaggatataataagttagggttgtcagataaaatacaaggcacccagttaaatttaaattttctacacaatctttttttatttagtgttaagtatgttgcatgcattatttttatttgctaaatctggcaacgttttgccaaatgtgtatacttgtgagagatctggaaagtggaagtgaggcataggtcacctttctgccccttttggctatttctgttggcgagcttagtcaaagaaacatgagatttcctacatcagagttccaaagttctttctccagcttcctggctggagaagggcagttgctaacagcagcttcaaaagtggtagcgtctagatttcaacctcctggttcctagttcctatttacaaagtatgttcttgaaatcattgcttcagtggtaccccggagatggtagtttcttattggatcagttctatatagttttagaaatctgtcctcgaagccaagtctaaaacctgctactttagcctttccaaaactttgatatgtgtctaacgtacctagagtagtttctcttttctgcagtgaactccgttatattgaccttcagggccacctcctctatttgtttctactacttgcaatatcttcctttagtcattaaaaaaatctacaaacaatacaactttatggttttcttaacatggttctttgtcacagcagagatttcccatcacagaaggataggaattgaggaaggcaagtggatttgtacctatggagagatgtcttgttttatttattttatttctaaagaacatactttacaagacactttaggttgtaacagtgcattaaaatacctaaacagtataccagcatcctttaggaacactttactattatttttctcatctcttttgtccctcatatctagatgtcaaatttccactgacaagtaatttgatgcctagggaaaatattcgattcaacagtttcataacatgatgtcctattaattaaaacatgatacactgacattaaatttccaaatgaaaagaagcccagaagtgaaatatcacaaacttgatacatacgtatagtcacatggaggggtggagggatactaaggaaagacagtgtgttttcaaacctggcttgcacgtgtgaggtgaacactggagaacagaacttacctctctgctgtcagcacttggaacagcactgagcgcactcgaggcgctcaataaatcgagcttaattttttaaatcttttcgctcccttcgcccattctgcatatatctcatgtacaatttcatttcccaaaagtaccaggttctaacatcaggaagaaaatatatggtgagtattgaccatttctggtggtcaaggtctctactcttaatctcatgtaattagggtgatcctatagttcattgtccaaacctgaacacttttgagagtgtccaggatgctaataataatcacacagggtcaggcacactggctcatgcctgtaatccaggtgctttgggaggccgaggtaggagtattgcttgaagccaggagtttgagatcagcctgggcaatgtagcatgactcttatctctacaatatgttttaaaaattaaaaataaaaataaaaaaacagttaaaggagtttgagaacagcctggccaacatggcgaaactctgtctctactaaaaatacaaaaattagcagggcatggtggtgggcacctgtaatcccagctactcaggaggctgaggcaggagaatcgcttgaacccgggaggtggaggttgcagtgagccgagatcgcaccactgcactgcagcttgggtgacagagcgagactccatttcaaaaaaaaaaaaaattaggtgggcatagtggtgcacagctataatcctggctactcagtaggctgaaggaggaggattgcttgagctcaggagtttgaggctgcagtgagctatgatcatgccactccactccagcctgggtgacagagcaagactctgtctctaaaataaataaaataaaataaaataaaatatagtaaagtaaagtaacacaagaataacagggataaactgggacagccggagacaaattaggatagatgaacctatagcagtcaataaaatgggcaaaagggtctcagtagcagcagaggcagcctttcttcccgctcattctctccaagtaacaaaaggtctgtgacacgacgttctctttctgcctggggttcactgcacgcagtgaattgatcactgcacctgtttcttacattcagggaacggaaagcagagaaaggccagtggttcacaccactgtttgtgcacccaggtgccctctcaccgtggggagtaaacaccttcggttctgtttgctacggaaaagaaaaatgaaaagagggccaataacaaaatgcccttcaaagaaaacactttgtgagcctgtgtgtagcaaagataagaactaggacactgtcatgagaaagatcctagaatagcttcttgaaagaaagatttctttaaaaaaaaaaaaaaagaatgcgagtgaatgttgctacgacatctattgtgtattatctgccatatccctcttagcaaatgacgattaaagtttctgcatctgtcggtaatgcaaacgggaaagaattcactttcctgaaatttactttaaattttcctttacggagaaatgattcattccccctgtatttcatacctgatatgtaatacagattttatgtttaaaaaaatggctttgtggggctcccatactaaccaaaaatttcttcctagacatttctaactgtatctagagaaaacagggacatcaaaacaaaacaagaacacaacaacacagcaaaatcctggattttcaatttataaagtcatggatgaagaactggtttaaacctaaaatccataatcagagaacttcaaagagatatggtatattatacacatcagccttttccttttgaagaaaagcagagagaagacactggaaggggaaacctcctgctactctgggagctcctaagggctgggaccatatctgccttgtctgcggctgtatctcccacttccagcttgatagctggtatgcaactgcttttgctttcaataaagttatcgagtaaatgattggatacattaatacattgattagttatgaaagacatcaagtaccagagaacatcaaagaaggctaataatgagagtcaagcagtgggtaaccttggtatatacctagataatagagcactggtttctcttttttttttttttttttttttaattttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaacggacatgaactcatcattttttatggctgcatagtattccatggtggatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcggaaattttctcccatgttgtaggttgcctgttcactctgatggtagtttcttttgctgtgcagaagctcttgagtttaattagatcccatttgtcaattttggcttttgttgccattgcttttgaaaaactttgaaaaaaatttagaagaatgtataactagaataacgaatacagagaagtgcttaaaggagctgatggagctgaaaaccaaggctcgagaactacgtgaagaatgcagaagcctcaggagccgatgcgatcaactggaagaaagggtatcagcaatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatgtggagaatggaaccaagttggaaaacactctgcaggatattatccaggagaacttccccaatctagtaaggcaggccaacgttcagattcaggaaatacagagaacgccacaaagatactcctcgagaagagcaactccaagacacataattgtcagattcaccaagttgaaatgaaggaaaaaatgttaagggcagccagagagaaaggtcgagttaccctcaaaggaaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttatagacaagcaaatgctgagagattttgtcaccaccaggcctgccctaaaagagctcctgaaggaagcgctaaacatggaaaggaacaaccggtaccagccgctgcaaaatcatgccaaaatgtaaagaccatcgagactaggaagaaactgcatcaactaatgagcaaaatcaccagctaacatcataatgacaggatcaaattcacacataacaatattaactttaaatataaatggactaaattctgcaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaacaagaggagctaactatcctaaatatttatgcacccaatacaggagcacccagattcataaagcaagtcctgagtgacctacaaagagacttagactcccacacattaataatgggagactttaacaccccactgtcaacattagacagatcaacgagacagaaagtcaacaaggatacccaggaattgaactcagctctgcaccaaggagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcctacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggatacattcctcgacacatacactctcccaagactaaaccaggaagaagttgaatctctgaatagaccaataacaggctctgaaattgtggcaataatcaatattttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaagagaattttagaccaatatccttgatgaacattgatgcaaaactcctcaataaaatactggcaaaccgaatccagcagcacatcaaaaagcttatccaccatgatcaagtgggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttaaaaactggcacaagacagggatgccctctctcaccactcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtactaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaatattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatggtttctcttgatagcagcccagtttactgtatgattgttttagccaccttttccccctccaatcttccaagttacagcagttctcctcactaccaaaagtgtgatggtaggactatagtttgccattgtcccttcattcattctacaaatactgagggagatgcagtgatgaacatgacagacactgtcccagtctaatccggggttttctgttataaaagaatgatatcagggtttagattaggtactctgaatgcaaagccctttgaaagttggacaactctgaacacatcagggatcctagtacatgatgaacaagtatctgagagaattttcttaatttaacacctagaaaatcagctaaaagggtaaaactgtttgcacagaaaaccaaaccatttaagaagagattgaatagttattagattcttttgatcaggtagaaaacctatcctgggagttaaaatctcaagataggctcttcttggcctataatatctatttggactagtcacatggcctgaaattaatgagataattgaaaactatcctccactagaatctcctcattttatgcattttatgcaaggttgcttagtggcctaggattgataataataagtaagctaatgaacccaatcccaaactgattttgcagtatcttttatcagtagatttcatggcagttgctgtatatttaattgtaaaaaattcgggactgtttaaactggggaggtgagaaaacagaaggaaaagaggtagaaataagaagcacaagaagattgtgaaccagttttcataaacttagaagcaatgaaaggtacttgaaactgcaaacagaatagagtggacttaaaactgctcactgattgtgtactcaacattttctctgttaaataggatcctagagcagctatttcaaattgccactcaccttaaatctcagactccaacaccttcctcatcactgggcatttagctgcagcttccacttcaataaaaaataaatccaatacaacaatcctacttaacctttcaccaaacttacaaaactaccagtagctatgcccatcctccttcccttctcccctgatgttgtaatagaagctgtactttccttcctatctgaagctaatttctaaatttcatctttctgccttctcaagtacctgtgctattgattatctctaatttctcctgcatcctcaacctctccctctctaccatcttcttctcattgccatttaaacatgtgtaagtcactacccttttaagagtgtgttcttcctgcccctacatccatcttctgctactatggccctttctctcttcccatcgcagccaaaagtcttaaaataattgttttacacttgctcccccactttctcaattctcaatcatgcctgaacgtactgcaatcttggttctttagttaccaccaagtaattactgagttctccataatcaacactgaaatcacttgcataaaggttgtcaataccttccttgttgctaaattaataggatatattttggtcttatctttcatgatgcttttgtagtatttgacacctctaaatgttactttttcttgaaaacctctcttcccttggattctgtgacatcacacgaacctagtctgtctcctatctactgaactgcaaatttccctgtctccactgaaagcttatttttctttatttacccctgaaactttgccattttcctgggttcactcctaggccctcttctcatctacgaactttactctgaaccatttcaaacccttgcaaggttttaattacgtatatactgataattaaatatccaattaaagattctctagcctagaacatttctccataggttcagctcacatacctaggtatcacaacttagttacactatcatcattactcacctggacaatttcaatagtgtgctgaagctatcttcttgcctccagtttgctaagcttcctctagtcccttgaaataacatgacatgactttctcacttccaggcctttatgcatagtattccatctgctgggactccacctcctccaaatccccaacttgacctgtctaactcctgcttctcttcaggtctcagctgaggtaaggcttccttgggaaagccttctgcatcctgccaagccagggtcaattaccttgatgtacacccgtagcactatcatagtaatacccttaccatctataggttgaatatctcatatccaaaatacttgcgactgaaagtatttcaaatttcaggttttggaatatttgcattaccctatggatatcatgcaggcctttagggcattttcaacaatatcttgacaccaccagagaatataccagcaaacacagtgattaatgcacgtaggttttggccccatgctggacattgtagggtacctgccgttgtcgcgtctagcccgcacatgtgccatttttcgtaccttttgtgggtttgcttgtatgatggaatctgggtgtgggtggaaaagatatatcacagctaacgggggctgagaggatctttcttcccttggggatgctgaataaactctatgtggtgtgcctgcattttcactgtgacttgtcacatgaggtcagaagtggagttttccatttgtgatgtcatgtcagcattcaaacagttttggaatttggaacatttggatttcaggtttttggatcagggatgttcaacctgtagtagttacttgtttaatttccttcctcccccactaaactacagatcaaagaagatagagatcaaacctatttcctttatttattgatgtgtctctagtgtctagcctaatgtttggaacatcaataaatattcatgaaagaaatggataaataactgtatgcttgcaccagaagatatcccacagcagtcttttctaatccttggtaatttgaattttttgtattattgatttatatacaagggctaatgtcctgcgaagtagtagtacatatgtttctgtttttaaaagacattgtttcataaaattctattataatgaaaagcatgggctattacatttttccttcatggagatatttcttatatatcgtaaatctagaaatgtgtattaaattagacatactagaagtcaaagaactgaggtacagctatttagaaatgaatttgtggaagcagagggccatgaacagctgtgcaagttgtacaccgagaaaaacaaagaagtaccattcacatcatgagttgtatgtttcacaatctggacggctcttcatggcagtcctgaattgtagtaaaagagaagggttattcgttctcattattttttcctcagactctctcttcatggtgagggatgattattctcgtattcttaaatttcagtctaatagagttattagaattttaaagctggagagtatcttaaacatgaagtagcctagagatgacaaagaggttttacctatgtgctaactctcattagtgagtggtagctacctggagcattgccttgagaagtgctctgatacagagctgactgactagccatgtctttcaggggtaaacgagacagaaacggaagccattcacgtattttccttccttgttccagttaatctattcattttccagaagagaaaattaaggtccagaaaagcaatgcaacttgctcttaacatcagtgctggagcagaacccaggtttctgtacttctagcctacgtcccttccttcacacctggtttcaagattccttaaagataaattataaattctagccctaagatttgctgcctttcaaattttaacctattttcaaggttaactacctgcctttggtcaccagcataaataaatctggatatgccatgtgagaacacagcatcatcacagcaaatagtctttagcatcataaaactatcacataaaatgtagtgccaagtgcactacctaaaaggcacatgttataagtagtaggggtcattgtcaatcaagttaagcaatgcaggggggaaagaaattgtcagaggaacaacgaagagatcatctgtaatatcgttttgagacatatttggcttgaatctatacaaatggcagcagaatacttgcaaggacttttgtcccagtgtgaagaggtaacaactggaattgattcaacgtctattaacattggtcatggtgctagatactgagaatccaccagtaaacaggaaagacatagtccctatctttgtggttggttacattttagtagagaagtgaggcactgaacaatgatgtgagtgttttgaaagaggaagtacaaggaacttcttaggggtgggaggggtagccgatgaccccaaatttttgacaattgccactcggaaacagaatatagagatcaatttgtgataactttctgcagctattctgcatccaggctggatatccaaaacaaacactggattgctggaaaacttaggaatttaatattcacaaatcgatattctaaaataagtaaaaacaattagaaaagacagattcacacagagtaataaccatttgaatctcaatagatactagttataaaatgatacggacctttaaatcagtacatcttctgatgtctaaaagatgcttatcactactcactagactctttttcacttgctttgcaaatcagtttaaacatacatggtaatcaggagtcattatttttattcacttggaaagtcagaagtaccttttcccagtgagattttgaaggaaaagtaaaacacccttcatttggagattttatgggtgtctaaacatgtgcttttctaaacaggaaatgatttatgacttatcaaaggatatgcctgagtctctcacctaatctctaaacccagctgactttctccatttctctaacactgagcgtagcaaaaggagacgctcttgattagccaagagacactgctgctcatacaccaacctatatttgactcagggttggggaattgtgaaacaacctaaatgcagcacttttagatgaaaattgctctgaggattttccattctgaaaagtagaaggaaaccaaggagttcttataataccagaaaacttagaagcccttaatgcacaatattacactgacctacaaaatgaccttcgcacaaagttaacttattaagaagcaaggaaaataggtagaaaggcattgttggtacaaatagaaacgctgctaaaatgccgagtctggaaaatttgaaaaagatcttaatttccaaaactgtttctgctcagaaagaagtaagaggaatatcatttggtgatataaaacttggcccttttgagagtgtgggagaaaatgggtggagaactattgattctgacataatcactgcaaattttctacactgtcattgattaatttcttcaataaacatcgatttaggatctactgtgttctagggctgtgctgctctgtctaacacaggagccactggctgtaggtagctaccgagcaattgaaatcaggctagtgagacggagagactgaagtttaacaaatttttattccattttattaaatttaaatataaatttaaaaattgactcttggttcagttattgaaaaacttttgtgtatgtttggaacaacttaggaatgtgaatcttcttttttcaactataaagtttatgaaatgtaaatagagaccaaatattttcttttttttttattatactttaagttctagggcacatgtgcacaacgtgcgggtttgttacatatgtatacatgtgccatgttggtgtgctgcacccattaactcgtcatttacattaggtatatctcctaacgctatccctcccccctccccccaccccacgacaggccctggtgtgtgatgttccccaccctgtgtccaagtgttctcattgctcaattcccgcctgtgagtaagaacatgtggtgtttggttttctgtccttgtgatagtttgctcagaatgatggtttccagcttcatccacgtccctacaaaggacttgaactcatcctctttatggctgcatagtattccatgatatatatgtgccacattttcttaatccggtctatcattgatggacatttgggttggttccaagtctttgctactgtaaatagtgccgcaataaacatacgtgtgcaggtgagaccaaatattttcaatgaaaatacggtgtccaaattgagatgggatgcaattgaaagacacatgccagatttcaaagacttagaatggaaaaagcaaattttattaatactttttattgattacatattgaaataataatatgttggatatatcagggtcaataaaatattagtttcacttctacttttaaagaacgtggctactagaatacttaagattacataggtggctctcatttctatgggacaacactgttctggacattgtgctggcattgggaacataaaactaaacattcccttaaggattttacggaatggtggtacatttactgctatagcagagagatatagaggaatgcaaaggacgctatggggacatagatgagtagcaattaaattaggctgatgtcaaccatggctacctaaaataaggcatgcttaaattgatccttaaagtttgagtggaagttagatgaagaaagacgaagggtattccaggaagacggaatggcatgtacgataacattgggagaagtagtacaatacagtgattaagaatctagaacctctaccctttgagtcatatgcactcaagctgtaccacttactatctgtgagatcatatgtaaattacttatctgtatctctttccttctctgtgaaatagggatactactactgtcaaccttataaagttatcgtaagaaatgcatgagttaatatactgctcagaactgtgtctggtccacattgtatttcctgctattattgtgaattagaaaatactcccacaggttggagtaaagggaatactgtctgtgaaagtgtcagggaagatggggctacagaggtgaccaggcatcatgcattcaccagagcagtttgaccttttatccttcaagctgtgagaggattagtcacatcttgaaaacatattccaggcataagagtagcagagcatttagatggatctaaggcaatagataagagataagaggccaatgcagcaagctagttgagcagtgctgcggggccactgcgaatagagggcagggcatgaataaggtggatatggttgctaaatgctcttgaaacctttctctgcttctttttaggtatctagctagacttcattttccagcccctctgctgttacatgtggccacagggcagagttctagccagtagaaggttgagtcaaaggacatgggacgcctccgtgtgcagtcctctagctcattcccctttgggctggctgaatatcttcaggagggcaacctcggcaattggctattgcagatggaagacccttgctggcctgttttttttttaatttattttttattttttatttttattttattttattttttttagatagagtcttgctctgtcgccaggctggagtgcagtggcatgatcttgtctcactgcaacctccgcctcccggcttcaagtgattctcctgcttcagcctcccaagtagctgggattacaggtgcccaccaccactcctagctattttttgtatttttagtagagatggggtttcatcatgttggccaggatggtctcgagctcctgacctcaggtgatccgcccaccttggcctcccaaagtgctgggattacaggtgtgagccactgcacctggcctggcctgtattcttgaataattatgtgggtgtcacccctcccttcccacacacacatccaacaccaactaacatgaattcaccttagactgtttacatgagaaagaaatacatttctattttgtttaagtcattttaatagtccatttggtggatgtttaatatattatagctgttagcctatcttagctattatagatatgaaacatacttaaagagctaaaagcatttttacgaggaaaaaaagacttgatgacagataagatatgagagtgatgaagaaagttgtcactaaattctttgagtagcagggcctcaagtgttatcttgagtgcaaatataaacagtgaaccgataagtatgttcttggtgaactcgccaaagtaaattttcagccagcaatgaacaacagtaagaagtaggaatttggtgaggttaaagaaatcaggtatcttcctcaattcagcagaaaagaggtcaagtttcaaaagacattgggaagtgtgggtgaccctcaagaatttagataagaagaggaaaactgtcagagtcatttggttaaggtattgataagattcaagctatgcggctgggtgcggtggctcagcactttgggaggccgaagtgggcggaccacgaggtcaggagttcaagaccagtccggctaacatggtgaaaccccatctctactaaagatacaaaaaatttgccaggcatggtggcatgtgcctgtaatcccagttactcgggaggctgaggcaggagaatcacttgaacttgggaggtggaggttgtagtgagccgagattgtgccattgcactccagcctgggttacagggtgagactccgtctcaaaaaaaaaaaaaaaaaaggattcaagttacgctactccaaaatccacaatatggcagcttggtatttgagaagacagcagaagcaggatggtcactctcaccttccccttcccccttctcccctgaagcaggtcatgagactatcataccagaggtgcccttactatactggaaggaaaggaaaatttttacctctgaaaacacagggacacaggaggttctgcagaaacaggccttgctgtggtcaccccagtttattaccattcccctttgtccagtcatactggacatctacttttcctcaaatcagagcataaaaatacacacttttccctgattctttgggtcatttctgaaggctcctgtgtcatgtgaaacttatattaaataaattcgcatgcttttatgttgttgatttgtccttcattataggtgcctcagccatgaacctagcgatgggtgagaaaagagatcttttctcccctgtaagagtcaagtagattctaaaattctaaacaagcaggtttcgggttctcagaaaacagggggttgacaagaatggttctgacatagcccaaactgtgaaaactgaattatgattccaaggcaatagcatttaatactcatgcttgttgaataggcaagggcttccagaaggaagatcagagcctggtcttttcatctctggaaacctagatgtggtttactcttagaatgaaaaagggctaagtcttcctggggctctaaggactctccctgtgttgaatagaaaaagggataaaccttcaactgggtttgtaaaatatcgttgttccatggaatcaaattcaagaccaaggtcaaaagtgatggtcacatcttgctttctctgaccctacccaggatcagaaccagagccttcagctggcagcccattccttctgctgctgaaaccaatcctcaccagccaggcaattcagcagaagctcactcagggacagcatggaagaggcgtgagatgaatatcgctgctgccattctgttaaccggtgtgagctctagacttcatcatgattactatatttccttctgccttctgggattccttctgacacttgtttcagtttaagaaccatgtttctttctcaaatcattttccttatgctgtttcttcacaggaatgatacacttttctcatcataatttttgaaaatatgttgcaaaaaaatactgtgtgctatctgcagtgattattctttcctttgccttaaaaagaaagtattctagggaaaggatggaaaacaccacagaagttgtgagaatgggcatttgtgatttctaacaaggatttgtcagcctttgactgctctggactttaccagccacagttgctgaagacatgcagggtgaaagatcagcccttacagctctaaatcaatgaactccttaaacctgcccccaaatgtatcaggagctggaccctccactagcaggcagggtctgagatttccttgagcactcactatgtgcgagttactgtcctaaataagtccagtgtagtaattcacttcattctaataacaaccctatgaggtcattaatcttcactgcggatacaaagaaactgaggtatatagaggtgactcagctagaatgtggcagtcaagttacaggaaatttataccattctttacaactgcctttcctgaagtaatggctgtgtataatattgttaagattgggtcgacaaaaatcaaccagtcaaatattagaagcccaagccccgccaacagatggattcctgtattagatgattttcccgagtcttctaacgacaaaaacagcaatggcagcagcattatctgcaaatatttatgagtacttaattgtgttgtgccacataccatattaagtggtttccatgtgttaaatcaatgtaatcccagtatccagtgggcgtcagcagagctgccttgagctgcaacctctttcattagcaaccagcttagatcccttagtcattttggctgggctactctggtggtgattcataccccagggccttgcctgagctgaagctagaacgtggctttgcaccctggaaacctgcctatattttgccagttttctccccttaaggaactgaaacctagctggtacctaagaattgcttctttctaaataaagcctactatggccacaccaccttcccaaactaaggtgctgaccgatgctctcctctccttctaccagattccaacctttagttattcatattttagtcatttcacttaactttacaacttcctcttgcccactgattttggaatagctggtttcctttcttgaagacttgaataccaattaccagggcagccctctagcctcctgtctccagcagttagctgctacagacattatgcttcttgtcagaggcaatgtgggtcatgctttacctctaaacagaatagccccctatctatgacatagaataggaaatgcctgcaggcagggatctggtcttattaatcttcatatctctaacactctttctgttcttagcacatagactattcttaatacgtgaatgaatgaaggaatgaagaatgaatgaacggctattgaaagatatcaatcttcattttcctttcccactgttaaaaatcaaagcgataactcaaatttccaattagaatgaaacataccagttctagttggtattctgacagaaaaaattatactgcaggttatatttttacactaaaattttccatcacgtaactggaattaatttattccaagatagtagaaatgtattggtgcagtatgaaatgaaggggatttaaataacataataaaaagaagaacattacaatctgtttaacataacctaaccctgggaagattaatagctttcaattcatacaaagactgaagtctacaatttcatatacacatggtcttattaaaaatgaaagctggttataatgaaatgctagcaccacgctaagattggcatggtgtatgaaatagacaaactaacagtgtggcaatagttggaggtggaatttcataggataactttttagttccaaaatggtcaaatcacacaatggctggagatataattaagaattaggctctaaaaacaaattctgaaacagaaggtaattaatatatcttcggggaaagctggatttttaatgaatcagacatgaccgcagagaaaggctcgatgttgccctgtactctcttagtctggttagctaaaaccaccccacactagggacctcctagtgcatggggttaaatttcacatttgtgagcagtaagcatgtgtttgctggcactcttgcagcatactgggcatgctgtggaaggatcagagaatttttggaattgtgcactaaatgtctttgttctatacagttttaaataaatgagtcattttcagacttggagtttttctttaaatctgttggtataaaatcctattttctaaatgaaaccatactcaaaagtggaatatatgaaagagataaaagatgaaagtattcaagtgggttagggaaccttggaaagagcccattcaatccctcttcccatctctccctttggcctctgaggcaccttgcagaactttctagaatgacttgaatggtttgcatggtttgaattcgatttgcatggtctgaaagcctccagatctggagcaacactcatacttttcaggtgaggtaactgggatttaagaagttcagggatttttgcaaaatcacaccgacaagtaaatcagttgagagggaaggaaccagagtattttcgtagcaccaggtcttggggcttttgacttcaatttctcattgccctgccccctggaacagtgccactcaatggttcataggttgccagcatgagtgtcatcacctgggagctggttagcaatgcagaatcgcaggccttgccacagacctgctaaatcagaatctctgtggtgggatccagacaactgcattttcataagcttgccaggtcattcttaagcatcctcacccttgaacatctttcccgtctttccttttcttctggtcatgattcctcaactcccaagctcaaaagtagtgaaaatgttgttataaaggaacagaaaaaaaattaggagaggaatagagagtgaaattactccagagcctttattccctcacctcaggtcccactgaagtcattttggaaattatgtagctttttctttttcttttttttttttttttgagacagggtttcaccatattggcaaagctggtctcgaactcctgacctcaagtgatctgccctcctcagcctcccaaagtactgggattacaggctgcgccactgcaccaggcctggaaattaagtatctttgtttaatgatggcattatgaaaaagactaatatgttctgccactcctcttcccggttacttcagctttttttaaatgagtaaactagaaaatcattttttttcaaactaaatgtcttcatgtttatcatgtaacatttgttatgtaaactcattgtttaaatagaaggactagggcgtgcaacatttggccacaaaagaaaatatgcacacacacaaacataactgattttttttaaaaaaaaaacatgtattactttaaaaatatgccagttaaatgttaaaacttatgtatgaatgtgctaaacaaagagactaacacaaaataatttctggtaacatttttagtatcatgaaggcccataaaaatgaggagggtatggattattgaaattgtgtgaaattagaaaactacatagaaacattcccgtgaatgcaaggagacaaagagagcaaatagttaagtacattggacccctccatatctgctcctttaaaaaatgtatatttcagtcatttacattttatgttaaattattatctgactcttctaaaagtttttggtgtaaattaaagatgatctgaattatcagaaaatcaggactgagaacaactaccctgaaaaaaaaaaatggattactttagaatgtgaaagaatggccaaggtctatgcaaagttatttttgctttgaatagaaaccctgagtgcaatgtttaagaatataaacctattcccaacatgcaaaaattctatagaattcttcaaatgaaccctccaagtcagtattttaactctgctactgtgtatgtgctaggtttcccaaatggaattctctattcccagaacaatcttttctaaagccacaaaaaacacaaatagaattcaaagttcttatgcttgatatactttatgccttctttcataaaacacatcacctagttttcacgtttctctgaatatcctatgttgtcacaaaagatatatttctcctaagttaagctaaaacgcatgattttaagacaacctaaatgaaaattgcaaacacaaaacacattcataaattcatgcttatgaaattatgacttacagcataagttattcttgatatttaaaagaatcgtttatgagtttttgtcatcatgaatgtttgacaacaagattatctgtgaacaagagattgtgtgggcttacacagtattttcaactaaaagttacggtattttgtttaacacagaaaccacaccataggttaagtttgagattattttgaaatatctgaactactcagcaggtaaaaacaaataatacagcccatttatagctcatcagttttttgttttgagtcatctaagcaataactcaaggaaggtgagagagagcatttgccaccctccagggtggcaactgaacttcaggaattccctggagatacagccaattgatgcttcacatctctcaccatgctctgccatcaattctccattgccatggaatccacaatggaaatgtgccacacttaggccacttttcatttcagttcttttatatattaccctcccttttcatattctccttggaactgaatgagttactgtttcaaagaatgggggccctgtactagggaagggtggggtataatgacaagcaagttcatttgtttggaataaaatagtcagcaacagaacaataaacacagaagtctgctagaagaggccttcagtttatcaacacaaagagttttcttcatgacttccttggatgtcagttgcatttaaatatagagttgctaataatttcctttcctctttactcgtttaattatgcaatcggatattaaagcattgggtcaggtattttgcccaattttagctattttatttgtattttaactatttccaattttaactgttcttgatttatatccaatttatttccaatttatattggaaatcttggccagtaaataatttgagtatagcatggtttaatattataaaggttatatatacatacacagtctctctctcccatgtaactatatccactaaagtcctaaagtaacaatgcctctgtctgttatggtgactcagtctgggtttcccatacagcagactgaggtgatcctaggaaacactgtagggaacaggaaaggaggagaggaaaaggaagaaacaatccagagttctttattgggctgggcgtggtggctcatgcctgtaatcccaggactttgggaggccaaggcgggcggatcacttgagatcaggagttctagaccagcctggccaaatggtgaaaccccatctctactaaaaatacaaaaattagttgggtgtggtggcgcatgcctgtagtcccagctactcaagaggctgaggcaggagaatcacttgaactcgggaggtggaggttgcagtgagctgagattgtgccactgcactccagccagggtgcagagtgagactccatctcgggaaaaaaaaaaaaaaaagaggtatttattgagtagattactaatctggggaactggggctcaatgctgttggggatgctctgaggatctttggaatatatctcaaaattatcccagtgaggggagagaaagctgagatttgtacccatctactctcccttattggttgagtcttgctcctgttaataccctgtcactttgggcttggtccatgtgcccatctaccaccccaaagctaagaggacatggaaaggatacctgcagcatctgttctacatggtatttgatattaccctcaatatgtgcccacaaaacagtatacaggatcatggactcaaaatgacagcaaaataaacagatgcacacactgttcacaaaggatttgattgggtttgcaaagctccctacatttctttgcatataaactagactcatcccttaaatttcaaagtaaaatctcaccaactgagcgaaagctgtggcacagaagttcctcagagttttaaaagatgtgctttgggtttaattccaaccacatacatataaaaccatgtcagtttcaaagtctaggtcagggctcttaaagctgaaacagctagactcaaatctcagagcattttcataactggatgatctgtactcacttgcatttgcaggcaaaattgtaaatgaggaattacaatatatacattcagaacagagaagaaatttccctaaagacaagtaccaaaaatgttaatgtaaagatttgccacttaagaacaaatggaaaaaaaaatcattggtgcctaactttcgacacataatctaaggtctgaagtctttttgtgtttcacaatatgaaggtgccctggccacaatatttatactattcctagaagattgtaaatagtatctgaatgtgcactgtgagtttctcagattcaaccccaggaacaattgcgcaaatgctctcctgcatatagaaactgctagatcctcttttcagagctgctgctttttgtttttctggagacagggtctcaccctgctgcccaagctggagtgcagtggtgagaccacggctcactgcagcttcgacttcccaagctcaagcaatcctcccacctcagcctcctgagtagttgggattataggtgtgtgccaccacacccagctaagttttttatttttattagagatgaagtcccactagattgctagggttggtcttaatttcctgggctcaagagatcctcccgcctcagcctcccaaagcactgggattacaagtgtgagccaccacacatggcccagagctgcttcttaccaggcagacagagaaatgggaggcagcacgaccttggagaaggaggaaatagtcattgtccccttcttttattagggagtgcaggccccaccatactactattctaccagcacagtgcctgctcctctgggctgctccttccaacctcactgctgccctcagcctcatattcagaacatttcagtggtgaagatcagagcacataatgagcttgtctggaacaaattaagattccgggctttaaagtcaaacagacatgggttacatgggtttgagtctcatttggctctgcgatcttcagcaaatttcttatctatttccttatccgcagaatggagatgataataccaccttcctcaagggacttttgtgatgtatatatagtgctgggtatttagtactgaaaatatgctagaggttgctatttgtagtagtagtagtggtagtagtagtagtatggaaagaaggaagcaagctaccgcacagaagtctcctgaaaatctgaaaaaggcttggggaaatccagcagagagagctttccctttcttcagagcagaggtttttaagttgtgattcaagggccggcaacatcccctgagaacttgttagagatgcaaattctcaggccccatcccagaccaactgacacagaaactctggggatggggcccagccagctacgttttaaaaaggcattcagaagattccattacaggtcaacttttgagaagcactgctctagcggaatagcaggaagggtaaatgctaagctgagcttagttcatatgggacgttaacatttcctctctcattagtggtcccctcctgggcagatctagcatttgagattttcatttacatttcttacttatataccatgcagtcttgggtagggcccgttaaagatggaagtagataactattaggttggtgcaaaagtaattgcgttttttttaccattaaaagcaatggcaaagaccacaattacttttgcaccaacctaacagctgtaagggattatttgttctctgtccaaaaccagaaagactgactagaaagacttttacaggccattttaagtccttgtttgttttaaatatgtacatataaaaatcagtatctatgtctatataagcacttcagtgtgttaacaatcatataatcacgcccatgagagtatcatgtaattgacattgcaccatcattaccattatgttgaaaaggtgagcaatagctactctttaaatctacttagaaatcatacaggattgtgtggtaaattctgtgtattaacataaagtcagatttcaaatcttaaaggcttgtagaataacattttcacagccatatggttaatagttgtaaagaaaagacaatgtttttttactgctgagaaatttgactacagaggactcttaagtattgtccttcatttagaatcttaaacaatatcattacatatgtccttttgattttcaatgaatacatatttacataaaatgtagtcatttctcccacttcttcattgttgaaattgccttcgccaacagctatgcagtgtcaagatgggatcagaatgtgtgggagcagatatttttttcagtcatgctttgctgacatatgcactgttaacgaattaccactgaaacaatatatgtgtctaagaaacatgtagaagagctggctgttaattcttatctatgcgagaagaagagaatatgagagtaagaagaacttggtttgttgagactcaactttggctaaattggaatcattaaagattaaaaacaatgatatctgggttccccacaaaagtctgatatcattggcttggggtacagctggggcatttttttaagcttccaagatgatgctaatgatcattagcgtcatttccttataggtcacctctaacctaaccacttcacagtagttaaatctggctatgatctgtactagctggtatctggttgggagaatcactagtactgggtttttgtatttctgcccagccaggcgttgatcatattttacattaggatttgcataaaagaagcaggccaggcagtggccctatgttcctttccccacacaaggtcatacataaaatatattattattttttattttttccccctctggccttttccctgtaagtatatgttatcactttgatacaaatgaatcataattgaatactcattcactcactccattcacttacttattcattaatgctttcattaaatatttattatgtggtaggtatacggaagtacaaaaaagtacaaaaagacctcacaaagcttaagatctaaacaggaatacaaattcatgggcaattgaaataccatatggcaaagggtaagacaaatgtactgaagtagcacattgaaggtgcaggagatccggtttgggatgttcaggaatctatttatgaggtgctgtctgaaaagggattattaactagctaaacaaaggtgatagaggagagacagattgttcctaggagagggagccatttgatggagggccagaagcaagaaacaaagatattttatttgattgtagagttcagtaaagagggataaggcttgagtggtcacacggagtgagagcatgaagggccatgtaagtagtggaatgctagtaaatgtcaaataactggctctaggggagggcagtggcgctaattgtagcatttgccaatttctgtggtgtaagtgctctcacaatagctgatttcaagcaactaacttgatgtcattgaatgaagaactcagtggaaagagatacacataattggctcttggaatgtgttaattagaagataagtagttagcaagcagagcatgtgtgtactaaacatagatagtgagggatagaaggaccaaaagatacccaatattcatgaggcacctgggtactaaatattcataatatgctaaatacacatgagaccaaatatacaagaggcactaaatattcaagatcaaataaatacacatgagcacttaatgttcacaaggtcttaattcaggcatccataggtgatacctattccagcaccgtaagtcttctgcctgagaattacatggctagtcatcaggctattttggcaagttacagctgtggccatgcattcttgtctctgtgtctctgataaaccacatgccactgaatcaggcaccacccattttggactcccttgttgggaagtcaactttggtccttgtaagcacaccataattgggaaggctgatgcaatacagagacagacaagacatataatgttgtgtactgcagaattcaagtactctaatcttcacagtctgcttacactctattctaagcgtgttaacttagcacatatctttcccgtttgcttctcactgtgattttaataaactctgtgattcaagtattttaatttggtctatgagcctttctgtttcatgatttggataggctgcctggtagtatacttgaaggccatcattgcatttaagtaattccccagatgacagaggaagtttatcataggtgaaattttaaaagatttatgataggtgaagtttaaaaaaaataataataattggccgggcgcagtggctcacgcctgtaatcccagcactttgggaggccgaggtgggtggatcacgaggtcaggagatcgagaccatcctggctaacaaggagaaaccccatctctactaaaaatgcacaaaattagccagacatggtggcaggcgcctgtggtaccagctgctcgggaggctgaggcaggagaatggcgtgaacccaggaggtggagcttgcagtgagccgagatcacaccactgcactctagcctgggtaacagagtgagactctgtatcaaaaaaaaaaaaaaagaaaaaaaaataatagtaacttaaatttttcaagggggaaaaacacctcggagttgatgaagatcattcgttgaatttgcttaatcatttgctacattttaaagaatgaacttgacttcctgtgaagtgaaaaaagcaaaaaaaaaaaaaaaaatcttgaaatggattgacttctgaaatgatttgtgaggccacatccagaaaggaattgagaaaaagtctttaaatatatgatcaaagaaatgttgaattaaaaaaacccaagcatcatattctgatgacacttgctcattttcacacgttcgttccaaaaatattaaaaaacacaagagatgaatcatttgatgacatttaaaacaatgcaaaaataaatttagatctaaagtgtcattgaaagacctaattggattagaaagttaatatttaaataaataatattcagaaacagagaggattatgctctggcctttatttcaatgtatgttatcagtaaatgccactataaaattaaatatgcaatttggagaaatttaatttaagtttgttgggatttatttactgcccatttgtttaaaggcattctgctagatactgcagggggctacgaagatgaaaaatacattctcaggactttacagtctaattacaactatgaagaatgttctccaaagctctaaatacaatttagtacaaataaagtacaaataaaaagctaaagaggtttgaagaaaggagaaacatagctgctgggaggatcgggaacagctcatggttgaggagctgcgggagacagtacttcaataattagggtattggcaggcaaagagcacagagaaagccaagaaggccaaggccattatatgacacggaacttagatgtgatcctataaaaggcaagacagtggctcatgtggcctgtaaactcttttgaataaagaccccaaacttctatgggtaattactatgctagaagcaaactgtctcagtatcctctcaccccaaacatcattattaaactgatcatgaggtttcccagggcaacattggaaacagagtcatctccagtctgggtatacagacttatgcacaactgtctgttttaacaaggaatatgttgtcgtgtgactaatttgcccatttgtctccccaactacactctaggctctagaggccaagggttttatcattttcatccttaaatctagcaattagtacattgtttaacacttagcaagtgctcaattaatgcttattgaatgaaccaacaaatctatcaaacaatagtgcatcaaaatgtttgctccaatctgcttattaataactcagtgtcttggttgccaaaggaggggaaagagaaagggtagagtgtagtagaagagggggaaataagattctaactagcacaatgaacagatttgagttacatatgtacacataaaatcggcatagacgtgatactcacatacaaatacagattggaaaaaaaaaaaaccccactgggctacgaggagtggagttgccaccattccctgctatatatcccctctagctggccttaggtgacttctcctctctttcaaggctcctttagacattctagaatgaaaatattgcagaattggaatgagagaggcatactgtttgatttactctcttagataaagcctgaataatttcgcttataacaatgacagaaattattggaagataacaaagtgtcatgtgaattatctaagaaagataacattagggtggaatgaagagctctgaagagtgccaatatatgaataatacacattatatggagaaagccttttcttttttggtgaatacatgattgagtagaattttacgttgctggaaggtagagtttgttcttctctctatgcatatatacatggaactagtctccacctgagagcttatgacctctttctctctctttggtgttgaatatgtgtgtatatgtgtgatactgcagtgcttctcaagctgcaacgtgcgtgcagatcccttggggattgtcttacaatggcggattctgattcaacagttctgaagtggggcctgggatttcaaaattctaaaaaaactcccaagagatgttgaggcttcaatcacactttgcacagcaaggtgatgctcttttaagaaactgaagcaattactaacaaataggtcacataagtatgtaattataacagaagtgaatctgtgcacaaaagaaagaactatgaaagaattatgtctgagttatatgtgtatatatatatactatatatatgtgtgcgtatatatatatatggacatataattggcattattattactgtgatagaaagacctctcttctgcaagccaaattatctttcactttgttgcttcttgaattcttttcttcttttttcccctacaattgcatctccagatctccttgaaagggtcaagtagaatgcctatgggctatctaactatgttggtaaggagtttgaattcaatgacattcaatgcatatctaagccaagctgtcacaacacactcaagcctgccaaaggagttcgtacaaatctttaaaataatttacaggagagacaaaattaccacatcattcccattatcagaagaaataattcaaattaagaaaaattagaaataaaaatgaagagatgacactgaagaatatctcaccactggaagatgactttcatctacagtgatctctctataaagcaaagatacttttcagctattattcagtaagtgagtccaacagtttcctctgatattgtgaatttaattagtaggcaatttgctcatgaaatcagaatctagcccttcccttgctgggttgctggatctgtgtattcctatattcttctctagctattgcctcatttctcaaattcctttcatgtcttcatctccattccttatttccacctccctacttctcaactcaccaccataagacttcttggctgccgggcgcggtggctcacgcctgtaatcccagcactttgggaggccgagacgggcggatcacgaggtcaggagatcgagaccatcctggctaacacggtgaaaccccgtctctactaaaaatacaaaaattagctgggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaaaaaagacttcttggctctggttccagtgtaaattctttgattgcatcatcatgaacctcttacttgaggttagggctcagcgccccgaaccctcacactgtttgagggtcaactgtataacactttccctaattcccaactcaccacaataagacttcttggctctggttccactgtaaattctttgaggcatcatcatgaacctcttacttgctgaaaactccaagaaatagtgttcacacctagctttttcagctgcctggtagtccctgacactgccagccacttccttgtctttgagactttctccttgctcaggttcctagtcattcttctcctttgtagcctgccattttctggccacctgcttagctcctacaggaaacacttcataagtgttgttttctgttagatatcctgcctgagaaatcacacccctactcttgcataagtgggaaattcttcaaatcttaggtgaggaatgttagatggcttctcttctctttcaaggcttgtgcatgcagatcttttggggatcttcttacaatgcagattctgattcaacagttttgaagtggggcctgggatttcaaaatgccaacaaacccccaagttatgtcaaggcttcaatcacactgtatagcaaggttgacactgtctttaaagaatgatgcaattactaataggacacataaatctctaattattacagaactgaatctatgatcactaaaaaaggaaccatgaaagaaaagacattatgtctgagttatcataccttggctaaggtagtaccaagataagctcttcacaaagctgaatgggcttcacaatgatcagggtggtagaattcagtgggcccacaaactcctttgcaacttatattacggatagggacatttcaaaatagacactcgaacagacagtgccgtgatctgtaagggttcaccaatatgtgcacacttaaaacttatacccattggctgggcccagcatttagattggcagcaagaccaacccctcctctccctccacctcctcagcctacttaacgtgaagataatgagaatgaagacctatatgatgatccacttccacttaattaatagtaaatatatttttctcttccttatgattttcttagtaacatcgtattttctctaacttactttattgcaagaatacagtatatattacatataacaatgcaaagtatacgctaatcactctttatgttatcagtatggcttctgtcaacagtagcctattagtagttacgttttgggggagtgaaaagttctacttagatttttcaatgtgttgggctcagcgcccctaaccctcacattgtttgagggtcaactgtataacactttccaaaggctccctttgccctgttcttagacacggcccagcatgaatttgtggcaatcttgtaatgagccacatactgtctaacaagttggatgctaattatacaaaacttttgaaaaaagggatcaaagttcctacttcacaagcttgaacagctgtagcctcaggaactttctccagattgagggcaaaaatcctatctccaggaagccaaatttgcagctgccacactctcccaaaatcccagttcacctcagggactgatggggagtcagtcatcatacttccttcccctttgggctgaaactgaaaaagcaaaaaacggggtgggagggtagaaagaacaggaagggaggtatcctgttcattggagaggtcctaaggaaacctggctggagtgaaaatctgctgtgccttaagcaccacccttccatccccaggccaatacacatcatattactctgttgtcctccttcaacagtgctagttacagactcaagtttaccattagtatataatagctataacacttgtccttaaaatgcgggttaactcaatgctgctgggcatcaatctaaatatattaaggtaggcactactgtactacaactctaataataataatcaataactatcatttattgaatggccacatggcaggtactatgcttatcagggcttccctgtctgctcagcccatgtttctttgtaaaacacaacatattaaaacaacagtatttggagacaaaaatatcttcaatccaaccacctcataataaaaccaacatattcagttttctatattatcttatcgtccttgtccatatacatattcaatggttatatatttgcagtaatatttatattccaccttttcactttttgtgaaacttgatacattatttgttcctctttcattctcctttgaaaatccaaggtaacaaatactgataacctagtatatatctctccattcctccttcatggttatgtaatcccataagattaattttatcttttttattttaaaaatggaatatgttaattgaaacttgttttgatttttgaaagatatcatcaccattctttcaggacagtagacacagctctaactagactaaataataattcattctgggatgcccaaataattccataacatattcaataatttccacactgaagggtatttgcttgatttctactttttgaccatcatagacaatgccaaaatacacatcctctacatacagcctttcatactggtacttttatttctgtagtattgattctcagaaatggagtgactgatcaaaaggtaagtgcatttaaaatttttgtagatcataccacatttctttcctcaaagaccacagcaatttgcgtttcatctgcaatatctgagagtgctctcttccattaaaaattatcattcttaatttctgtctatttgttagatagacatggtgtcttatttctttattttcctatcccttactactatgaggaagcatattatcatagttttatttttccagctatctggatatcctcttctgggaattgcatattcctatacttcggccagttttgtactgggttgtttgaattttaaaaaatattaatttaattaacaaatttgtaggagaaatttgtatattaggtatatgcatctctttatgtcacatgttgcgaatacatctactctatttgctgtttttcttttgactttgtcttctgttattttaagcagtaacaaggtatattttttccttatagcttttgagttttgtgtcttgtttagaaaacgtcttcctcattccaagaatttttgtttttacatttaaaactttaatgcatttgaaatgtattcttacattgcataagctaggaggcaatctgtgttttctaagaggaattgcaaagagtgctggcaccatttattgaataaaacacctttattccttgaattaaaataacacatttgccatataatgtttccaaaaacaatttgtatctatttatttatttatttatttattttttgagatggagtttcgctcttgttgcccaggctggagtacaatggtgcgatcttggctcactgcaacctccgcctcctgggttcaagcgattctcctgcctcagcctcccaagtagctgggactacaggcgcccaccaccacgcccagctaatttttgtatttttagtagagacggggtttcaccaagttggctaggctggtcttgaactcctcaggtaatccacccacctcagactcccaaagtgctgggattacaggcgtaagccaccatgcccggcctccaaaaacaatctgatctgcttctggactctcaattttgcttcagtgatctacttgtcttgttttgtgctaatactatactatttggattacagtagctttacagcaagtttaatattggataaggcaagccccctcccttattattgatgcagagacatttattatttttcatgcattcctgagatacttgcgattatttattatttcatatgaactttaaaagtctcccctcctcaatatatcttgccttcaaggcacttgaaatttacagggaatttaaattccaagatttaaataaaatcttgataagcctaaaatactataaatctattctatgaaacagacaccaatattaaggcaaaacaatgaaagtgaaaaccaataaaatgttcagagcactgcttaaatagattatgatacatccacaaaatggaacaatatgtagtcattaaactaacggttaagttctttgctatgggttgaattctgtccaaattttctccaaatttaaatgttgaagtcctaacccctggtacctcagaatgtgaccctatttggagatagggtcattacagagataatcaacttaaaatgaggtcatttggttgggcctgagtccaatatgactctgtccttaaaaggggaagttggagacagacacgtacacagggggcatgccatgtgaaaatgaaggcagacatctacaggacaaggagcaccaaagattgccaacaaaccatcagaaactaggggaatggaatggaacagattctccttccgagccctcagaaggaaccaaccctcctgacaccttgatctcagacttctatcctccagaactgtaagacaacagacttcttttggttaagtcatccagtttgtggtatttcactattgcagtcataggaaacaaatacattctttatgtactgatacaggaaaatgtccaagaaacattgttgagagagaagcataattcagaagaaaatgtgtatcgtatgctaccattaatgtaaagatgcatatatatagaaaacagacacacacatatacataacataaacttatgcatattcgcttgaaattcgtacatatctcctgaaggatatacaaacagctgacaatactgattggtggtgggtaggggaattgattcgacagtgcatagaggtaggagaaataatttttattttatacctttttgtaaattttcatttttgaatcatcaaaatgatcacctagtggaaaataagtaaaattaaaaacaatcaaataagaccccctaaattatcagctttctttttactatcttaattaaatcagataacttgaacagatcttcttttgtactttctgtgtggaaagttatatcagactgaaacatgttaatacaaagtatttgcatatagacatagacctctatctttcccatttactcagacaacaacttttacaatgttaacatgtgttcaacattgcttgaagtaatatgggagttaaaagaatacaagacatactttctgtattacagaagctcttaactgagtgatggagaaaagaaaaaaagacttaggtgaagcatgaaagtaagtcacttcagtttctttgtgcctgttttctcaacagtaaaataacaaatgagataaatgactgttgaagtcttaaaatttctgaattgttttatttgttttttgaaattacacttttagttttgagataattgtatgttcacatgtagttgtgagaaataatacagagaaaaccagtatacccctgaccccgtctccctgaaggtaaaaccttgcaaaaatatagtacaatatcataaccaggatattgacattgacacaatcaaggtaaagaacagttccaacactacaaggatgcctcctgtgttgcccttttggagtcacatccatctctctctctctctttcccctgttgtcccggactccttgcaatcaccaatctgttcttcattctttaattctgtcacttcaagacggctatataaacagaatcattcattatgtaaccttttcagatgagctgtttttactcagcataattctgtggagattgatctaaaagttgttgcatgtataaatatttcattccattttattgctgaatagtattgcctggtatgtatggatgtaccgtagtttgtacaaccattcattgttgaccgtctgggttctttccagtttttggctataatgaataatggtggtatgaatatttttgtacaggttgtaagataaatgtccaagagtgcaattgctgggttgtatggtagctgcatgtttagttttacagaaaattgataaacagtttgctacagtggctgtaccattttacatttccaccagcaatatgtgaatgatccattttctccacatccttgctagcatctggtgttgtaactactttgttttagccattctgatagatgtgtaggaatatataataattttaatttgcatttctctaatggctaatgtttttgataatcttttcatgcacctatttgctatctgtatatcctttttggtgaaacgtttcttgatgtgtcttgcccatttcctaattgcattgtttgtttcttgttttaccttgcagttttgagagttctttatatattctagacatccatcttttggctatatggcttgaaaatattttctatcagtctgtagcttgtcttttcatcctccctcacaggtcttttgcagtgcaaaggttttaaatcttgatgcagtccaactgatttttttctgtgtgtggatcatgctttcaatgccaattctagccctagagcctgaagattttctcatttttccctaaattttgatagttttatgttttacatttaagtccatgatctattttgaattaagtttttacaaggtgtgagatttaggttgaagttctttttttttcccactctagggatgtccaatttctgcaggaccatttgttgaaaaggtgagctttctctattgaattgcttttgcaactttatcaaaaatctgttgggcacatttgcatgggtctgtttttgggttctctattctgtttcatttggtctatgagtctatccctccagcaacatcatactgtattgatagccttactatattgttagccataatattgggtagagaggttactcccactttatttacctttttaaaagactgttttagttattctgtggcctgtgacttttcttatagattttagagtatgcttgtctatgtgtacagaaatccttgataagattttgatagaaactaaattaaacctttagattgatttgagaagaactgacatatttgctatgctgactcttccagtctataaacatgccatataatccacttatttaggttgtttttaatgcctttcatcagcattttataattttctacataccgatcctgtacatgtatgatagatttatacctacgtatttcatttttggataagcaattataaatggtgttgtgtttttaatttcacttttcacatcttcatttccaacatagataatccgtaagttgtgatggcttgccttatgattttttgactttatgatgggtttatctaaatgtaagcccatcataagatgaggagcatctgtatataaaaatgtgactagctttggtgtgttgatcttgtatttttggatcttgttaacctctcttctcagctccatgagcatttttggttatttttgcttttgtttttgtagaatatttgatattttctacgtacacagtcatgccatccacaaatagaaataattttattttatacttttcaatatgcatgctttattgtttttccttgctttattgtagtgtctggaacttccagaactatgttaaaaaagagtagtgaaattgggcatccttccctaattagcaatcatgggtggaaacattaagccttccattattaaaattatgctattaactgtagttttctgtagataccctttattaagatgtggaagttatcctctattcccagttttctcatagtttttatcatgaatggatgctgggtgttgtcagatgcttctgcatcaatcaatataatcatatgattttttcttctttagtttgttgatatggtagattacactaattaactttcaaatgttgagccagccttcaatactaaatcccagttagttatggtatgacactctttttttaaactttgacgcatgttatttaatattttgttgatggtttttgtctctaggctcatttatttattttagacctttcctgtcttctaactaaataatctaatgctatacattttattctcaatactgcttttatgacatctcactttatttttttttgccagagaaaaagactagattactcacagcaaagcagtagtcaaagaaccaacattttattgagccagttcccacagagtaatcccaaagaagttcaggagacacctgtacacacagtggattgcatcacaggagagaaaccctgagcttaaggaagcttaatctttaaaaatagacagtagatatgcttgccctttgcttcagaatctcactcatgttgatgttttattttcattttatttagttctttgtgtttaaaaaatttttctttgcaacctcctccttgacctggggaaaatgatttaaaggtgtgctgcttcatttccaagtgttttgaggtttttcttttgtctttctcttattgatttctagcttggtttcattatgttctgggaacatataagttgaattctctaaatttgctgaagttgcttggagtccagaatatggcttatatcagtgaatgtttcatgagagctttaaagtaatgtgtattctgctactgttgggaggagtgcttcaattagatcctattggttgatggtgttgttcagttctctttacccttgcttattttccatttagtagttctatcaactgaagagagaggagtgttgaagtccctaactagaaatatggatttgtctgtttcttttttcagctctattcatttttgcttcatgtatttggaagctctgttgttaggtgcaaacacatttaggattattatgtcttcccagtgaattaacacttaatctttatgtaatgtccctgtttgtcactagtaattttctttgcaatgaagcctactttatctgatattaacattactgctgctgctttcttttgattaattgttgcataatgtaactttttcgattcttttaattttaacctacctaggttgtatttgaaataaacttcttttagacggcatattgtgtgctcagcttttatcaatccactcagctaaatctcttttaattggtatatttagaccatttgcatttaaggtaattatggatatattagggcttcaatctgccaccttatttggtttctgtttgttttctttatttctcattcttctctttcttttttcttaccttcttgtgggttatttgaacatttcttaagattccatcaaaatttatttgttgtattttcttaacgtatcactttgtatagttttttagtggtctttccaggcattacgatacgcattaacattgcaatctactggaattgacttcaggtgacgtgtagaaggactcttacttccacttaggtatgtcttcttttaaaatataactcttaagtattttctctacatacattgagaaccacatcaggtggtgttaaagttttcacttcaaacttatggtaaataggatagtctattattttactctcatttttacccattctactattttctttctgaaatgtcaagacttcgttataatttcctttctgtttagagaatgtctttttgtcattctttaagagcagatttgctagcaagaaattctttgttttccttaatctgagaatgtctctttccctttaattccttaggaaaaccttaggagttatctgattatctaagagtctgtaccttagactttggttatgctattttgcaattctgtacgtttaaaagtcaatttgtggagggctgatggtgacacaaatgattcttgttcactagatgccagtaaaattttctcatggaacgcaatagattcctgccctacagttagtgatcagtattgtatctgttataaaattcctatcagcattctagagtgttttttatatatatatgtgtatatatataaaatatatatatacacatatatgtatatacgtatatatacgtatatacgtatatatatgtatatacgtatatatacgtatatatacgtatatatatatgccaattcttcagactctcctttgaaccaactgtaactaacatcttactaattccttcatcagttaatgatctaataaaatgttttacacatattcattttatatttttatgggactcacaattttgtctctttagaaatgtagccttatataaaatacagacataaaatgacccattaattcattattttacttacaaaaggtacctatgtatctgaaagttttctaagtgcctgacacacagcttcccctaatgataactcttctgtacgcatgagagatttatctaaacatttaaacaaacactgatacaacactattaacaaaactacagactttattcagatttcaccagtttttccactcatgtcatttttctgtttcaggatccaatccagaatctcctactgcatttggtccttgggtctttttggtctcctctagtctgtgacagtctctcagtttcttcttgttcttcatgaccttgaaacttttgaataggactagtcaggtatattctagaagtctcttaagatttgactgaagtattttccctattagaagaagttacaggttttggggaagaataccagagagataacatgtccttttcatgacatcatatcacaggagacatgatatcaatattattatcactggcgatgttatacttgactacttagttaacttggtgcctgcctggtttcttctccattgttattcctacttttccatattctattatctggaagtaagttaccaagttcatggaggggcttaggggaggattaaactctacatcccaggaaaggagtatctatgtatattattaagaattgttctataagggaaaattttctctcaaatatgcttttttactaaacagagaaaacacattattatctgagtggttgctatatggctaatctcatttaccttcttttgtcaattcataaactggtcttttttcccttttcgggccagtataacttaataggattgtttatcttatgttattaatttatttgtagatgacaaagattccttttggtaggttctggcactcaagactaataggtttttccatatatttctatggatacaaattgtaccagcatgctgggaaggaaaatgagctgacagtatatgtgtcactttgaatcactgggtatcctacagggaatatcgagttacttaagcttcaaagaaagatgtgacaatggttaaccataatttagatttggattttaatattctcacagcctggctggcccatcaattttttatgatgtttttctcttaagtttctcaacaatttctctgggcaagtttgtttcaaatgcaagactaattttaagcttgattaaaatgttaaacagactcatgccatttgtattatcctttatgaaaaaatcaatactttaatagactttcttaggaaactattttgagaaactcaatagcattgttaaataaagtagaatgtcccatcagattccagtattttatatgtattctctgacaaaagggtaaaataagaagcaatgagttacatgataaaagatttaaaggggtgtgtgtgtgtgtgtgtgtgtgtgtgtgtgtgtgtgtgtatagaaaacagcttttaaacattacagtattctgagctaagggtggaaattcacctcagagaatttttaattgtctgtctgagtcctgatgcctcaaatttagcatgttattaatcttctaacattaccatgttctattgcaatatttttaaaatattgtaatttttaaaaatctgtctccgctactagattgtgagctctgacttcaaagactatatcttatttctacttctttcctcggtatggaacatcacacctggtgtacagtcacactagctatatttcaattgctcagtagccatatgctacagtactgcacatcacggatataaaatatcttcatcatcgcagagaattcacatcacagtcctgatttagagcaggatgtctgaaacttggcactactgacatattggaccaaataattctttgttgtggggggctgtcttgtgcattacaacatgttgagcagcatccctggcctctgcccacttgatgacagcagtatccccgcccccaatgtgacaaccaagaatttcttgagatactgtcaaatgttctctggggatgaaattatatcaggttaagaactactgacttagataaatactccctgaactagagtcctggaaacctttaggtggccaagacttattctaaagaattgctaaaaattattttcttttaaaagagatgccgggaggagagagaggagcagaaaagataactactgagtagttggcttaatacctcggtggtgaaataaaatgtaaaacggacccctgtgacaccggtttgcctatgtaataaaccttcacatgtaccccacaaacctaaaataaaagttaaaaaaatgaaaagaataggaatagattaaaaaataaaaataaaagtgatttcacatataacaaatgtttcctatcattgcataaggcaatgctgcttaataaaagaaaaatttagtatagtagaatcgtgccgcagtcatgagaagcaacccttccccatttctcttaaccaacacaccttgaatccatcaaattaaattcttgcataagaggtaaccaccttcagatttctttcttagacctgtatctctaaaagaaaacatccttaccactttagtgcagactggcctggctttcaactatgaggatccacattttttttccctaatggctttagacatactctggacacaaaataatttttcttgccaaggtggtatgccagaaatgctaggaaaataattcccccgttggaagcagtcctaaaccaatgactagcaggattttgtgtataaataccccagctcccttgcccctttgaaagaataactaactcttaaacacatgtcttcaatccatttagaatttccccagtgggattaaactccactagaccagtggcagttggcttgataatgcattttttactgaatgatttctcttcacagtctcactatcttacctcacattcatctctgccttctgcagtagctggtgcttcacatttctaggacttcccaagttctaagtacttggaattcaggtttccaagatatgctaactcctccattctctgcatattcctaaattttttatcttttttattttattgtttttcctcccagatttttttctctttgtggtaaatatcattttaattcccctattctcattttagtgaaggttaaagagacatcatttttaaccagaactccctataagtgatctatggaaagaaaaaattagcaagaaaaagacatttgactagttgcatgagtcaagggttaagtaaaggagaggatgaaatttgtgataatttaaatttagctagtgggaggttgcaaacaaagactcctctctctgtaagctagaattctttatagccttaaatttcccaggtctagtttagtatttatatttattttcctcactacttttttactgcaaaatattcggaaaccatttgtaactttaagtcacacaattctaatttaatgattaggttaaagcaacaaaatttcctactaattttgtagctctataacactcagatattggcaatcctatatggctcaaactaatactttaacatattgtttatggacatactagaaattgtactgtgtatgctaacttctacactgggatctagattttgtacctctggatcttttctaagctgaataaatatgttcatacaaggttgtactctggttaacattctgtttatcaaaagacatgataatcatgtatatgaaacatgagaaaatttgaatcagttaaactgaaagatctacttagaaaaacatctacttcttctccgagtcacattcttgtgaattctggctttttaaaattatttttgaaattttagtaagattacataaaacagcgccatgtaaactataaaggatcatatacaaatgaagcacattactattagtaattataatgcaccaccagaaataagagatagaaggccctttaacctattttgactatgagacaggaggatagaaccaattcccccaacagccagggttcagtattattaataatgataataaaatgaatctactaacaacataccaagccttcacaatatgcagggcaccgtactaagtgctttatataagttttctcatttaatcttcacaatattaatctctactcctattcctctatttagaaaccagacctggagtgattgagaaacttgaaggaaaatcacacagtttgaaagtgacatagctagtgttcagaaacagagtctacactttcattactatcctccactgcaggataattccagtgcaaaggatgatctgtttgtttttttttttgtttttttttttttttgaggcagagtctggctctgttgcccgggctggagtgcagtgactcgatctcggctcaccgcaagctccacctcccggattcatgccatcctcctgcctcagcctcctgagtagctgggaccacaggcgcccaccacaacacccggctgattttttgtattttcagtagagatggggtttcaccatgttagccaggatggtctcgatctcctgacctcgtgatccgcctgcctcggcctcccaaagtgctgggattacaggtgtgagccactgtgcccggctgcaaaggattatctttaagttaaacatagaaataaggatgtaaaatggaatttagaattctgaagtctatcaacaaggaaactagtgctatgaaaagctaggtaatttgtccacaaatacccagtgctacctgcggacagagctagaaaagtgcccatatggtcatttacttcaccaccaaagtgaaatgcaccaaaccaaggggaaatgacttctctgggagtttaacaactctacttttttttccctcatttaattataacatggtctgttaacttgcaaccctctatttgatgtctcttcttttttcagtctttagcaaattccacatcgtatttggccaaatcagacataaaattaacatcaattcattctcaagagacaaaataaaactacgattttctaatcgtagttacttttctcctaatcttttgcaaatgtcaccttctctatgaaaatgctatgttcaaatgacctgtgtaatatttcatggctctaatgcaatcacaaaatatatattcggtatcaagatatataagatacatgttaataagtccctctaaagttgtcaaatttacactatcagaatgaaagattcctgagggctaaataaattttgtctctacctttcctcctcttttacaatgcctggtcttgttgtataaacacggtgtttcagtatcttcttgatgataatgaggtggatttggccaatctagctatttaaaaagtctgctctgttcttttaacttagttttgtagatgtataacaaaactagttatggaaattctctgagatttagataaatcattttttcacataaaattggtgctacagaaataatatgtggactataagctttcactattattgaacatttggccatatctatgaactattgagacagttgaaaaaaaagccacagctggaactatatcgagctcaactctgcaacttaattgtgaaataaatacaataataataattgtaacagcaggacctaaatcatgctggtgtaactgctgggtttgtcctcagatattaactctaaaggttatattcattgtggtgccacctgtttggaaagaagggcacatcaggattttgagtacatattttagagttttcctttggtactgtaccatataatatggaacactaaaatcacaataaaatgtgtctgctttgtgtgaaggtaagtaagtgccaagcttattgtaaggcatttcaaatcttggacacaacgccttttatatttcaactaatatactgggctgttgggctgtgctcatttttataattacagtagtttcctacataaacagttttaaatggacccactgcaacatgccaagaaataattagctcctatcatttaatcttatatatttatatgtatcatagcatatgttggcacataacattcacttactaattcaagcatcatcaagtaagtctagatcagaaatatatttagcagttccacctctacatactctttcagactgagctaattagccactagttacagagaaaaagataatactttctaaaatatatatttagatattttctaaaataactttactttgaaatggtttaagaccacaaaacttgcaaatatagtacagagacttctcacgcaccttttacccagcttctcccaatgatagcattttaaatacccatagtacattatcatcaaagctaggaaactgacattggcacaatactattaactcaaatacagacctcatttatatttcaccagttcttacatacatccttctaaataaatatttattttaatctggcttaaatcctaagtcttatggtaggcaagtatgttttatagcggttttaatatcattcaaaattttctaaataatgttcagtgtagtaaaattataagaatgatattctgatcacttaattcaaaactctttgctttctgctatgggactgttgccacagaaaatttcaaaaattacttttttttttttttaaagacagaaagcatcttgaatgagagggcctgactttgtatccctgttaatatgtacgttctcaattactccatagaaaccatatatgaaaagtttagttctgcttctttgctcccaagtctcatttcttactagcatttttcttaacatctggttcaatgttcacagcagatcagctttcaaatacttttttttaaaacccagaaattagtcaattttacatttacaattataggtcctttaggatattctaacaagtaaaaatcctaaaggcaaaatgtatgttttcaagtaaaaatatatgaggttgtttttttttgacagagtctcactctgtcacccaggctggagtgcagtggtgcaatcttggctcactgcaagctctgcctcctgagtagtgggactacaggcgcccaccaccacgcccggctaattttttgtgtttttagtagagacagggtttcaccgtgttagccaggatggtgtcgatctcctgacctcgtgatccgcccgcctcggcctcccaaagtgctgggattacaggcgtgagccaccgcgcccggccgatgagttattatatatagtgcttcatattatccatcactgttcctatgctagaagtcactcacaaaagctaaagagttggcatagctatttagcaaatataaacaaatatctgcttcctaaatattttaaagggttagtcattattaatttttacaaaatgtattgcaatcacattaatcgcaaccatataatatctttgtaatgtggatataagttattcaataggcattcgttgtgatattactttaattaatacttgttttttgtaaagtattacccgccttttgatggcatgtccttaatgactacccctcttttggtgagtgccagatcactattaattccttttgtattcattataacaacatcaatcagggaaagctcatttgctattaatgtgaatataacaggtaattccattctaatctagtagtgattaatgttcacttggtagtaattacaatatcacatttcagagtgttagcactggacaatacttattttgtgtggccttttaaagaaccacagcagcttgtctggacttagaattgaaaaggttaaagaaaggcaattaatctaaggacaaagagaaaggattcttatgtggctgggaaaggtgaataatggttaagtgaagggtttacaaaatttgttactattttttggtcaatcagtatgcttcatatgtacccagtaatatcactacttgacttgtaaaacaaagaaaactgaaatcgacatgtttaaaaagccactgttttagctccatgatgccaatgaattttcaaactacatggattccctgtcctaaatgacagattactatcaatgtgagagttacaacttatctttaaaagaaggggcccttttgatgttatcattttatttgtaaattagtaaaaattaaatgttctacctaattttgaaccaaaattgcctttatattgaaaaaaatcacctaaaacacatcgatgatatatattaatattatagctttattctattttaggtaaactatacaaacttccattaacatcaaccagagagactcccacacatattgacacaatatgttatgttagatcagagcagtgctagtcattgagttttaaaatcctggaaatattaaacttactggagaacattataggttatctgtaggcatcagagatttataggctatatggggtggaaaatgcatgtgaacctcaaaacaaccttgaagtataggcaagacaggtgtcattaatcttatttcacagatgcggagattgatgctgagagaagttaagagacttgccctaaatcccactacagagcatttactggaacccagggcttttaacttattttcttggtctttccactgcagcccatgccatcctgcctccactcacttgtgacagcctgtagagaacagatgtaagaaaaattgccaagagtttaggagtatccaaataacaaaaactatcagactattagggtggccaggggagaaagagaagagaggaaatcaggaaggctgggatttttcaaaccatttgggcacaccccaggtttattcctgacatattgaataccaagtctgtaagtcacagaattcaaattacaaagaccatcagaaagcaagatttttgatgcgctaccagagccacttagactaattcagaaactaagatgaggctggcctataaatgaagcttattggtagatacaactggtactccagggcagcaaagggaagataaataaatctgtgcaatgcgtcaccttggaaaagtcaattgctatttatttaacttcatttcaaccaacaattattattaacaacaaccacgtatcttgttgaaaattatgaatagaatgattaacaggacaaaatcattgccttcaataagttcacagctgataaaggctctaaaacagggctttccaatgggtatgctaaggcacatgccctgattgggttataggtacttcagatatcgatccctctcagccctgggatggttaggcagcttagagtcttcggccagcttacctgatatcatgatgaacacatcaacttaatctgttcatcatgatatcaaaaagactgaggaacactgcagagaagtttgggctttcttacagaacagactgactgtatagcttagctgagggagatctggagaccagaagatgtttccaagaagtgtgataaatctcagcttaagccagaagacaggtgagagtctttgtgaacatttcagccagtttaatgagcaatccaacaacattaagacatgtcaagattagcaagcttcagattgtgtgataaaagtgcaaagagttcgctagagccatactgaataatttgtctttctcttctacctttgtctgccaacaattctacccattggccaaatgcttctttctctaataaattcttgttcttgcacaatcacttgctcctttgaaccacctaaatcgctgtttcccaaaatgtggtttgctgaacagtagtggtagggagccaatttaccatgttacacagataaacagcttatagtttaaattttaatattcatttagttttatctgtattaaggaaaaaaacactgcaacatcagactacagttttgtgggaattatcacttaaggctaaaagcagaaaacaaaatgagctgattttaagaaaaacattaagtaaataatagtatatgtgttattcaaaagattgaacaatggagcgtatatttgtttcctattgcttctgtgacaattttccataaacttactggcctaaaacaacacaaattgattatcttatagttttggaagtcagaagtttgaaatgggtttcatggattaaaatgaaagtgttggcagggctatactccttctgaagaagcttagaggacaatctatttccctgccttttccagcattagatgctaccaacattgtttggctaatggcccctttctctatcttcaaagccagcaggggctatcttcatctctctgactcccactctcctgcttccattttcacttatatgaaccctgtggttagattaggcccatctgaatagtccataaaatctccccatctcaaagtcacctgcttagcaaccttaattccgtctggaatattaattccctactgccagggagcacagcatattcacaggttctggggattaacatcttcgaggggcccatgattctgcctaccacagggggaaataaaacttgctttagccaatcggatattgcaggcttaatggaagcaggggctcaacaaattgtttacatgtttgcacttccactcttcacctcagccttcacaaaaaggacttgctcgggctggttagcctgctggagggatgttcaagatgtgagcgatagagctgtgttgacccagccactttcagacacttaagctctcagctaccctccagattcccaagggagcccagtcagagcagataaactacccaatgtaaaccatcagcccacaaattagtgaactcaagaagtacctactgttttaagctactgagttttgaggcggtttggtaatggactgatatactattatatataactgatacagacataaaatgatacttttgccaggtaaactattaaaacaaaacaagatttaccatccactgttaccatcatattgttaaggaaggggtatttcaaccacaagaaataatcagaaagacatagtctcagcctaaatggtaggctgtcctaagaaaggaggatgacaagctacaagcttaaataatttctctttctctctctctctctttctgtccttatagttctcatttctctgcttattgaggaaatcttcttcacagatcatctgcatttgagaacctctgccacacacgacttaatgtaatgctttgcacattgtaaaccctcaagaatgttgttaaatgagtaatcacaatgtgaattaagtcattcacaatggaatgctgctaattctggaactgagtaatgtggtcattgcagtatactaagctgcgtgaaaacttctagaaaaaaattatagagaaaagttgccttctcctttattttagcaatactattgcagcatataaaatcaagctgggactttatgggaagctgcgccttgctaatttaaaaggacacactgactacatgctgattggcttggggggaaggattgcttaccatgttgttttgtttctattttaattttcacctgcctgtctgcgaattttccttaccatggtaatggatttaaattaatcaataaggtgttatgaagatttaatgtcaaatacactttaaaaacctagtttgaaaacttccaggtctatttagcacatgtcgtagtgtggcttaacccatggtgcattaacaaaataaaggtcaaagttaaattttagaaaaaggggaacaatattcctcacaagacattccagtgggataaaaaacacaggtttttttctatattgacaaacctagattcttaattataataactcttcctaatggtctatatctaatcaggtacagtggaatattaataaacatgttttatattctctggttatattgttaatggatacttcaatgcactgaattagaaggcactacagtgcatattgttttatcaagggcaagtttattttgcttcatctatgtaaaaacacattattttttgaaaagataacttattatttaagggtaagagtattagaatattaaaaattgatcacagaaagagggatggatagatgaatatgtaataaatcaagtatagtaaaatttcaatggcaaagtataggtgctgggtatacagatgttgaccgtaaatttctttcgactttgctgtatgattagccattttaatattaaaacatcgacaacaataatcctaaattgtaagcactgtatctttacatacttgtataccagtgccaccattttgtagctaattccttttctgtaaatgtgattattaaacctttaacactgaaatatctggcacatgtatacatatgtaactaacctgcacattgtgcacatgtaccctaaaacttaaagtataataataataaaataaaataaaaattgaaatatctgaaacaaagttttagggggcgtgttcatcctgtacaacttactgagagatttgtaatgccctatggaccagaggtctagtctgaagtttgaggttatttttaaagaaagaataagaattcgttgaggatgggaagttgggtagaaggtctttgcggcagatggaagtattgggacgtaaggtggataatatccaggcagccttaaattttctgccacatatatcactcaaggagagtggaagaaatggggccttggagagattatgtcatgtgtgaccttgcatgctacaccaaggaggtgggaatttatcttaaaggtattgaagaatttcaaacatgagtatgggggtgacggcatcagccttcatgtcagaagataactctggctgaggaagtgatgctagatgcagaaagaccagtgaacaagttaccggagttttctaggatacgaatagtaatagcatcatcatcagcagttatagtgactattctttattaattgcattttatgtaccttactctctgtatggtaatctcatttaagccctttagtcaccctaagaaacagaaaactttatgaggaaactgaggctagaagagatttaaaaatttgccaacggtgacaagattcgaatcaggtatgcttgacttcacagtgataagggcctgaaaccatagagaatcatagagaaaaatctgctttaagacagacttaggaggtaaaatttgcagtcttttgtgtcagtgtagacatatgcataaaagagagaagtctcaccagaatcagaagtttctagcttaaataattgggtagatggtggtgccatcttctgaaatagagaatagaggcagtaggggatttcagtttgggacatgctaatgttaaaatgtctgtggccatgagtaagactcaaaatatttgacaactgctttagcaaaagcccaaccaaatagagaaaacactactcagtacaccctacctgtgcttatcagcaggtaccagtcctgtggtctaaatatagaagttcactggggagttgcagatgtcaatgtagaatggccaagaggggtacataggcagcatatgctttgagagtcatctgcttatagatactaattagagccgtggatgaagatgagatcacagaagagatgtggcatggaaagtgaagaagtgctgagggtaggatctggggagcagccatacttattatggaagaggctgaggatgaatcatcaggaaagagactcaaatgtcctatggagacaggtcaggtgaaaacctggggaagagggtgttagagaactaaaggagaaaattacaaggagaagctgagtcaggcaatttggcagggggtaggctattgattttcttagtgagagcagtttgcctggcacggtaggagtaatagccagataaatggactgaaaagtgagctgtgggtaaagaaggtgagctaggcagctctgctacattttcttttctttttttaaagttctatgattaatttttattttaagttccgtggtacatgtgcaggatgtgcaggtttgttacataggtaaacatgtgccatggtggtttgctgcacctattaacccatcacctagagatatatatatatatattttattattatactttaagttttagggtccatatgcacaacgtgaaggttagttacatatgtatacatgtgccatgttggtgtgctgcacccagtaactcgtcagttaacattaggtgtatctccaaatgctatccctcccccctcccccgaccccacaacaggccctggtgtgtgatgttccccttcctgtgtccatgtgttctcattgttcaattcccacctgtgagtgagaacatgtggtgtttggttttttgtccttgccatagtttgctgagaatgatggtttccagcttcatccatgtccctacaaaggacatgaactcatccttttttatggctgcatagtattccatggtgtatatgtgccacattttctcaatccagtctatcattgttggacatttgggttggttccaagtctttgctattgcccatcacctagatattaagcccagcatgcattagctatttttcccaatgctctccctcccctcgccccaccccccgacaggcctcagtgtgtgttgttcccctccatgagtccatgtgttctcattgttcagctcccacttttaagtgagaacatgtgatatttgcttttctgttcctgtgttagtttgctgaggataatggcttccagctcctcaaagatctagaaccagaaataccatttgacccagcaatcccattattggttatatacccaaaggaatataaaccattctattttaaagatacatgcacacgtatgttcactgcagcactattcacaatagcaaagacatggaatcaacccaaatgcccatcagtgatagactggataaagaaaatgtggtacatatacactgtggaatactctgcagccataaaaaggaatgagatcatgtcctttgcaggaacacatatggagctgtgctacagtttcacaaagtttggccatcagaagagggagagaattgacactaggtacaggtggaggggtgaaggagcagcaccggtaagcttggacaattgtttgtttgttaaaatgaagggtaccagagtggtaagctgacagcaaaggatcagtaggaaggtgacttaaaaagtatagaaggaggagattcttgacagaacaaggctcagaggagacggaatttagaacagggtgttagcctcatactcttgcaccttccatatcctatagtcacacaatagccagaataagttttttttttaaaggaaaataagtcacaaatttattggctattttcccaactagaatgcaaactccaatgaggcgcggtggctcacacctgtaatcccagcactttgggaggctgaggtgggcagatcacttgagcctaggagattgagaccagcctaggcaactggtgaaaccccatctctgcaaaaaaatacaaaaaattagctggacatggtggcacttgcctgtagtctctgctacttgggaggctgaggttggggggatcacccgagcccaggaggtggaggttgcagtgagctgtgatcataccattgcactccagcctaggcaacagagtgagaccctgtctcaaaaaaaaaaaaaaaaaaaaaaagaatgtaaacatataaactccagagggtgggaccactgttagctgcgagggacccgacttgccgaaccagtctaagatatttctagttactccttttctcttttttcgccctgtgaacaatttaatatttggcttcttccttttttttttttttttaaatttcttcctccctactcattcccactcccaaaccaaccacaaagctaacctcagctttttttccaaattatcccttttgcttgctatgaacacaagtttgaacctcagctctgttggtgataattttgcccataagaagcttctggcaaaaataaaacaaaataagtctttaggcctcattctttaggaggttttgctggcctaaattgtttttgctttttaatggtattttaattagtgtttcaccaagtgtggttctcaatcagcaacaatagtatcccctgggaatttgatagaaatgcaaattatcaggcccctctcataactaaatgattacactttgtggagtctcttcatctaaatgtcttcagtggcaaaagccaatgaagaaaatctctgtatatagttttttttttggtttgtttgtttttgtttgtttgttttttaatggttctcagggtttggtctctagaccaatgccatcaaaatcaactggaaatttgtgagcaatgtgaattctcaggtcctaccctatctgtaactgaatgtaaaactctaggcatgggaccattcaatctgtatttctacaagtcctctagtagctttgatgcatgttcaagtcggccctaaagtgttggatttataacctataactgtttctttctagaaaacaactatgtcgggggaaaaataaaaagaaagttttctattaattaaaaacgtagaattcaagagctaaaggaatctcaggacaatgattagcaaagataaatatacaaaggaatataaagtaaaaatgcaactgaaaatggctgaagagaacgtggactaacacataatgtttgaaacagagtatactatttaaaagctacatatgtgctaaatctcagaattcttctttccatgtgctagtttgagaggcaatttatttctggcacaactgccatatgcatttatactaatgtgaaagacttcttgtaatgagaaggtaatacactgcatttagtaaactagttttcaatgtgagaaaaatgcctacatgaaaatgttgccctttaaaaagcttcccttgactattcctgtttatattcttgatagcagaatagctttgggaaatgttctgaatagaatccaaagctactctaaagataggctgacaaggttgtcaccatacagttcctatgtaccatgaatcttagaatcaagaacgtttgaatcaagacatttctcagagccaatctgagatatgtgtatatttatatgtatctatttgagacaactctcagggaacaagacatcaaaaacaaattgatcaaaaggttatacgctcaaatgaatgttgcattttaacgcagtgagtaatggtacaatttaggaactaaactctttttgaaactgcctttcaagacagtttgcaattacaaaagaaatgttcatgggtatctactttttttatttgaaaaattgattgcatctaggtttaccattcatgcattttgttcaacataaaaatattttagactgacaaaaaataaattctactttcaaaatataaaaatttgatacctttaaagatgttaaaaaagaaaaagacacagaatagtaacaacaacgtaggaataattgtataggctcctaaggtgaccattaagaattctaacttacaggtattaagttttttatttaaaaaaatcagttgttcgaaggaaacacaatttcaattagacaggaggagtatgttcaagagacctattgtacaacatggatactatagttaacagcaatgtattatatacttgatacttgctaagagtatactctaagtgttctcaccacaaataaagtgtatgtgaggtaatgcatacgataattggcttgatttagccattccacaatgtatgggtatatcaaaacatcatgttgtacaccatgaatatatacaacctttatcaatttaaacaagataattaaaaatcagttgtattacttaagttgcttgttaaaatatgtatctgttactgtaatcaatacaaataattatgaagcagttcatgcatgctggcaaagccagtcaagccattcgtaagtgcctctcgttggcagtgaatgtattttttttccttggcctcctaaggcccttatgactttttctgggtcagctttgttaactcctctcacttagctccattctcaatggtcagcgaggcttgggattagtcattttcacttttcttggtacatggacctctctccccccgtactctcagtatttcaattatcatttgactgtagataagctcccaaatctttatttcagcttaatattctatcctgaatttcagactcacacagccaactgcccaagaatattccctgaacttgtccgccttttggatattccctaaacaggacacgtcctaaatcagtgttctcaaagcctggtccctcaccagcggcatcaaaatcatggaagaactttgtagaaatgcaaattatctgtgccctccccagacctccccaattagaagcttaagggtaaaacggtcatctgcatattaacaagttttccaggagattccagtggagctaaagtttgagaaccactgtcctatatcatgcccagcgtttactctgtgtatttataatgtttttaaaaaatttccatattttatggatgcttgaacatcttgaggtccttggaaggccagggagagactgcccctcccagggctagctaattcctaaagatagcaaataacttgtaaacttgctcccttgtggatttgttggattgcttttcgttatacaaaccaactaatccaaagtccgtatccccaactaccttcttcatctaactgttgttacaccaaaccaatatttcccccaccctaactttttcccctcaccctagggcttggtaccagacaaccagagaccacttttacagccaggaaattttggaaattatttgaactatccagtcctaaacttgctcagacttgcctattctacctcactcatttcttttccttggaaaccacaataaagggtttgggctgtgctttccttttctgcctgctgaccgactctggaacttttttcctgcatggctttgcatggcgtagtatgtactcttcccttgagaactgtgagtaatcaaacttcttttaatggaattgatctctctatattgtcattcagtcatttctgtaaagcaaatccctgtgcaactaaaataccctgcccctcccaacataatctaagtcttgggttccctacttcggtgaaggtttctagctgtccaaaaagtagaaactttactttttccttttgtatattaatccattactagatagcaaagtctatgtttttttttttttttttcaacttggaatctattaacctctttcccccacttataccaatactccagtttaagccaccagtgtgttcaactgggcttcaataacttaacgaaggatatttttgcctcagtttatgcccttcatttcaatccaatttacctttttaaatgaagtcactcctctgcttaacacagaacctttagtggtttttaccattgtcatgcaagtaaaaaaaaaaaaaatctgacccttactaactttctagcttcatctctcccaattcaaactctaggtttaccaagcagcaatcctctcaaaatcactttcccatgacttcagacttgtgcacagtatgttgcctggcttagagaatactcctcatgtttccttccccctacctgaccaacccatctcttaggtctccatttagatgtcaggaggagcctttcttcatgccttcaggctcagctattctatcattccgggttctatcctatcccatttcctgctatctccctgacttattgggggtcctatttctgtcaaaatcagcaaaggaaagcgggtaggggttaggggaagaaggaactgggggtgagaaggaagacaatatgcatcaggataaaggaatgagctgttggcattcttagttgaaactctgaaggcattttccatgagtgtaaacgctataatcactttcacagatcaccttcaaaaatactgccatgtttgacctcttatttagttgacattgttatctagattgacatttattgacccattttgttttacttagtctcaatgtaagcaatgatatcttaaaatcaactgtttatagtaccggctatatttgcctaaaacacattaaatagattaaattaaattcacataattagaattttatgagagtgagaaattacttaatgggtacaatgcatcttattaaggtgatggataccctaaaaggcctgacgtgaccattacacaatctatgcatgtaacaaaattatacttgtacctcataaatttatataaataaaacaaataaactcaatgcctcccaaaataaatacataattgtcagagtttgtaaaagtatcaagccatgtgccatgtaataatattccattttcattcttccagtgggaagtaaacaataagggaaaaattatagatgacagataatgtatataggtatgtcataaattgaattagcctaggaaattaattataatttatatttctccctgtggcaaatgtatttcaaataccacacatcttaattgtaaactaagtaaaaaaaaaagactacttataatctagaaggcccttgataattgaaatacacttagcaatgaacaatcgagtttattttgctgattcacaattcacaagtaatcttaaggtcaggtttctgattgctcattcgtagttgttttccaaagtgttgataatctaattttgtttgtgctccaaatgattcttccaatgcaaaaaggtcccagctgctttgcaaaggtaggtaggtttgcctaaaaatcaagaacgacatcacccacaagacattttcttgttaagttgcgaagtaacttttagtatattttcagactagtgttttcctagactagtgtaccccatgcatgatctgaatcagacttgctcttaatcttccattaaaaacaagactttcattctagatatgaattttagtctgatatcttattcttaaagactactttcttatcacaaagttctcacatcaccaatatccaaaccaagacatttaagacaacattctcaggggtgataaatgactacagtttttgcgcttttaaaataggcttgggaaatgacctgtattttgcattacgtgcatcataaacttctaattgctcttacagagtgttctgtaaaaaagaatatccaccattctttaaaaatactatggcattaagactgaagccctgagagatgttaagatagactatttaaactctgtagactacatttgggaatgcttccaaggttagcagtgaagagtgactcatcagtgaagggccggaagttcttttccttttggtttaatgtggatctctcaaactactttctaatatggtaaccactagacacatatggctactgagcacttgaaatgtggctgatctgaactgagttgcgctgtaagagtaaaacttaccagattttaaatacttaacggaaaaaatctaattaataacttttgtaacaattacatgttaaaatgacaatgttttgggtatattgggttatatacaacatactgttgaaattaatttcacttctttatttttattttttcagtgtgcctactagagaaatttaaattacatatgtggctcacattttatttctactgggcagagctgctgtagtaaaatgaagagaacaagaatagccccacagatatcttagttttcattgttacaagccaacaatttattagacaattttctctgacttgaaatgacacaaaaatctcagagagatcctgtggtgtgagcgtttggagtcagaggcctatttttcatggaccattgttctggtttagtttaacaaatctactatagtgtaatatagtataaactatttttgcatttttgttcatttagaagtttatgaaagtcagcaagatgagcatttttgtgattgatgtatgatgcaataaattgcattgccaatttagaaatgtaataatctgaatttttgatcatcaagtttatgcataatgtatttttgagagaaaataaacacaagcaaagaatcaatagcatttccccagcccccaatcctcgggggagattctctctcattatatttaatttcctctttgaattaactcattttaaaagacagtaaaataggctcaaatgttttaattgtatttctgatttttttctgaagttaagagcaaagtagactgagtgaattgacagatggtaatgattttgcacaccatttatttcaggactaacggcaagttctattaaagtagttcctcctaaggagtttatctcaaccagtgaatttccattcagcctttaacacttgactcaaatgccacctcctcctctaaaaagccttgcctggtcctattgggcagttatccactgcatattctcctagagcattatgccttatatatatttctcttattgaatttctcctcgctgtcccaaactagagtgtgtgcttcctgacaacatggctgaagtcaacctgagtcttactaatctctgtattatcaatgactagtccagtgcccaacatataatagacatccaaaatgtgcatatattccaggtttctcaatgagatggtattaatattgccaaatattaggtatagtgtacttaacagtatgtctagttaaaacatacatatattctacatatatgtagtttaaatttctctagtaggcacagtaaaaaaaaagtaaaaataaatgtatacatatattctacatatatattctatatatatatatatatatatatggcacatagaaatattttaatgaggaatttgatgatggccaattttcaatgatttaataaccaagtcaatttttaattagagacaatttataagtaaaaattgaccttgaaaagtgtctcacacacacacacacacaaagacataatggaataataaaagaccttctagtcaccaaattaaatatttgtcttctaaatgcaatcacttcgattacgtttgctgaaaggattacccaaggctctttttttgctacaattatttaattatactcatggttttgactcatttgtaaatgcccatctgaggttttattaatcctgctcattactatatgttgacccagtctattgtgatctcatctctaaggttttatgagcacagcctgatattcatgaaattttccaggggtttgtaaaaatttctgggtgatcatattattaaaggtagttatgtctattctcgaaaataaacatatcttttcattacaatgccaaatacatgatcgtgggagggatcaaagaagtgtgtacatgatttagctgctcaactggtttaattactcaacacttttagctatgaagagagtttagaccattataatagtcctagattttttattcttataatttatatccatatttagagcattggttactcatgttgaaatatataaagggttgaagaagttataagggatcatatttctccagattttactccagatgatcttcagagtaagtcaatttgtaaaccgcatatagaaaatctaaaagtggaaatttttattgcctccgtattacagaggagaaaatggtggcacacagtttaagtaatttgccagggtcataaaggtagctggtaaagacttggagggggtttaaacccaagctctgtagctatagaatcttccaactggatactagacaaaacaaaagttcccagagcttcgctgcacattagattgagctgagtagtttgtaagaattatgatgcccaagtcccacagaacaccaataaaataaaactctcaggaaatcttgtgaaaaccaaagtttcaaaagaatgaaactttactcaattgatgctcaaagtgtattttgttaagatgtacttgaaaatgtcatttgagcctctcttatctgattgtttacagagcaaaaagaaaaaaaatagctaacttctgataaaacccaaaaactatgaagaattccccatgcctcgtcataaaagtagctttttcctcgactttatagattttatttgattttaaattttagtccacattttcatgtgtatttggccctcaaaccaagcatgtaatttaaaaaattgttaactcatactttttcttatgtaattagagttaaaaatcattgttaaagtgaaaaaaataaaacgtttgtctatataatgaatattattgtaaagcatattaaatgttaaataaaatcctaattaatatactaatataagctcttataaagttcaaataattaaacaatatttatattatcaacatttcataagataaaacacactaaataattaaaagctcttccaccatgcaaaaatgactaaacgattttttaatttctaaagctttttgagattactgtgaaaggggacatagtttcaggaaaggtgagtaaacactatattagactagcatttctcaatttttatactactgacattttggcctaaataattccttgtggagggctatcctatgcattgtaggatattttataccatatctggcctctacccactagacttcagttgtatctccaatccagtaataataattaaaaatgcctccagatattgctaaatgtccacttggtggaggtaaaaatatcccccgccccccattttgagaaccattgcaatagacaaattagctcagagttatgtcatctctaaacaacttagcataaacaaactagagaagccctttcgacttctggtctgaagaattctgcgtgtctataatacaagtttaattgatatgtacctaagttattatcagctgatataacaatttgtgatgctttctgaatcatcaaaaaaatgttgtttgaatgcttaagatgcttaatgtgttttgtaatacagtatactaaaaaccttggaaatcattaattaactgaagccatataattttgatagtttggttactgggcactttaatctaatctgtaaatcttccaatagatttccaaactcagaattttcatcctgctctgattggttaatctttggtgggatttaccatttatccattgcattataattatttgctgtgccttatcatataaagacaaaattgggtgtggagtagttgcccatactttccagggcatatcattgagacccacactcagtaggttattatgttctttaatggtttacacattgaagggaagtttcacctttcctgaaactataccccctttcacagtaatctcaaaaagccttagaaattaacaatttatttagtcatttttgcacggtggaagagtttttaattatttaatgtgtttatcgtattataaaacattgatcatataaatattgtttaattatttgtactttataatagcttacattagtatattaggatttttataacatttaatatgctttatagtagtatttgttatgtagacaaatgattcaaatatttgcctcattgttaaaagctcacttaaatgttttgacataagctcacataatttgaaaatattaagaatttgaagctatagaatttgaaaacattaatgcattgaattccatatggaagaaagtctgtttagttgagggacttcaatatgcttccattttccacttctgaagatctgtttcggctcatggtaaatattacatctttaccctcgctccccaaatgcttcagatggattaagcaccattctttttgtgtgggggagctggagagagaaatagatgaatatcttccacacccttgattccatcctaacaagtaccaataaatagcaacttctcacctcctctatagaggttgtcttcaattaaaaatacactagagagattataaccatagaaaggacattgagtagtgctttcggctaattggcagtacattccttccaaaatttcagaggtacctcaatttaatgactcccctgaataaagtaattggttgaaatttactttgcagttcttaatataactttgggcccatcattagcaagaactctaaaaaggaaaaacaaaaacaaaactggggtcagtatatatttaaatgaagcacaaggaaaaaaggtatttcactttcaaaggacctatgctgttttttttttttgaagattgcaactcatctattttataatataatgacaataatattgcctctgagttaactgtgtaataattcactttgggtactgcaataattgagcaaacagaagctggtaccagaggcattcctttcttttatttagtgtaatattttttcataatttaatgagaaacatttcaaaagcaacgtttttatcctttcatgttaaattaatttacaatgctataagctataataaaatgagagaaaccatcagcaaaaagcaaaagttaataaagacagatattcttaaagtttcaaggactgaaaaaagctcaaatcacaaaagtatttggtttctcctttttttgtggcttggttcaatttgtcataatttgttctcaattattttgtacttacagctagcataacataatattgatgaaggagaaaagatgcattactgaaagtaaacatacataattaaaatcacctaagaaacaacaaaactttgcgatgtacttcagtaaactactctaagatttatacaaagaaggctatgatgtaatttaacatgtactggtataaacttctttgggcaaaattcaaaatttcaagcgatgatgaataaagcataaggaaagttcatgttattggaatggagttctctgtttaagcatattatggacactccaatttgacagatactactctgatacagcttaataaatttgtattcagctgctgaaacactaacgagaattgagaagacctgggctgttggacctttgaagtccagagatttcaactctcagaacctggttttcatctttaattgatagaattggacaacctcaagaagagagtagtttcacttggagtgatggtgctgggctgctcatgaggattctgcaggttaaatgcagtcaagcactatagcacggtatcaggttatttgctatccatagactagataatagcaaaagtccttgcaaatttcaaagttctatgactcagtgagaacatttattatttagccagcaagtaagcacatagcccactattcagcatgtgtctgtacatataacatcctagagccctactactcaaagtgtgcgccagagactgacagcagcagcatcacctgggacctactgaatcagcatctctggggttggggctaagtaatctatgttttaacaagctctccaggcaattgctatgcatattaagagaagcactgattcagagcattgtgagaacatagaagatattctaggctttgcctcaagaactttagttttggataaaatagatgtaaaacaacttagcaaaatctttcataatgaagtaatatctgtaggtcattcattcaacaaatattgagaacctactatttgttaggcattgtgttagtggctggggttataatagttctgcttttgtgacgcttacaatctagtgaagtatacccaaataaacaaatatataaattttaaaaatacggtttttaaaaaatactatgcaggaaataataatggtgctatgaaaacaaagaacagaaatggctttgaggggtggagagtgatacatttaactttattttaaattgttaataataatatgttaagatttagttagttgataaatcagcaaataccaactgcatgcatgctctgcacccagataagcatcttgtggaatataagagtatgccctggaggagtttataatcagttggaaagataagatttaatcaccaactataatcagtatggtgtccgcagtagaccactttagaatggccctttgttgaaactctctcctctctgcttcttacttaataagcttttctggttttccaattcctggttttctaattcactgtgcaagacaaattttaaaaagagaaatcaatgttggctgaaattaatgcagaatgttctgtggaagaagaattcaagatgggtcttgaagcagtagtagaatgtataaaggtgaagataaataaggaagtcattttaagaataccactattgttagtattaataataactccaatcattttatttctaataactggtactgtcatgaaagatgatctgttaataccacatatcagaagggttttagttcagccccagacatgatacattgtgtttataagttttctttcattactttggcaaacaacgtcttttgattttaaccttcctttcaatgactaagggggactctaataagtatctaggtagaattgtcaaagaagatgagtcagtatttacatattgactgttacaagcactacacaaatggttgttacataacatacttgaaatgaaattagagttacctacgcaaatatatgtgtgtgtatcttgtttttttttttttaattgagagagagagggtctcattctgtcacctagactggagtacagtagcatagtcacagctccctgcagccttgcagccttgacctcccaggctcaagcaatcctcctgcctcagcgtcctgagtagctgggattacagaggtgttccaccacatccaactattttttaaaaaatttttttggtagagacggagtcttgctatggttcccagactggtctcgaactcctgggctcaagcgattctcctgccttagcctcccaaattgctgggattacagtcgtgagccaccttgcctggctgtgtgtatatcttttaatgttaaacttttacagtagaaatactcactatttgcttttcaattgcttgctctgaagagcacaatgctttactgaacagagatcaaaaacccacctagttaaacaggaaataagactaataaaaatatttaatggtcttatttaacaactatagaataaaactgaaaacagtacagtgaaataaagaaaattcctttgtaccaatgtcactgcatgatatcggtactaaacaaattgttctcaggagctacaagtcatattcaggtggtcagaaactttaccttacacaatgagaaatgtagtatctgaaatatctgcaactagttaggtttaagaaaagaaaactcttaccattgggggaaaataaatccttttagaaataggattgaactgtcaataaagctgtttataataaattcttataaagtttaacatgaaaggactgtaaaaacagatgttattcaaaagaaaatcacatctgatttttattgctacagcctctcactgacttttgtctcatttttcatggaggcttttaagttttaacaaaatacaaaattgaagagctttttaaaagaagagatttatgcgatgtatagaaagattttctggagttataaaatcctgatcaccagatatacttaggaaatgattaagaaggctgaatggtaaacatagactctagaaatgtaattatcattttctctcttcttttaattattaaaaatcttgcatttaaggtctgaagtttgccagactaatccaaatttactagtgagaggcatccttgaattctccttaatctgtttagttacttaaaatgtttaagactttctaatcaagagaagcctacagtctcgaaggcataatgttctctccgaaaccaatttaactttaggttatttaattggaactccaaagaattagaagttcattctatttccttggcattcttcacagcacctggcacagtgttaagtacatattagatgctcaataaatatttttgaaggagtgaacattgcttaagagggaaataagaggaactattaagatagaagatatttaaattcctaaaattatttcttccctattcatggagaggatatgattagaaagacaattgtatatagttttaataaaatctatttattttggttttgtttaatgcaattccacaagcttttactgagtttgcactatcttgacactgaaatgctgaagacattttaaaaattacagaatcactcaagaagcttaaagtttagtggtgtgttaatttgcagatgatttgattctgcttttaacttgtttaaggacagtgatctctgtttaatgccacactgaaagtactatgtgttcataataaacaatttctgaatgatcttatgagctcattagtatgtctcatgtggtttattgctttaaaatctcataatcaactatggtcatttttttctgcactagaatgtaggtcactgagctcaaatttatttcttatttttttttgatagggtctcactctgtcatccaggctggagtgcagttgtgccattatggctcactgcagcctcgacttcctgggttcacgtgatccttctacctcaggctcccgagtagctgggactacaggcacatgccaccatgcgcaggtactctttttgcattttttgtagagatggggtttcaccatgttgcccaggctgatctcaaactcctggactcaagtgatctgcctgcctcagcttcccaaatccttgggattacaggcatgagccatcgcaccccaagtgtatttctataccttacaaagtaccttacacagtaactaaccagcaaatggcagatactccagtcatagatgaatggatatgaatctactgttgaatactaatagaaattgtaacggcacagttacatttctgaaccaattctagaggttatacattcaaagaaggagtattattattaggtgcctaaaattgttagtaaaatagacctcttactatatttatctggattcttatatcatgcaagaaaatatcaataaacaagcatgccaactatggttttttttttttttttttttttttggtatccctccagatccagatccattttcccttctttttccaccttccagggggctgacttggattacatcattagactcctatgccctatggttttctgtttgggtttgaccaaggagaggactagcaaaccactgcagagaagggagagtcttgggtcagagtattgattcccttcatctctttttccctgagtatcatttcgaggcaaattctgtccttaagagaaagccactgctcctcccaaggcattaaaatctgcatgatgttttttttttttttctttttttctgggctctgagaaacctctctccccaacaacggcttcaggtctaggagaggtgacagctctgctgctgctagtcctagagtcttgtgctatcttgtgagatttccctacaccctgcccaatcctgagtatgtagtgccttgtaaataaagactcctcaacttaccctaatctgaatgtgccatctgtttcttgttgggactctgactgactgagatatcaacacaaatacaatcatgaaacaggacacaaattcagcacttcacagagttattgcggtactatgttaatgggcatgaaagttatcagtaaactgtaagtgccataccgatgttgattgctatcatttagcacaaactatgaaaagttcagactatgtccatacacaggtgtctcaacacaaaaccagttgacatggtctaacttgatataggattgatgtggctgtactgtaacagttgtccaataatcatgttgtaaataagtttttaatatattaacagcatactatattgatacatatgtaatcacagtgttatcagacttatccagtgttaatatggctgaccatagacaaggtctcaatattccattatccgccagtctgttccagatcgtgggccacttgtacatgttcctagttcggaatcaattaagagactagctctgtgaagagacgggaagcataacctttttctgagttataagtataaagtcagccctgcattcttttaccctgattggggctgagctacattacaaatctcctttgtctcttcaagcttaggggagcttgcaggaaattttctgttaagaatttatgtttttatgaaaaacaatgatactgagacacagagtgtatgctacgaaaaaaataaatacttttagggtaaaaaaggaaaaaggtggtattaaaataaattttcccaaatactgctctttatatatttcgttagtgacatctacacaataaccatattttgggaagcaattaaacacctcacatggacaaaaatcatatcggtttcttactatttgggctggcagtaccttataaaaagaaaaaagcatcaaggcactgtagtatgatatttttgaggatgtttttcctataaaaatcttcaaatgagctgcaaatggacccaaacagacttattttaatatactctaggaccatatataataaaaggtcctatactattttatagaaatggcttctgttgccttagatgaggtttacacataaatcttttaacttttagtgctgcttgtttcacttctggtggattctttttacaacaatgccctgccaagcagttaatactacttcataaaggaagacgccaccccttgaccttcacgtttgtgacccataatgcaaggtgcttccatcatctctatcttttctagatatcacccttccttggaagtgcagacaagtgttttgtttatttgttcttgttttgtttgaggtcaattcactggctcctttctccagtttttttttttttttttaaacaccttgaaagcttctaatacatctgctagccaaaacagtcattttcattacatgcttgtggctggtcaaaaagaacagttgtataatttttattttcttacccagaccacaaacaggttataaaaagtacatggcccttaaattttggcggttcctttaaaatttagttcaaaagccaacatgaagagtcagatggaatgactgtcacatggaagagctaccaagcagataataagtttagaactcttaattgaaaattaacacacctacattgtattcccaaattgaagaaaacggctgttttggctactgctataataagatgctgcatacttcacatgctgaatctggaagggggagcaattcagtcctatctgacggttgttcctaagctttagtataacttcaaagatgagggtatgaaattccgtcatcgtcagagagatcctgctttctcttccttgggttgcaaagttagtaaatattagccttccattttaactaactcgttgagcttgtctccaatagaagattgaattattggcctcaatcctttcacatccctagtagtatcatacattcacgctccagccatggcctcacataggtggaaagtattttcctaccccttgactttgggcttggccacaagacatgttttgtctaatgggctataaacaaatgtgacaagaggagagattttgaaaagtgttgtttgtgcttctgtcattgccttgtgctactctgtcataccccgagtagctgatgtcccttcagcttgagtctcagaagaaaatatgtggtatagacccgaacagaaccgacggcctagagataagcatagctaaaccatttccagccatgattggccaaaccctaccaaactgcagctccatgaataaatcaatattgttgttattagccactgaattaaatttttttggttgtttattgtgcagcaaaatggactgatatgaactgaaatgtggtttataatcaatacaatccagtaaagttctactaaatgtatgtctatcaagcaaaagaaaaaaaacagatgattagaaagttgtcaaattcttctaacaaagtccatatacataccaggtaccagaatgagttatcaataattgcctaggggtaagggttagaaataaaaaaagtcaagttgaacccactaggtcgtatttccaggttttcaagcagactgttctggtttgcaatatttgaaaagagtctgctgtggtatgctaatgactgtgaattctgtggtctttggaatagttccaaaatgctaagctcaagtttaaaacaaaattggattctcaaatatctttcttgctcagaaaggatttaagtccttttgtacagaaaggaacaaacaagtgataaggtaccttttgggctttctattacctatgtttccagagtggtaaaactggatctctcttgttttcagtcatatctacaggttccctcctaaggatgatccttcctggtggcttctgtttacaacaatgccacgccaagcagttaacactacttcgtaaaggaagactccactccttgaccttcgcattcttgacccataatgcaatgtgcttccacaatctctatcatttccagacatcacccttcctgggaaatgctgacaagtacggactgtgctaaagggtggaggctgtctttcacctcctgccaccaacagcttatttgaggagagtttaagaaagaagattttaccagaaaagttccaatttcatgtgcctctttatatgctttttctgcttcttatgtagtctccaaatttgaatgacagtcttcctaactagtaaccttggaggaatataggagaccaagtgaggaagctatcaaataatttcttaacatcaacattattgaaacatagtaactcattgttttacattggaggctaaatagaatgatatgttttaaaatggctatctccatgggcttattttttttttctcatctgataagtggattcaatgatttccaagattttgttttcaactctgtgattctatggtctctggatactgtagttccaaccttcaagagaagagcacatctaattaaagttcgagacagcgccaaaagattagcagctacggtcacatttaatgagcaagtcgagtgaaggcatttttcccattgtctaggagtcacctcaataggatggaagatgcacgttctatacagtcttatgaccagcctgttcctcagcatatttttcctttaagtaccaaacaggtatatgaatttagaatataaaaagagggttgtgataagttgatattttcttctccaaagtttaaatatttgaatagttcaccagctgtagctttaaatagtgggaaataatgcagctagaagaaccatacagggaaaaagagtgagttgaaaattctcagctcagtggttatcatcaagtttggttcctgtcagcctccagcgactgtaggtggtgcttataggtattcatcaataaaaggtgcatttgaggggatttccagcattttgcttcggaggaaatcatttatgtcaaaagattaaaactgctgttttcaattgcttaattgagtatatattgaggttaaggttagtgaaagtggtaaagcagaatgaatacattgcttattacagtcaagaaatgttatacagaaatgagaaaatgtacaaaccccaccagccataaataaggaagtggttagaatgtcgctctcagccaagggccctaagtccctttgtgtaggtttggaaaaatttatgcctgtctagcagcttgtagctgtggagcagagttggctgaccaaactttgattccttctctgaccatgttctgctagccttatgtccttcagtaaatgacagttgccataaaaaacaatgaggttgttgtatactccatcattcccactactttgagatcttaacaagatcacataaccatctgaacttgaagacacagactgaattcaaataattcaggctaagacatgtgctgataacctaagaaaaattattgctagactcctaaaataaatactatgagaaagaggccactttcacacatatttttagcttgaaaatgtgtatctgcatcaattgttaaaaaaaaccttttttttggataaatgggaaagtataataaattcaattttatttttaggacatgaatggatgataatttgtgggcacaaaaaagaataatttgctaagctttagtagcagtgtaatacattaaaatgcctgtatctcttgctctaaatgaatcaattttaaatatatatgaattgaatgtatcaattgagatcttaaaatgagcaatgaatgtggtaataccaggtacagataatttatgtgttctaatattatttagaaaagcatgccataagctgttcttagctaaaaccaccataattgagaaagaaatacttgagaagagattagatattctctactagttgaatggagcagtgaaaagtagattttggtgtcgtggttttatgaaaaagaaacatcagaaaataaagttctaaatcatttccattaaacaaaaacaaaaaacagagtttttggtatggcttggctgtgtccccaccccacaatctcatcttaaattgtaatccccataacctccataatccccacgtgtcaagggagagaccaggtggaggtaatggaatcataagggcagtttctcccatgctgttctcatgatagcgggatctgatggttttataaggggctcttcctacttcgctgggcgcttctccttcctgcggccttgtgaagaagatgcttgcttccccttcaccttctgccatgattgtaagtttcctgaggcctacccagccatgtggaactgtgagtcaattaaacctctttcctttagaaattacccagtctcgggcagttctttatagcagtatgaaaatggactaatacagtagctttgtttaagcaacataagtactgaaatgaatattcaaatataaatcatataggtggataaactgatcttatgaaatggggttctgtcatagtttttggttacaataacacacaacgtacaatgttattgattactgagttagctaagaggacttctcctgttataatattatacataatatcacaacacagttgctttcgttataaaataaagtaacatgtacattctatctgagattaagagaccaatggtgaatatattcctcttcatgggatcactgcactaaaacccacggcttttatttattttacaaaaatttctagttaatgatctaaggatttagctttttattttttcaccaaaccaaggtatatattgactggaagtattctgaaactattatataaaacaaaacagcttttgacttttttgtatcagttgtttgtttgaaagttgttcttcaagtgggaacatgttttcttccattttaaattgcagtcttacagatctgtagttttcttttcatggggacaaaattcgttttaagaactctggtatataaatctctggaagagagcattcacaaataaattccgatcaacagattgcatacatttctcaatcagctgtgcagactgagcattttcacggctccagtcatttcataaagatgattcagaattaatcagtcctactgctacttttattatttatatattcacagtattgacagatttcattttcttcccactctttactcctcctctataggaataacactcatgatgtggtgcgggcagcaggaagacctatcatctgactttctttctttaaggcatcactcaactaatcctgagaacctatgaacaataatggtggatatgcagattcacatcaaacttctgtttggttcttcaagtgttctctccagaatatgaagtccactaattctttagacctcagtagaggtatgtgaagcatgtagtaataacaatggctacaatgacacataaatagttatggctgcaatcgctataggtactggaacaacattcctctaggaacaatgacatcaagaagccttgcagagagccaatctcccagaattttgagcaatcaaactccttgtgacattttagaatgcactgcatcttctcttagggttactaaaaactacaactatacctaactcacctagcaacagttcatgccgctaattcattttaaagatacattaacagtagtcttttcatatgtctctttgaattgacttggctgtgtctcttgaaaggctcaaatttgattaggccaaaatgcagaggaaattaatgttattctcttgtgccatttccctaaattcagaaatgtaaagaaataccaatttcaaatacagacaagtctaatgttaaatgaagtctgaacatataaaaagattgtcgtcaagacaaatccattgcctggttttcttcagctgacatctatttttatgtagacggtatgacttagattcagggactaaacatgaagaaattcagaataatccaattattcaaaaggcatgcaaaaactattatttaaaaaatctcttttcacagtgtttttgttttgagtactatagctttgtaaacatttaattatctagctttatgggtttcgttttaatgattgtgccaacaaatgataacaataaatccatgccaattttggaagtatttctaatattatataacaaattggaaaggaattttgtacatgattatctctaggaagacaaaccacaagagtaattaacagagctatgattccattatcatcacaagggttaaaccagaagttcatgttcactattttcatatatctcacaaacccaagtatcagttcagttctcctggaaattcatgaaggattaaaacaaaacacattattaggcaatattttgatataaggagtgggtagctaatatgttttccaaaatttagtacagaagtgtgtgtatcatctcaagattggcggtaacacatgttacttacaaaaaaatgagcagaaataaacagtgtgtttatgatgtataaataaaatataatgacatcactagacaagggaacatctactttttggaaatttatttagggcagtgaaccattaaaaaataaaacataggctttatatttttatcatacagatggctaatattattaattttcaatatgcatttaggaaaaaccaaagtatatttactatttcaattagctattgtcacagtaatgtagaataaagctcaatggctttatgcaacaatcatttcttttcctggatgtgaatggctagtgcagccctgctgttcatgtcttttatcgttttcctgagaccagcagcctagatggacgtgttctcagaatgatagcagaagcacaaacaggaatgtatagatctcttaaggcctaggctgaaaactgtcacctctcactcctgctcatttaccatttgctaaagcaaatcacatggccaacccctaagactaggggttgggaagtacattccactcataaggaggcattgttaaggttgtgattgcagaaggtggagaagaaatgggattaatgattaaatctactacagctacataacagtttctttaaagcagatgatatattgtggaacatgacaatgatgtgtacttacttatatctttgactgaattcttcagggtgtaatttttgccacaatatttacccgtgctagatgattgttatgtatttttattgttatcagtgattaacctgctgctaaatttaagaaatagagaatcttactttttttttccagattcttgtataaggaattaaaagacatattttactggaggcaatcctttaacagcggatgtgagtataggcagactgatgcaatgtctagtctagggagcagagcatgccatctgagtcacgagtcttgtcttactcaactctggagttacttacttgaagagcatatactatatgggaattataagacaacactgcccctaaggagtttgggaaaattattttcttttccaatacaatatgcaagaaaatatttcacatcatgagatttagtcacttcctgtaagacaaccagagcaaaaagtcttcttagtcagatacaccatgtaggcaaactactctctcatcacctgtgcatgcacgtgtgtgtgcgtgtgtgtgtgtgtttgtgtacacattctgtctgtttccaattacaacttacttttctcatctcgtctttcaaattcttgtttttctggtggtgttccatttttgtaaatagaaaagtaaaagaagagtgtgcttaaaaacctgctcagagggtgaatttcaaattggcgtctctattagaggactaatttgctttctatgtgcaatcctggtgtgatcactgttgcatatgttactggatttcaactcctctgcccctacctaaactcattttgagactctcacatggtaggtcgatagcctgagttttatggagctcaaatgctgacatgacttctgtcagacttctggtgtcacatttggtgaagcaccaggagaatattctaccatatttctctttcctttgtttcactaggccagagtagtcctctctcccttgggttatcagactttacacactagcaaagcatatgattggcatttttctcttgcttattacccactccattcctctctctctgtctctctctctccctctccttcccattctccctctgtccttcctgttctccctctctcctttctatcctccctctctccttcacacttctcttctcctctctctgtctctctaaaatcaactaattattttccattttaatcacattcataagtcaatatattttatgtgcaaagaaatacatattcaagaaaaaagttcaaataagtaaaacgacaacaaaaacctgtttcagaataaaataatcttctttgctagaactaaccaagttctagctggtgtctttaagacacaaatttggctagaaagttactaattaatttgtaaaatatacctgaaggagttgtgccttttacgggatacttagataatctattcaccatcagtcaggggtgggtaataactctctgactactcttctgtactttttatcttatatacagtctttcagacagaatctatttcaatacagtaaacacacatacacattccaaatcaaatcaaaacaaaaccttttttccttctcttgattaactttacttttgagaaattgattataatgaaacatgtttaacaaaatgcatttttatgataaagagaagattccctaaatcaagactgagacataattgtgaaaaattcagccagtattataattggattaagttatgggattcaacctgaaaaaagaaatttttattctgatattgtaatttggtcatattaggctaagatataatttaatgtcatgagtcattagagtgtaacattgtactagtgatcatggctctgatggaggcatggacagtttttatgcaaagggaaaaacatgaaaatggtaatggaagcctttaggtgtcatctggcttagcttttccttttgtatcttcaaaacagtgggaagaataaacaatactattcttgattggctagccactggagatggggataccaaatgaaaaaaatgctccaacacaagcaggaagtattattttcttcatttctttatcctgcaaaagcacagagactctgtcttgcagaatcatttttttttttttcaaatttcagagctgaaagggccataagcaaaacatctggtctagtggttctcaaatttaagtgggcacaagaactacctaggggctctttacatatgcagattccacgacccatccccagagagcttctgacacaatgcatttttaataaagtttccaagtaaagatggtgtccgtggtatgtaaacctggagaaacatatcttttacctagatccatcatttttcagaagatcaacctgagatctccaacagcactgacttccccaggattacagaggctagtgtttaggaacaggaccctaacttcttgacttaaaataagatattttgcactctctaaataccttaatacttctattaaaaaaagttttagagtctgttagctgaagaagctgtgcctttttaaggatacttaaaagcgaataggcttttccccatttttgtattgtggcaaaatatacacaacataaaattgatcattttaatcatttctttttgatttgggatcttgaccatgctggggtacagtgtcattcactgcttcctccagttcctgggttcaaggaatcctcctgcctcagcctccagtgtgtctgggactacaagcatgagctcccacacccagttaatttttgaattctttgtagagatggggccttgccatgttgcccaggctggtcttgaactcctgagctcaagtgatcctcctgctttagcctcccacagttctgggattacagaagtgacccacaatgcctggccatttagcctttaaattttttttatgggtacatagtaggtgcatatatttacggggtacatgagatattttgatataggcctacaatgtgtaataatcacatcaggataacggggtaccattttcttgaccatttttaagtatacagttgagtactattaagtacattaatattatattattattatcgttgaaccatcaccactatccatctctagaatgttttcatcatcccaaactgaaactcaggtactcattaaacaataagccctcattctcttcttcctccagctcctggtaacatccttcaactttacgtctgtataaatttgactgttgtaggtagctcataccagtggaatcatacaatatttttcattttgtgtctggtttatttcacttagcataatgcctctaagattcacccatattagctcatcttttgatttgctgaattcttttaacttcttgttcaagatgatgttctggctctttaagaaatgaatttctatcatttgtccaacttcaatagatagctgctaaatgagagaaagcattcagaaagggcattcctgggtgaatgaaatagacagagcctggaggccggcatagtgatgtgaaatgcattttctacttagttgaaagtcacttgaaaagaaaaagaaataggaaataagagagacaggaggagaagagaagagagatgaactaaactgagaaaaactaagactttcttaaggctgcgctgtgctcagattagtagggctatgcaaatgaggttattaacaggtatattctaaatattaattggtacacactggtatacatggaacccgatattattaaaatacctttggggcaaactatagacaaagaaaagcaaataaagaagtgaaataaagaagtaagcatctatgttgctattcgagaggtatttatcgtgcttaagatttaattttaatttatatagttactgtcatgagcattttgcagcttttaagtcagaagggaagttatttaatttatgttttattgtagaaaaaagtttaaagttttaaaaacatcagtatactggtgtatctccaattgtacacttagaggcaaggcctggtaatgctttcgagaagaggtagggctttggccaagagttgaattttccaggtagacaaggagagaaagggtattctgagcaaagataacttctcttgactgggataatgactacttgctgtttagtattcattcagctcagtgtcatttataagaaactttgtatggcagctttaattaaatggcatcaaaactttttgatacttctccatggaaaggtggagtttatgttctcatccccttgaatcagagctctgtcactgattgacaaatagaatatgggagaagcaaaaccattcttgcttttagggcaggccttgagaagcttgcagctttaatttcttgtcccttaggataattgctcttgggacccaactcttacactgtgaaaaagcccaaactgctccatggagaggtccacatgaagaaaaactgacagtcagcacctattttccaggcatgtgagtgagccctcttggaagtgaatcctccagcatcaggcaatctaccccaactgatatcaactgaaacagggataagcaagccccattgaaccttgagcaaactgtagattcatgaacaaaacaagtaatttttactgaagccatgaagttttgggctggcttgttatgtagcaaaagttaactagaataccttctctgatcttactcataagggatgcagaaggtgccccttctcttggatgactaaaggactttgtactctattataatatagcccttccttccttggctaggtctctctgtcctcctgccccaagccccaccactattaattcctcttttggggtagttccatatcttatcaacttgtatattttcatgcctgtttactgttctgtagaagatcccacttcttaatagctcttcttaaaagtcacattcaggaatccattcaaaaagtacattttccactacgggtatatattgcatgaatttcaaaatttctttcaggtcatggatgaaagatgaatttagggttgtctaatcaatgcaatggttgcatccaaataagaacacttgttttccactccaaaagagaatcaacaatttaccataccaggtgaagaagctacctctactcattgcactttttaaaactgcattgcacagccattttccaaatatttgtaaagctactgcaaaaactaaaaaggatttatggagtaaatcatgggaagaatgcctggtcaagtggttcataaatatccaggtctcattctatttggggtcacagccttgaatttaatccaatattgaattgttgaattgggagcaaagaattgaggtgaaatgtggttggctcctgagagcaactgaaatgctgcttcctgcagagaataactttctttgtaactcccagagaataatatatttgcaaaggtgttggaggtgaatagatattagagaggaaaaagtaaaatctttagagaactgaaagattatatttatgtgactcagatcattgtaagttattataatgctaatattgaatagtcaatagtcaacatgctaacagacctctcaaggacaaccacagactcaggagcaaacaaaagtaatttgttgctttctcactatcaagaaacagacattcttccatctagactaatatgatctccagtgggaaatgatttatgtctcttacattcatgaaactctctctcataaccaggcgtaatgacttcttttacctcttcggagaatggctgatttatgcacagacctttgtgcaataacttttctttaaagattgatgctgttaaacatgaaaaaaatgtgaactttctgacattttattttaatataatttagaaaaccatgtaaactgcaaaaggacctcatgtggaatgaaaatcacatgctgataacctaaattattttcaataccattaatctttgactaatacctggaatgttttattatcagaattatgaaaggcacaagagaggcactaatgtagttcatcttaaaaataatttaaaggacttaagattctttttttatcccctcaatttacactttgagaattttccagtaggatgggtagtgattgttacctatcacatagaggaatatcattttttttgttttggtctagaaagtctgctcccaaagaccaataaccctaaaaaattattcaaggttagaggaagggaggaggagaaagtgacacaaaattctttgacatttttctgtggtcaaacttttcctgaccttttcaattcttgtttggagaagaagttctgaaattatgtggatcttgtccaggttctaatggagatcaaagaaagttggcaaatagtcccagccttctcaatgttttcattgccactgccccatggtatgcatttaaaacaactttattaattttattaacgttatctatcagtcattggtgtgatttcctgtgttactcaggatgtttgggaaaaagaaactccttttaccaaactgtgtttcaggcaatctcaactttggtgtctgattgaaagagaagggccaagtcaatgtattttcccaaggagggcattatgaaagataaaatatctctcttacaattttcagtataatatgtttgttatcatgaatgagggtattcagccttgtttatatcccaagactttaaagagcttttccaaaacgagtcaatatgaacgcttaagaactaaaatttatggaagattaacaattgaagctttctttaaacaaaatggattttcaacactcacagtaaccaatatttcaagcatagtttcattcacacgtctatttctttctaagtagtttctcacacaaatcaaatgagaattgtgctctcaaggtgatagtgaaataaacaataccaaagtctatttatacatattgacataaaattacatactatatgtatacataaaaataagcctgaaaatagtaataacataatattagctatgtttattgggtgcttaccgtgtgccagaaactgttccatgcacttcagtacattaattcgcatcaccctcacaacaacctgaagaggtagctgtcattacttttgatttatgctccataatctgagagcaattcagaaatgcgtctatggtcagtaagccccagaatcacgatttaaactcaggcagtcgggcttcaaagttcacactatgaaacactatccaccccagcctctctctaatgcaatgtcagaagtactaaacgtcatttaaagtgcagagaaatgcctataggaattgagatggagacaagatgtcttccagcttgggggctcagggaaaaagggaagattcgaaaatggctttccttgaaaagtaggtaatgtttgggtaagcttagatgaaaaaaaggaatctcaagacaaaaaacaagatcatcgaaagacacagaagtaagctggctagctgttcattttagtaggagttgaaggtgcattgagaggtaaaataagaaataagattggaaacgagactcaggggcaattgtggagagccaggtgaaggagtctgtagaatattctgaagggctttgaagtcaaaaaaggtgtttgaagaggggagtcatatattattttcgttcactgacaaatacttattgaacacttttcatgtgacacacacagtcttggacaatggatatatacaagtgaataaagcagatgaaatctttgctctcatggaatttgcattgtagttacaacctaagctatgttttaggaagcttaatttaaatggaaatctgcaagttggattggagccactggtgggcaggaatgagtggaggagggtaaaaaatagtaagagtgtgaatgagagtggaggtaaggggctagtgagaaaggaatggtcataaagaattagggaggcagaatctacagaccttaaaaatgaacttgaaagtgaggcaagtaagtgggagatttagaaatgactatatgatctgaactctctgactgaaaagatggtaccgggatgaacagcaggataggaaataagacttggtataaaaaatggcctatttgggtcatactgaatttatgtcatttgtgagacatttgagtaagaaatgtcctacatacagtaagaaatgtgggacagacattggaaaggaataaaaatgttcaaatcattggattaaaggagatggagaaaagactgtttctagtataataactaacacataactgacagtaactattgactaaatatcaaatgaagataatgagattaatgaaatcagaaaagaatgcatagaattgatactgtgggcttggtgtggtggctcacacctgtaatctcagcgttttgggaggccggggcgggcgcatcacctgaggtcaggagtttgcgaccagcctggccaacctggtgaaaccctgtctgtactaaaaataaaaaattagccaggcatggtggaaggcgcctctaatcccagctacttgggaggctgaggcaggagaatcacttgaacccgggaggtggaggttgcagtgagccaagattgcgccattgcactccagcctgggggacaagagcgagacttcgtctcaaaaaaaaaaaaaaaaaaaaaaaaaaagtcaaaaaataccagatgctggtgaggttgtgaagaaaggggaatgcttataccctgttggtgggaatgtaaattagttcagccactgtggaaagcagtttggaaatacctctaagaactcaaaactgaactaccgttcaacccagcaatgccattactgggtatatacccaaaggaatataaatcattctaccataaagacacatgcagctgtatgttcattgctgcactattcccaataccaaagacatggaatcaacctaaatgcccatcaatggtagatcagatatagaaaatgtggtacatatacaccagggaatactgtgcagccagaaaaaagaatgagattatgttctttgcagcaacatggatggagctggaggccattatcctaggtgaaataacataggaacagaaaaccaaataccatatattctcacttataagtggagctaaacactgagtacatatgaacacaaagaagggaacaacagaaaccaggatctactctagggtggagggtgggaggatggtgaagactgagaaactacctatcaggtaccatgcttattatctgggtgacaaaataatctgttcaccaaactcccatgacatgcaatttacccatgtaacaaacctgcacatgtgcccctagagcttaaaataaaagtgaaaaaaaaaaaaagaagaaagaaagaggaaggaatgagtgcttagagagacaaggagacaattagtataatatatcaccctggcaagtcaaaaggtgagacatttttcagtaggctgtagtgagcagtaataacaaaatatgagtagatttctagggcaatgaggacttgataaaaatatttgcatttggtagttatggtgatttcatagagaagtgtttcagttgggaggcagatgtagaaacttgactttaaaatgtaaaggaaagatggatgtttaggaagtagaaatatttccactaatttctattagatgagtgatttgaagcttgcttttggtgatcttgggtctttccctgtaatgctgagtcaatgtagagtaatgggtaggacagtagagttggtagaagatcagaaagtcaaacttaggttcaaatgctgacttttctatatattcgggttgagcatcccaaatctgaaaatccaaaatccaaaaaactctaaaagctgaaaatttttgagcgccgacatgattctcaaagtaaatgctcattggagtatttccaattttgaattttggggtttgggatgcttaacccataattataaagcaagtaatccaaaatctgaaaaaatctgaaatccaaaaaaagaatcagaaaaaaattgatatccataacacttgtggtcccaagtgttttggataagggatactcaaccagtacttgtgtgttaccttagtagaagttacccagcctctcagtttttcctctgtactaaatatacgatggtattacatcatgcaagcaaagcacttagtacacaccttggcacatagtaactattttaaaaaggtagctattattattattaccccccttaataattgaaaaatacatgatgactttaatcccagaaaagtaaacatttattgtgacaagcttttagtttatataattgccctcctaactgggagtaataaaatttagtagttattttaacaagtagcaatagataaattacttaacctctccaattttattcttctcaaatgaaaatggaaataataggagtaccaacatcacaggttttcactaaggatcaaattagaaaatgacagtaaagatactttgccaattatgaaacataaaatatttagttattattctttattaattaatataactttgatccattgacttttaagagcatcctattagatttacatcttcagtttgacttttgtttaatggtaattcataaaattaataaggacctttcacttgaaagctttttcaaagtgctttcatatttattcccttataagatcctcacaaaagctctgcgaggaataaaacacaatggttattggaggctaacaaaattgacttttcagtatgcacagtgtcttcttaccaatgtgggcttttcttttggtttatagatataaaattacaaaatccaatagttaatttacaaagttattcaatttagtcattactttgtatcattctagataattgtttaatgtaatggcaacatccagaagtaggttttaaaggttttaatacaattaacatgtttacgtatgaatgagacatggttcatgttaccatggtaacatggtccaaaacggtacaacacttaaaatcaaatagctaaactcatattgcattaaattggggtgactggatgaaaaatggattctaattttctgcattcagtctttcttcctgcaggagataaaagaccagtcctgaacatttgtccccattgactcccttttctaaacttttaattattttcattatttcatttcggattttctctgagatctacaggaattcagggtcccaaaatggaaaataataaagtaactaaatatagcaagaagacaatcatgtgagtcttgagtattcctgagcattatagtcagaggttctcactgaacaatagattcatgggtagaacatgctacgttcaattgaactggtatctatcgagggtagagacagtagtattgtgaatgaggatggggtttttatagtatcaatatgagaataaaaggaaaaatgaaaatttccatgtttatataagaaaaggaactaattatcttattgaaaagagtttttcatgatcttggatacattatgcaaagacttttactttttccatgacataattttttttttttttttttgagatggagtctcactgtgtcacccaggctggagtgcaatggcacgatctcagctcactgcatcctctgcctcctacgttcaagcgattctcctgcctctgcctcccgagtagttgggattacaggcgtgtgccaccacacctggctaatttttgtatttttagtagagacggggtttcgccatgttggtcaggctggtctcgaactcccgacctcaggtgatctgcccacctcagcctcccaaagtgctgggattatatgcatgagccaccacgcctggcccatgatatgaattttatgccaaagctttgctaattctttgcctttttcacaattagtttattaagagggtccctataactgtctttttgaataacatggacaatagtatcacttaataccaattctgtactacagtaagtaacattttggtgacatttagatatatttctgagtggaccatggagaaattcaaataacgacataaatttgtgtgtaatataatttatttctatggcttccatgttgatgtccttcaattttaaatctttaacccagatctttttccaaaccttagatttacattcacaactgcttcaagagaggtaaggttttcacctctgatttttcacttacagatacctcaaaatcaaacacgttcttgactttgctcctcacaactgtttgccatcttgaattctgcaactcatgattgagtgaagacactaccttcagtcaatcatgccaagtggtaagcaggcactgatttctcattttacctcacattttctgctcacctccacctcccacaaaacatatgacagtgttgattttatctccaaatagctcacgtatctgttttgtttgttcaacctcaccactttgatcatcaattcttgcttggcttattacagaaataatgtcctaactgttgtccctgcatgggtctcatatctttccaattcattctcctaaccactaccagaatgatcttttaaaaacatgtctgattagtccatttccttgcttagaactaggctatgacttaaagtgataaaagtccagagtctgaaaaataggtggcaaggggcagagagagccagcttacacttactgagcccttcgagtccaatagtctgcctctctggtatgcattttacatatatcttatcatttaaacctgataaaatcctgtgatgtactcattgtatagaagagtaaaattgggactcagaggtcagacaataagctagtaagtgctaaataaggggtcttcctgcttacaaggtccatactctagctgctacatcatgctgtctttccacataatttagccccagttgatctaatttcatttcttgtagcaaccataccccagccaagttccttcagattctcacactaccacactgactaagcctttggatatggtgtttcctctatcacgaatgctcttttcaaccccatgaacctaaataactcctaacaattcttctaaggtgactttctctaaacagaggttctcactggacaatagattcatgggtaggacatgctatgctcaattcagttggtatctattgtgggcagagatatttttaaaatctcccccagtgcataagcaaggttaaaatccaccgttctaggtgagtttcctggcctctttggaaggtttagcctagtcttctgtttttgctagaccctgtccagctctctactgtaattctcataatgctattataattttgtcttaggatgtatgtcttcacctctggaatgtgaacctctcaaaggcagaaataatgttaaaatacagaggcttttgaatatatgttacaaagtgatccagtatttccacaccgacagacacacacacacacacacacaaatacacacacacacaaaccaccgaaccaaagttttacgaacaatattgaaacttacttaaaagtgatggactccttatttctattctattttactaatttcattcatttctatcttaaaaatatggattgatactcattaaagtgattatacaacccagtacttttactgaactgtttttgaaaagcacctttcttggggcccttatgatggaattagttcccttataacaagaggaagtgtcatcagagctctgtctctctttgctatgttaggacacagagagaaggaagccatctgcaaaccaggaagaggggccctcaccaggccctgatcttggaatcccagcctccagaactgtgagaaataagattctgttgtataagccttctttcccttacccaccccccaaaaaagaaagaaaatcatctctctgaacatgtttgtatcaccagacctaacaccacgacacatggcaggtgtttagcaaagatacgctgaattaataaaagttctcagaaaaattttatatatatatatatatatatatatatatatacacacacacacacacacacacacacacatatatgtgtatataatttttaaatatccagagcagaaggcattcatcgccaggcaaaataaaaatatcaaaattcactttcacactctttagacaacaatcaaaatagaaagattaaaaaatacatataaaactcaattcaaactaaagcaacaggaaggaatacactaaaggtttcttctccttagaattagggatccttaaattgcctctgcattctcagatagtccaagaaatacgatactccaatttattcaaggtactaattgtgctactaagattgcattctttcttctttcttcagaattaatccgtgcgccaaaattttggtgagaaacttctccaattttattttattttattttaatttatttttttgagacagagtctgctctttcaccaggctggagtgcagtggcgccatctcggctcactgcaacctccacctcctgggttcaagcaattctcctgcctcagcctcctgagtagctgggactacaggcgtactccaccacacccggctaatttttgtatttttagtagagacgggggtttcaccttgtggccaggatggtctcgatctcttgacctcgtgatccgcccgcctctgcctcccaaagtgctgggattacaggcgtgagccaccacacccaattttaataacatattagaaatcaaagatatcttaattcataggtgtactcagatgtacaattcaaactttatgaaacttgtctctctggaaatgttttattcatcagaagacaatttttataatggggggattgagaggagacgtaggtaaaacacgagattagggaagggagtgatttgaaagatatggcctgagacatgacccagatcacagatgaaggtatctcatatatttattgctccttagtttgtcttgctgagaaaaatatgttaattacaccacctttatgaacatcataaaggtcaccacatacccacacccccacattgtctttacaagctaatattacaatgatctctcaggggtacttagagaaccacttaatatttgtgaaactcttgtgaaatattcagaaagacagagtctttccattttcagttagttacccagggttttatggtagtactttgaaccatgaacagctttgtcaactcttcttaggcccaaagcagaaaatgttttggatagagaaataatccgattcaattacgaatatagtttttttatttaaaggataaatctgcaatttaaaaatcctgaaactttcacccctaaaggctttgtatggcgttctataaaaatacatttgcttaaaaattccagttagcatatcagaaataacaatatttataagaaacacccccttatcctgaagtacaaggacgacggtaaagttcttgattttagtaaggaaagtgagttacacctttttataatacgggaggaaattctaatgtctttcagagaagaattaatcatgttaattccattcagaatgtatatgctttatattacatgtatgtttaaagaatctatgaattatgattattgctgagagaataaatatcttacgaagtggctgatagacgaaagtgataggtagtctagcaagagctggagtctccatatatagaaaaacggattgacagtcttagagaaaaacacattttgtgaaggttttcaccctctctcttcattcactagcatttgtatgaagtaaatcatcactacttttggggtagacagatatatcaaaatctgttggcagagctgttgctttggctaggcatttcaaatttcctttttttttaatatatgagaactatgattgctatacagcatgaatctatgaatacaatgctaccagcttcttcaaatgaagtgaaaaagcatgccatttcacttttctcctacctacatattatagaaaattccttttgttcaaaataaaaattcatagaggaaaaaaagcaaacacttccatttagctgaaatactgaaattgcatgtaatctcttaaggtatgctgctttatttattttcaagctcggcatttccatttgttgctcttcaacaccagtttcttgactcaattcaatcagctgaaatgtgccattaacaataatcaatagtttcagtagttcaccgttttaccatgacatctccgagtctttcatcaaaagatcattatccaaccatctaactaaaaatcaggagttggctataaatgtcatttcaatccataaaatgtagtttaaaccttgggcaagtggatttatagaaaatacaatattagctgccagggaagagggaaactgtctctgttttaaaataattttggaatcttagttaaccttattatagttaagacgcaaatgttgaggttttcagaggctctatgggagttttatctggattttgagaataaatgtagtttatcactttggggttgagacagtaaaaagcccctgccttattcccaagctctctctttttctacctcgggtacactgaaagttatgtgtaatatgtgccttagctcaaagatggaaaagagtagcctgatcgacactggactttatgtgagcaacaaataaactgtggtttggttaagccactggacaaaaacgaataaatacattttcttgagtaacatgggataagctaagacattttctcagcataatttccaactgcttttgaaagagagatcagaaatctaaacataaaatatttattttccatgcttccatagtaaatatagttaggacacatggtgaatcttccctttaatgattcagaagcttgcagtttcttgagattagaaatagagataaattttcattatataatacagcagatataaatacaaattgtatagtagaaaatagacgtatttttgccctcaactagatttaaagatatgttttattaaatccctgacataaaataattttttagtcattgggttattctttatttttcaaagtaatctgctaaaaatagactaaaatagacttaatcaaagcttattatttacctaccatagctgatgggtaaaatgtaaacccatgtatttttatttatttatttatttgttttgagatgaagtctcactttgtcacccaggctggagtgcagtggcgccacctcggctcactgcaacctctgcctcctgggttcaagcgattctcccacctcagcctcccaagtagctaggattacaggcgcaggtcaccatacccagctaatttttgtatttttagtagagatggggtttcgccatgttggccaggctggtctcgaactcctgacttcaggtgatccacccacctcggcctcccaaagtgctggggttacaggcatgagccaccgcatctggccgggaaacccacatatctattaaaattctggagtagctttatcagcatttataatattttataataaaattttatttatgaaatagcctaagccaaatatattacagtggtacattgtctaaccatacatcgaagagtgagcaaaaaactctacatttgcattgcccttatattctatcacaagccatgggagatatctataaagtctgatactgttccaaacaaattacctccaaatgatcaaactaactcaacacgcattttggaggagaaagtggggtcaaagcaggatgatgaagcaagaacgataaattcaggagccatacattgccactgttacgtactctatgcaacagagcagcaaagtagatcaactatcatatcaaaaaagaaaaacaggagaaggagaacgataggagggagaggagaagaacttctgcttattatgatttgattctggaattattcaaactagaatatacttttcataatagtttaaaaatatcataatagtttcataatagtttttcataatagtttaaaaatatcaaaaaataaagttagtctaaaaaatcaatcatcttattataatgatttatatccaaattgtatttgagagactagtaaagttattatatcaagtcagaaaaaccaactatacataacaaaactccataatagttcaggaaaattatatcaggtattgagaataaactttaagagcctccttgtactacagaatatgattctcaccaagacttcatttaaacaaaactaccccacgttctgttttcactgtttatgcatatggaactttatggaaataatttttgtttctaggaaaaacaattgtctgaaaattgtttgatcattaactacgacaaattcagccatctcattcttattttcacagatcatgttaggaagaaagctacaaaatgccagattaacatttcaaaacatatttgaaagtaatgaagggaaactgattcagttagcaacgctaaataaaacagacaattcatacagatgctttccctgtaaaatattaaataaacactcaaaaatgtcaacttttaaaatttaataaaccaatccctaagttatttctctgagcaaagtttctccttgaccgaagctctggttttatatgcaaatgttttcctggtcagagcatgtactttttctaagacgagggtgttaagtggaattataaatgatgtttccttctccctctgcctctctcctccttgtccaaataccgaaatacatcaggctgtataaaagcaactattttgttttgtccctggcttgtcagttacaagtacaaatgctgagaattgttcaattggatccacaagagtgctaaagcggaaatgcctgacttacttgccattgtttcatcagctcttttactcccttggagtcttctaggagcctttccttacgggtagcatcctgtaggacattggcagttgtttcagcttctgtaagccaggcaagaaacttttccaggtccagggggaactgttgcagtaatctatgagtttcttccaaagcagcctctcgctcactcaccctgcaaaggaccaaatgttcagatgcaattattaaatatcagaatggtgcacctagtgaactccataaaaagagaaagatggaggaactaaattgtaatataccaacaatggggtgagttgttgctacagctcttcctttaagcaacaactataatattgtgcagtctatttactttcatttttatttaacttaaaggcgtttgtatgggggaaggcatgcaagaatgacaattacagatttctataaacccctctccacagaggaggtttcatatatatatgtgaaatatatatacatatatttgaacatgtgaaagttcaaagtacctttttttcaattttgtagtttttgttggtcaattttgaaagcttatttttaatatactgccaaatttgagacaaacctttatagttaaaaccctaaaatccctgtaccatgcttgtctttgatgctgctctgaggcagaaaacaaggatttgatatgcaaggagaaaagtcaagaaaatacaaacctagaatcaaaaggaaaagactagaggaaaagacaaaaagaaggggattggagggcaaaggaagaaagacttaacaagtaaagaaataacatttcatagaaactatcattttgtgcaaactatcattttgcatgacatcagttataattattgtgttagtttcatatttaactacttgatcatacaactgagaacattttccaaaataaaaatgttatgtgtaatgaaaaagagtagagttttaaaaactaggcagatctgagttcaattcccagtgttctttaccacttacgtgatatggcaagttccctctctgattctcagtttctcatctgcaatatctattgctgtgatgagaattaaaataaaaaattcctgtgaagttgagtgccccacgttatacagttatacattacagttactcaaaaacattagttccttctacccatatcccatttccccattcctgtaatattttaaaaagatgaaacaaactctttcatgacaaaaactctaaaaatgtattcatatttttgatcatatatatatatatatatatatatataaaatgcatgtattgtggatacacacacatatgccctcagcaaatatctatataataatagcttagaaaggaaaattgccttaggcagtaacagtcctatggaaaaagattcaggtaaactttgtctgcaatgaggaaattagtactctatttaaatgtcttatttgccttctattactacacaaacactttctgggattaaacataagctaaaaatggattttaaaaaattgaacacttgaatatgatacacattgcttgttaagatgtgattgtcaataattatgcaaaactgcaatttatttcagcagcaactttatcatgggatgtgcaaaccaggcaataaacaactcctgccgagccagcggcagcaaagcccccggaagagctgtttattcatcatgggtgaggtttttgctgagcacacagtcttccacagtggagtttcagtgctcatactggataaaaatcttctgtctgcattaactggtggagggtagaataggtttatgaggatgtagctactggaaaaaaggaagcattgcactaagctatttatcaactcctaaataaactttaatactgcacagctgaaaggtagtgtagggttctggttgggcaaataaattaaacctcatgtagttcaagggctaacgtggactgccggctccctgcttatctagttttcaggcaaactatcaatgcaaggagaaatatcaaaagagtcatttatctttttatgtatcatgcttgaaaaattcagaaccactgcaacaactccacgaatctcaatgctacaattgggcatacaccttacagtttgaaccatgtgtaactgctgacaattgactgggtgtgacctataaaagtggcagtttcatgcagtttgcattaagacttactccatctccagtgcaaaatttggaacagaaataagctgtcacattccagaatataaatgcagggttagacatttgacatattttctaatgtagtccaatttcaaacaaaatttaaaaatatgaaattctcccatggcagagtgaaacttagagaatgtaatattgtgcattttatcagcatcagcttcatgatgagctgcgcttgatgcatcttagctcctctatccttaaactagaaatgccgcttaccctctgcttccagagaaagtaactagtaaataactttccaagagttatttgcaaaatgcaatgcacataaatcagatgaaagagttctaccgagacaatgtgattttcagccaaatcctaccagcaagtttgctgctttgtaaattaggcccttagggaagaacagtaactctttcaggacagtaagaaaccattttcctaaatgatacccttgtggtctgaaatattgacaacatcaggctgaatattttctaatttggaaaatacgttaaaaattcgatggcaataacagcagaaaatctcctcaaatgagctcctttacgtgcctcttgaataataggtaagactgttgtttcctgcttgtgtgggggttttacggcttcaacatttctctcggaatctatgtgtgtgtacgttgaatccctaaattttaattgtgccaggtctagtctagaatgagtcaagaatacttaatttccatatctgtgcattcaacatgctctaaatgtatcatatagttttaaattttccggaaccatatgggtttaagtggcttatatgataagtaaaatgtaaaaataagaatcataaagaaaaaaaagatatgttcagaaaaaaaaccaaaggtcttgaattagatttttttttaaattcctttgtccaagttatcaaactacaggccctggagaaaatttggctgaattttacaagtaacaatgaccagatattagaaactgtaataatgctttgcaaacagaatctactgtattggttaagtacttttttacataacaaagttttataatcagctattccagctttatggtgcacaaaaatagctgagaatttgatggagtaaggaataatgtgatttcaaaaggttttcattctattcataagagcactgtgtaccattctcagtatgtaaataagggcagcatgaaacagtgttctcatagtccatggaccagcagcaccagcaacgtctgagaagttattagaaatgcaaattcccaggcctcagcctagctctactgaatcagagactctgtgggtaaaatccggcaagctgtgttttaacaagccttccaatatatgctaaagcttgagaatcacagttgccaggaaccagatttgagaacgactggcatagtagatgctaagctgggctgcccggaccccttttcaggactgaaatacttctgaccccagctgctggtagtgctactggctgacagtcctcagctgttattcctgtctgagagctggactcagctaaagagaggtgcctagcccaaagttacccactatgtccccgagacgggctgcacgtattggttgatgggagagttgtggggtataaaatcctgggtcccttgctgcaactcaggacaattctgaagggctattctaccttcagacttcagagatcctcctggggaaggctaggaaggagaggcggagggttgattgtgttgtagttgtgactgtatggtagcccagcttctccttctgcccaatcctgctccctttcctttcctccgctcacaggtgttaatcctgagagcactctccaataaaattccttcatgctaatcactttctcagaatctgctttctgggagaacttgacctcctgaattgtcatgctgaacaaggattttaaaaatatacttgcctaagaaatatatgtggtctccaaagggaacaagatggaggattctcacatgcagtaattgtgcctgaattgctactgaacttttggttgccctttaaggagacctatagataatacaggtttgcattatcatcagttacaagcaagaatctactgaaggggcggagtgttggagctataaagcttagtgcaaccctatacgtgccaaagaaagtgtttatccagagacaactgcacatgaaggtaaagaatcacagaaggcatgttttcagcatacccattttctttttaagacctgattatcaatgaagaaatcaaataagtaagttctgacctgtcattagaaccctactcccgccacacacacacaccatggtatttctgaataaatctctaagactgcattgagttgaatatcatcaatttcttatggccaacataatacataaaaaggaaaaaggaagggaaacttgttgctttccggggtaagcctaaagagcttaattattgtatacacaccattctactattagatatatggatgaaaaatactttatcggtgcattatactgtggaattgtaagtgtgtaggtataattacagaaacatattgagtatttttagaaaaaggctcaatctgatatgaaaggttattttgcccaggttatttttaaaatgtgataaattaggaacattcaaagaactcagtcttctgctaaataacactttcactatggcctggcattgttatagagtaatcacataaaatactctgaatctttccttcctagtttatttgcaatttagccactatcatttcctatgatattttaggagaaagattaaaggatcattattttgttcctttttttggtgagatataggtcagagagaccttagtagcacctggatgtaagatcaaaatgattcttgccatatcaaccgctactcatagaaccagagttaatctgaaattcaaatttcctgtaaccataacagttcctactagtttgctagtaaattgcattttgattttaaaacataactttatattgtacttgtgaggggaagctagaattttgtcacctatggatatacagcactttgtagaaaggattccttttaatctctagcaattctattagtaacgtgcactaatgagaagcaaaagctgtcaacattgcctggattagtagtccattcctagcaaaaccaactctgtggttttatctgtttttgggcaacatctacctagaaatatgactggagaagggtggtggcaatgagagaatgtttctcttttctcctctgttatgaaactgtaaggcgaggaatatatgacatcattttaatttaacttctgatgcttgcttttcatccacagcatgaagaatggcagatctaatgtacagcatggaagataatttttaaagctaacatccacataactctttatatgttttcaaacatattcagagttattctatcatcacttcataagatattttccatttttctacctaccttctttttctatgtatactcagctggatatttcattctctgccaatggctttacactcgatacagattatctttaattctgaacctcattcttatttccacatgcctaccaacatctaattcaataattcatccatgcatccattccgtacctattgtgtaccaggatctgtgcctgatgatggtgacagaaaatccaataatacatggactttggtatttaacatattcaagtttaacagagggtacagataggtaaacatttaactagagttacaatgtaattaaggctataaaccatctggagtccttcccagtagctcaaatgtaacatatatcaatctgctttcataaacttctatctcaatttgccaaacaagtgataaatgtatcttaaacatgttttactctttccatcaaaagaggtggagatcatccagcaaggctttatctcaaaatagagtgatggatgcttaacaaaagtttgcctaactaattttcataaaaataaaaaaccttttagatatacagtacaggcttttgctggtttcattttagggctggagagattgattctgagagaattgtaatgatgttcccaaggttgtatacaagttaagtggcagagctgggggtatagcccaagtcttgcattctagaaaagaagtttttgtaactctgaagacagatattggaatacactcctctctgatatattcattgtactaaaagaaagaaaggcacaaggaagattatgtcactgaatcctggtcttcattttagagcacaaatttaattttctgttattgccatatgcagggtcgttgaaacatacaaatacctacacataagggaacacatacatacaaagatattctcctacccaaactattgcagaaaagatctggctgctctttgctttaaaataaaaatccatttttaatgcaaatttgctggtttgccgttcaccaacatatgaattaacgaggttttcatcccctctctcttgaggtctggtactaaattactcaaactctccagagttaattggaaaccatgacctaaatgttcccaaagtattgctgattagttctcagaaaactcattcccatcttttgtcaccccagacaccacaggatgactttttaacatgtgcagtagcaacacactggcatgagaaatagattaatcctccaaagataaaccacagctttgaagctatctgtgtaaacttccttcactgatacagacattttattttttaaaaaaaatatacatatcacctagactttagatagtaagagagtataggcattatcaatcacgtaaggaattttgaaagacacatttcatctctcatttttttaaccttatgaatgtttttaaaatagagatttgcgaatttatcattagggaaacaaccataattatacactttccctaaaaccattagtactttcctgaaaagacctgcattaggagacagcagtagaaaatgtgttttctactttactttgcattacccgtttcatttgatttgtatttcaactcataaatcactgaaaaaaattagttgataaagaaatgtacacagtgttatgagcagatgaaatacacgtctctatacacacatatttttttctttcttgaatttttaaagagattgatactctttaagatctgcattttatatttttctgctgatacaatacgaaaaggtactatttggagaggttgaaatataatgttgggagtaatgaattacatttggtttggttaatatacagagactcaaaatatccttttgggcatttatacaactgtaagggatctttagaaaaaaatgcagttaacactacttcccagataattacacacttaaaattggtgttgacctatagttggacacatttctgttctaaataaattctcaatgatttgtataatgcgaatttttaagttggctttggttacttgcagtgataaactctttaaagatatatttcctaatgttgatagactaagcagcttttcttctctcctaaaaggatttgtttaaaatagtataaaaaccaatttaaaagatgagcctaagatcatctcttacaaacctgataagactgtgcagttatatatatcctcatccacaataacttagagaaaaacagaacaaaacaactaactgtagcttgttagttgttgatacataatattcagaagacagcaaagcaggcaggttcagttttctaatatcaaatggcaaacacacaacagattcactttaaaagaaagaagtggctaaaaacatatcaacagatgaaataaacttatagtagagtcctgtcagtggaatttggaaatacgaacaatttcataaccgctgatctaaattctgaattatgatatcgaaatatttgtgacttttattacctagtctcttactcagtactctcttgtggttaataatacacatttgaaagggcccttttagcaaagcacatgaacagacactttttaaaagaaaacatacatgcgaccaacaagcatatgaaaaaaagctcaacatcactgatcattggagaaatgcaaatcaaaaccacaaggagataccatcacataccagtcagaatggctatcactaaatagtcaaaaataacaggttctggagaaaaagcattgcttataaactgttggttatagtgtatgttatttcagtcattgtgaaaaccagtgtggagattcttcagagatcatggatggagctgcaggccattgtccttagcaaactaatgcaggaacagaaaaccaaatactgcatgttctcacttattagtgggagctaaatgatgagaacacatggacacagagaggaacaacagacgtggaagcctactggagtggggagggtgggaggagggagaggatcaagaaaaatatctaatgtgtactacgcttaatacctgggtaacaaaataatcggtacaacaaacccccatgacatgagtttacctatataacaaacctgcacacgtgctcctgaacttaaaataaaagttaagaaaaagccattttatattcaacatgtattgttatagtattttacactaaaataatgttctgcagttttcaagctcctttgacaggatccacagatagcacctcctttcatattttaaatagcttgatgaggctaatgaggcaggttgtaattatcatgaacagtttatagatgaggaacttaactttcagggaagctgggtgagttgccaaaataaatgacaaatcttgaaacaatctagtccactgtactataagacattacctctcaaggtagacttgccagtctccctgtgaagtaaatataatggatattaatatgtcactattctcaaaagccctttgttttctgttattattatatgaattaggattatggggtatgtgtgtatatatgtgtgaaaagagaaaagaaattattattcctttgcttaccatcttcatccgtcatctatgagatgtgttacaataaatactgaactttgaactcgaggtaagcttgaggatttgatttagaaagaaggcattacaggcattaatcgaatattttaattcttatgaaattatacaaagttatagtacatacaattttggccttctctaaatgataagttagtaaatgttggttaatgatacagagagtatctgaatgtctatgtattttgggatatcttttacataaaatttctaacatgaaaataaaatacttcatacattgctttactagacattttacagtgaaataaatacattttaataaaaccaactgaacgatgaattaatttgtcgaagtgacttagtttaagtagattctaaaagaattgcccttctaattgtaaacctattttaatggctcagatatgatttacaagacaagatgtgggattacaagtagcttgagctaattaaaacttatcaaaataaagatttaaagtttcttgctttcgtacttttaattaccagggtgaaaaattgcatttaaaagacctagatactttgaaatgtattgatggccttttataagatcaattaaaatttataaagaacagtcataatttaggatttatttttttcaattagaagtacaacatgaaaggaatgaatctgagggtgcatctggttttaagaatcctctgacttatgaatataccacttactatagtctggatattcatcatcgtcatcaccattcatcaaccacaacttactgtaaattatttgagggcaaagattcacaccacagttcctggcaatttaatagatactcaataaatttaattaaagtcaataaacctactaccgataaggtatacagcttctaaaaacaaggccataggctcttgttcttaaaaaacttaaaattttcttgatgtgaatttattgaataataatttatatttatatagaattttagagtttagacattgctttcacataaattatttcagttgaacctcataataatttgaaaatattatctttgttataaaaaactattgttcagttataaccaagatgtttaaaaatgagaatgagcaattctgtgcccaaaattgtgttttgctttgcaaatgtacagatattcaatctttggaatttgtatctttcatcaaattttatattagccatgaaagtgaaggggtggactattttactgggcaacacattgtatttagctgtcaatgactgagtttctgttactcttccacgaaagttaacaattttttttctgaattttcaaaatgagtgtctgcaaaaaatgttatttcaatactttctaggtgtattaaagaaatagacagcatacaaataataacttctgtcaaaattaacctgttattttggcaaatgttcagattgcctataagtttgatcctggtcttcagacatcaagtaccaaaagtgccttaaaacgcatcctgtccagacacccatttggcttctgtcacccaaaatactcctgccctccctgctttttatcacccataagtttgatgggcctcctctctgtagttctactcatgttctgtcaaaaacatccagtgtgtcagggttgagaacagaagcttgtgacatagcaccagagatcttccatcaccacctgacactggtctattaatcgacatcctttgcgtaaaatcatgaagtggcttctaagccatccaatttatcttgcatctagccagtatttctccaacttattcacaagagtataacgaaagactttgtcaaatgcccagatgaaatgcaaatagactgctgcattttacttacctacttgtctaaaagtttttcattgtaaaacattattttatctcaataatttagacaatagggatttatccctgtatgcaggtatatctgtgttgttttactaaattagctaatctcttcaataaatgggttcatatttctcttatagcctccacgtaagttgcatttagcattttaaatgtcttggacagctacaataatatctcttataatttttacataaaattcaactgcatttatcaacaactggttagggggcgattgatatagctatgtgaggggaaggagaatagatgagtgttatcaccacccttttatagagatcatgccattcaagtggtgaaaatagattataattgcagtgataatcacagaattgtaaaagactgggctagacaatctggcaggtctgaaatggtaatttcatttagtcttgtaaaaatggcaactgtatcactcagaaataggttaggtgctccgaaaatactgctatttcattaattcacaaatcagtatttgtctggaaagatatttaaccaaattatacagaccacaaaaaaaagaggcatcctagaaattgagggaggacatttgactatcacagtgattgaagagtgttactataatagcattctgtggagagggaatgaagatggtagacttcttatacaacaaagaactctcccaagtctgacagcactttggaatatcccactggacatgcatgtatgtggaaaccctgtttataaacacctaaacctggaacgtaactcaattttacacgtaaacataagatattttcctcatgattttaagacattgaatttttcagccatgcaactaactgccataacgatccaagaaaaaatttatttcatggtgttaggaattttgccaagagttgttcagcattttggaaaattacgctatggatgaccaatgcccctcatggtatttgagtctccatacaacacaatggtgtcattctgcatttgtttatactgcattgatagtctcgtgatctaaaaacttcacttgtgttccagtgtgatcctgcctgaataactgcatactacaacacatattattttattataaatgactcttatttctctttaaaatagagttacggcatcatttaaactattgcctgtataagtagggtatgttgtctacatattttggcttataatcgtaaagaaggtattacaaagtatttgttatttaaaaaagaaaagaggggtggcattgggtctgagaagtttgaaaaccaccgatacagagccactggggaatctcaagagaaagtttattatactgaaaattaatagaatttttcaggagagaatgaggatgtgtcccctccctgtgcatccaatctctgatccctagagctccatagagaatgaaatagcattttaaaaattgctctcttctacaaccagctgtgactatcggtgaaccggaggtctacttcatatacgaacctgaattaaaaacagccagcccttgagtcagttcagagcccacgttcttgattacatttgacacaataatcatcatcatatcttaagactcaaatcagcctgacagtgctcaactcagggctgcttctcccaattagctgaaaattgcagcccagctcatctcctagggaatacgtttacatttacaattttgctgtggcaaaaaggcaacaaacacgctggaaggagcaaatcagctttttaacttttacactaactattttaagtttacctaagtctggtaaacctgttttgacaagaatgacaacgaggaagctttttttgttatgattttttataactgcgcaaagtttaagataactagagtttggactagaaggggaaaacagatacacaatgtgaatatttttacaagttacttgtcaaatgaaagctttcagaagaaacagcctttctttggtaaacggtgcattaaaataatttgcaactaatagatagggacatgtaatttgaaaacaaaaagtgagtaaatgtcaaggtcctaggaaatattttccaattatatgctaacccgataactccatgtccatgtgacatagcgttattctgtgtaattctgtaaattacttctctcctatatttctgaggggtggaataaccaaggacatttttgtgcattttgtttcctcaattatgatacctttctatgcagatcagggcagtttgcacacactatgggaaaaatggaaagtgacaaggtaaccatgcttcatggtggctgtgctgaagatttgctcagataacagtgtccttatgcgctgtcttctaagcggatgacagtgcagacatggaagagaaatatgcagatgggaaaacatgaatctagaaaagtgggaaaaatactgaggagcaggagacctggaaaagtaagacaattctagagtgggctgagatagaagacatgttgtaaccactggggacaggaaaacatgtgaacaggaacatgtatataagctgacagtgtgcaagagctcacagaaagcaaatgctaacagtaatagagaaataccattgaggcagaggtagagataaaaagaaataaggagggatcggccatggtggctcacgcctgtaatcccagcactttgggaggccaaggtgggtggatcacgaggtcaggagttcaagaccagcctggccaagatggtgaaaccctgtctctactaaaaatacaaaaaaaattagcagggcgtggtggtgggtgcctgtaatcccagccactcgggaggctgagacagagaattgcttgaacccaggagggagaggttgcagtgagccaagatcgcaccactgcactacagcctgggcaagagagcgagactccgtctcaaaaaaaaaaaaaaaaaaaaaggaataaggagagaggcaaagttgaggacaggcgcactggggaaatgacagaaataacaactcagagaaaagtgagtaagtgcaacatctctttgagtcttgttattcccaaacatccctattcacccaaagattaacatttcctacaagacaccatgttatgaatatccttaactaatggatatccctcaagaagaaatatttatttttcttatagtacagttacatacatttgggaattagaatggatttttaattggtttctgatccaagttttaatcattttgcaggaaagaagccaggactcttacaacatatgaatactcatctattatgtataatatcatttaagtggattttgccccaaatctttgtggatgtgcataattgaagaaaaagataatgttattacttctcggtaaattaattgacggtttctcctttaagattggtcaacaatctgagtactatgagcaacacttcttctatagattctgttctcctttagaaaacaaaattcacgtcttctgttgtagaattaaatctttgacagttcttaatgttgagaaaaataaaaatatcctcacgaaagtcaacattctttaatattattgagaaaagagtatacattcacattttattaaaactacggtccactgctataagtgtcatgaagttaacatatacctagtaaagtttgtaaaaaataatcagaaataagctttagtgaaaaaatccacatgttgaattttgctgtttctcacattaccttaaagtgtttttccaaattctagcttagccaaatcataaggaaactgaaatagaaatcctttgagtgactactacatactttaaattatggatatcatgttgtaaaacatctggctcattcttgtgctgtcatgattttccaaaataaaacatttgctgtttagatgttgtcatttaaaaagacccttaatgattagtcaactgatttgctttagttgatttcaaagtatatgctaattgacaacattgatgatgacacaatacttaaaaatcccatacaagttgtccactgaacaatttggtcatttccttattcatttccttattaatgctcacagaagcatagttatcattttttttttagtgagtcacagaatgggaattaatttattttaatccaatgttccgttttccttattttgctctatcagttttgtgagcccaaagaaataaagttgaccacagcaaaagcagtgctggggaagaggccagtttataggataactgcaataccttttacttggaaatatgtttgaagatcacctgaaagtttaattgacacaggatgggacagcacatctaggaaaaatggatgccattcagacaatcgttcttccgattttgatctgactatctgttcgctttgcggtgtatatcaaattgttgaattaaatttcaaaaacatcacaggtctacagggaatcattagttcccccaagtactttcgagagttgactgtagctcttttacttccctgctgtaatgacaggaaacgtggtctgaatttattgctatctcccacctctcttagagaccattgttcatttcactcatccattttccttcctgaataaatgtcaataggaaaaattggttttgataaactatattttatagtttgataaactatatatgctttctttttcaccttcttattgacaacatttgtccgattatattagcaggttccaggactaagtttaacaattattgttaagagtttttgtagggaaaaatggtatttcttgtagatatattagtagttgataatttatgtaaaaatttagtgtttgtgataggcacttttttaaaacttttcatttgaaaatatgaacatcatccatttccccatctaatcatgtctttcctgaagcatatatttttaaagtagctcttaaaacttgcaacatgtgatgtagctataattattttaatctgcatgaaaaataataggataaaaattaaagtatcagtgtaattttgatgttagaactaataacattgcacatttgttttgttagtgaaatatgtgctcaaatgatataagaataatattaggtaaatatggaaaagtagttctatgaagaatacattttttaaaaatcttagttcatcaatgcagtgaaagcaaatacagaattctctagattctcccattaaattataacagtattcagaattctttcaatatatggtggaagaagcaaaagctgatattaatagaatattatgccttttctcagaaaaacattatactttcatagaatgtggactcatatatatgtatatggagaattttgttcaatgtgctcaatatctattgcagtatctggcaaagagtgagtgcttaatttttactgaagcacttaattagaaaatggcaaatatatgtcagtatcagtattttcaccatagatactttcattatatagtaatcacagtagtgcatatataactgccactgtctgattctgacttgtactttcaaagttagaataataaagctctgccaggtaacccattttcaaaagcaaactttggcaaaactttggaatacaaaaaagaagatggagagaaacttgcctttccaggaagaatggcaaagatgtggtgagatgccctcttagagccagtatgttaatacgctaataaaagtagaaaagacttactagaactatttgaaatatcaaaaagtaacacatcactgtatgtgagaaaattctcaaaaagttacagaacctaacatcatataggtgatgctgcaatgtaaaaacacacacacacacagaaaaaggagactgatagcaaatacaagaatttctgtgtcagaattaacacaaactggtgttttgagcttaggaaagtcacagactctctgtgcctcagtatccttttctctgtcataaatattttgatattgaaattggtgacttcataggttaactcagacctatagaatgtcacgttcatttagaatatgggacagcaaattgtaaagatgtctgtccacctgctactcatttggcaaacagtgcatatcccagggagcagaacccagcgcaagcaagctgtcctaccattatcaattaagggcttgaagtcaagaatgagtcccaagccactggtttgccaaggagtctgcaaaatcttgctagaactttgactttcaattctggttcttgcaactgcactattaaagaaccttggcctcttcttagagtagaccaggtccgtccaccaggaatagttgctaagagttatgggttggccagggttactctacatgagaagtgtatgggggtttactcacacacaccaagtgcttggctgggcttctggaattgcctacctgtcaggataagttttactgttaccagcagcaacctagcaactaggctaaaagtaatcactagcgtggtgtggtttataggttttgtgtgggaaaaaaatcctcaaaattatgagttacttccattctattagaatgttgatgaagacagagtgtcaaggagggttaatggcatttgtttcagggaaaagaaaaacgttattagcagatcccagcaattttaatagactctattgtctattgcctctattgttgattgccatctgctaaaatagagactttattaagtatagcttcttttactgaagatatccctgattacttcggtggatttctaaaaaatttctcctccatcctccttgtgggaagtctcaggaaaaaaaaagattcaatatgattcaaataggctctgccagagaatcaatctctatcctctctctgtctctagctagctagctaattaatcaatattcccagaaaaaagtccttaaacttctaccagaatatgaggtaagaataacagccttggaggagtcatagaaaaaaatgtctgaatagagtcaaaattcacgtaacacaaattcccttggttagcatggcaaatgtataggcttatgcctacgtgaagaattgagctaatggcactagagaatactattcaggtaactcacggtgagatgatttcccttcagtggcctggcctatatgctatgctatctatcttacaaacacttactgagtgcatgttctatgcatagtattggaccagatactgtagtgttgtataagattcttgagaaattgttttcatggtcaaacttttagaagggatgcatactgtatagattatcccttccccccatactttcataaatacacatactttgttgattcaccaagcatgcactgtaataagggtctgattactcctatgggaaagaagtctgttcgctttgatttaacttgatattacctaatcattttttcatccatagaaccctttcttgagttattacttattaagatacagtggaactagttctgccaaaaccccatttggaaaaagaaaactcccactctagatgatgagtatgtgaagatcaggatgttataccatacaaccaccaaggtatcaccaacctgttcctgaatacttctacaactttacaaggcagcctgttccatctttggacagctttataacaatattcctctctctattaagctgaaatatacgttcttaggactaggttatatgcttaaatttattcggcctaagatcccctttggctttcctttcccactgttctatcacattgtgtgttgtgtgttgtgtgtgtgtgtgtgtgtgtgtgtgtgtaaagagagaagtgaaacagaaggagattattgttgctaaaaactctatgttatctccatatttggaatgtttttggttggtgtaggcagtggttctcaaattttaatatgcatagaaataacttggaggcctgaaagcttgttaaaagttccccaagtcccatccccagagattctgatttagttggatggggtaggacctacaaatttaaatttctagtgagctcataggtgataccaatgctgccagtcagaggaccatactttgggtaacactgcggtcttgggtacactgttgctctgccaagacctcatgccctagctggttggaatattgactactaacagctcacagctgcctccctccctggaaattgccttcagctgtaggtaacaatcttactccagtctgctctttcccatggggtgacccaggaccattaactctctagtattgggttcaaaggtccagatcccttgcttcaattcagcgtgtctctaaagggccatgcaatttccagaactcccctgaaaatctgatgaggccgcaacgcactgcaggcttcactgcacttcttcgtctgtgcaatcttgcctatcttacaaccttacacatgtatctcatgggaacactcctcaacaaaccttatgcacacaactctctatcttagtctatttccagggagcccagtctaagttagatgggttttttgtttcatgtttcttttgaacccacatgtagcaccttgcatttacattacatctttcagtattcagcctaccagtccaacttgttgaaaactttttggctcctgatactcttgtctgctatatttgctatttctccctgctttgtggcattgatttgataagaatgttatctatgtcttcatccaagccactgatgaaaatattgaaaaggacagagctgagattagattaccgggaatagctgcctgaaacctccttccaaattgataggtatccattagacagcagtgaagggagcataggcctcagagttgcagatttgggatggaacaacagttccgtttaagcagaggtcaaaagctagactcacagctaaagagaacaatgccattttagcatttctattttaataggaaacttaagtatcacttatataacacatttcaacaaaacatatctcactataaaaacataaaatcataaataatcattatgaatttatgattattattcatctaatttgtcccagcatgaaaactgtatttggtcatttcatggagggttttttcgtttacacattttaaaaaagaggttgtgataaagttgaagttcaacagctaccccaacttcactaggacatttaaaatactggcaatataaaagaaaaaggcaatccatcagtaattgtatgagcggccataagtttaagcaacgtaggttattatctacaaaggtgattgaatttggttcacctgatttgctttaattgctctgtggcataaacacactgactggacacagagtgatgtaatgagtatcataattaggaatttgataaagctaagtgtgaaactgactattagaagatatttgaaacacacaactactgctttgaatggggaattgatttcctagttaatttaaataattttcatctctttctatgaatactgatgacagacggaatgaccacagcataaaacattggctggaagaatgtcactatgtacttcaagaaattatttcccccatgttttttattgaaaagataaacacctgtccatttccttcctaataaaaatgtggtaagatttttttaaatgaaaaaataaaactatctgaaaatgcttttaactgttaataaacagggagtaagtaaaataaaaataggcaaaaatatatttgcaaaaatatgatagaaggaattgctaagaatgttgagaatgattctttatttgtaaatttttgatagtttctacaataagaatcacttgtactaaaggaaagaagttatttcaaaatatagaagaaacatccaaacacagaaaaatggtagataaaataccaaaatagaaaatcaaaaaggcacaatctgggcttagaaacaagttaagtagctctgtgtttcagaaatgccacaaaaacacacagtggtgcacggggctgcagacatagggcttttggggcctgggctgggaagtaggtagcagtagccaggagttcagattctgctgggctcaagaatctataaacactcggtataagacaaaggacctgagccaggctctttgctgcaattagtcaaggatgatatcaggtttccctacggggtgaaagggagctgcaaaaaaaaaaaaaaaaaaaaaaaaaaaaaaaaaaaaaaaaaaaaaaatctgctattgatcacaacctagaactgattaaatgacatccctttttagggggaaattggaaagattagatttcataaaactcattaatacctatatgtccaaacatttttaatataagaaatcatttgaattaatgatttagagaaaggaaacagatccctgttacatactgaataaagccaaaggatcccaaaactataagatttctagaattgtgcagaaaaaaattaagtcaagtgatgattatattcatttattaaaaaaactcaactttctaaaaataaatctacctaaattctatttttattgaatgttttaaagaagtctttctgagaatgatacagatagaaataaaatgaaaatataaatataattgaaaagtaacatgatgggtattgtagctaacattaatggttcaattaaaccaaataagaaaaactttctcccatttgctttaatatttgatactgtaatattaaatttatgaacaaaaaacagtctgttggtatcctataattttttattaggaaacaatggtaagttttcgataatactattgtttttcctgggaaaactgatacataggagcatttctaagcatatattttggtgcgttggttcagcccagttcaggactgtaggactgggttagaatgaaaatggctacttggctacatcaccaggtaattttccacaccagtaaatcaccaatgacatggttccaaatgtctccctttgtgtgcaatccctgcaagctagaaacattctaattacttgaaaggagatgacataaaatgaagcaggctgttaccactatgaaccttttagatccatatggatcatgacactctctggcccggagccccaagatttcacatcatagatgttatattaccctactgtagaatgcagagaatttttttttttttttgagacaaagtcttgctctgtcgcccaggctgtagtgcagtggcacaatctcagctcacttaaacctccgaagagttcttatgcttcataatcagttgggaagatttgggtctcagcaatataaaaatgggattgtcttgtaactatacatatgactctctcctgaagagccgaaagacacattttcatactgctaagtgtacctaaaggagttgataatggattgaattttttaacataccaaatcctctcagtccttaaaatggactacaaggtacatttcgcataagaggaatttaaaatagggtattcaaaattgagagggttgaactggtggctttggggtcatttgtagctttaaatttaatttaattttaagagatggagtctcactacgtcacccaggctggagtacactggcatgatcatagctcactgcagccttgaactgaactcctaggttcaagaaatcctcttgcctcagcttcccaagtagctgggactacaaacttggcttttttttttttttttttatgttttgtagaaatggtatctcactatgttgcccaggctggtctcaaactcttggcctctagtgatcctcccacccccacctcggcctcccaaagtgctgggattatggggacatgtcccaccaggaactttaatattttaaataaaatgtgccacatatatattatgagcaggccccaatgtaataaaggttgtattttaaacaaatatcccgctagcattctatcatatttttgtacatagctttgaaggcagcaaatctttatcctttaaatttttggaaataatccaaagccattcagtgcccaacatctgatgaattgtttcattcaattacaaacaattattgagtacaattactcagcaaataaaaggtatggctataaaataatataacagtctgctgaggatcataaaacagtccttaagtagttccagaaaaggaactctaaaattatattgccaagggacggtatttgtagatacagcatataagactcttatgaagttctaatgcttgtccctctcctaaataaacaaacaaatgaacaagcaaaaatgtataacactatttgcttttcttcccaggaaaatgttttactttttcatttgtttttactttcagaaaaatttgagaatgcttttggaaacatgtcatacatgtaaatatcatgcatcaagtctcaggagggtaaaaaaaaagcactggaatcaaagggaagcaagaagattcatttcaaggaagacagatccaaggctgttgtgaatgtcaaatgagcgtaaagacttgataactggcagaatagagaaaagttggttacaatctcccagaaatctacaaaggatgaagaggctttaggatgaggtgacaatagggataaagagagggaattgtttctagagcaatttttgaagtagaattcacagaatttggaagccagtttaatacatgtgtcagtagattgggaaagagagatcaagagaaaggtagaaggtaattcttaggtttccagttttagagacaattaagttagacaattacactacactgaaaacacagaaaatttaactttcttttaggggcaagataatgcattctacttgacacattttgcagcctgtagcatatccaggtggtaatgtaggttaggtggcagaaagtacagttctggagatcaggagaagagtgtaagatggaagttgacactgaggagtcttaatgttaactgaagccaacagacaaagctactcaaaatgtgcagagagaaagaagagagacaattaagaatggaacatcaacatttaaaattgcattgaagacagagaacttgcactgatcattgttacaactcccaactttgtatcttgagctactccccataacttaagattcatatatccagctatctactccacacatctcctagatgtataataggcatttcaaatgtaacatatccacatcttcctcccaaaatatgttactcctggagccttccccatctcagtaaatgatgaccccatctttccgttgctcaggctaaaaattcttgagtcttcttgactctttctctcacacctaaatttattccattataaaatctgttgtgctctgtacccaaaatatagtagaatccaaccactcctcaccacattcacctctcccattctgatcccagccacagtcatctcttgactgaattatgacaacagtttcctaatggtctcactacttctgtttagtctattgtaacagaggagccagataagacaaaacatgtcactcctccattcaaaaccctccaataactcccatctcattcagattaaaagctaaagtccacaggcctaaaaggccaatataatcagatgccagttacccctctaaatttattgtcaactaccttcctgctcgcttgatccttttctgcctaactgatctcccttttaaggttccttcaacatgccaagaatattcctgctttggggcattttaacttattaggactctcctggactactttttcccccccaattatacatatggcccacatcctcaggtcttttagaatttgcttaaatgccaccttttcagtaagaccttttttgattaccacattttcatggcagcactcctcttccacctccctctctctctccacttgttttcctctttgttcttccacactgtgtgtatgaccatctgacacatcatgtatttaatttttatttgtcaatgtctgtcttccaacttctgcttccaagaatataagctttatgagggtagggcttttcattgctctataccaagtaccaattactgggcctacctagcacaaacttcatacaaaagtatttgttgagtaagtaaattaatttttatggtgtcgatggcagatgatattttactgagttcttactacgcactaggcattgtgccaagcacctcacaattattatatgattagagaaatgagatattcaagataatattgttctgggaaccaaggaggataaagttttgattagcagagttgaccaacaggatcaatgttaaaatatagtcaagaagatggacgaattaaaatacactaattagctattacaaagtcactgatgatcttagtaagtccttgttttcataaagtggtggtgctggggaagtgagactggagtgggtcaaagtacaactagtagctaaagaacaggaaacagtaatgccaactactgcttaaaaatgatatagtaagcagaagcaagtacagctggatagaaaaaaaatgatatactaaaaaagttctcttaggatgagggagacttgagtatgttggcctgctaaaggggaggagcaaaaagaaagaagaaattgaatatcccaaaaaaaggaaagtagaataattactaaaacaacatgttggagaatgtaaaagagatctagtgtttaactagagtagctccttgctacacacaaaatagggctcaattgttttctcttttcttgttgcaatgaagatgagaaaggacctaggaatagagaagcaaagagtgacttacaagtgccttcaaggttgtcaaagacggagaaaacaggtcaaaatgttttcagatgatcaactattaattttgatcattaaaatacaaaacagtattataaagaacagagaatactgagatgttatggaagaaaatgtgtttgtatgtatatgcatgcatatgcatatacacgtatatgtatatatgtacacacatacatgtacacacatgtacatgctgaatctttcttagaacctagagggattttttagtatctgggagcttagctaaggaacttctaggcatgtttaaccctctgatgcaaggaccatctcctctgcttgatgagtttgtacctggctagttggcagttgtggaagccctcatacagctacaagcagacaattcagagttaatgcttatttcttgtttaaagagtgatcctggaacagaaataaggaaatgaaatctcatgacagtgtcatcataaagtcatcagccagatggcagtccttgaaatctaatccttagaggcttctcacaataatttgtaatatcacatctaatattatcttattcacaaactcatatctattcacagagattgaagacaaagaaatgaacttgcagaggctcacatttctggctttatatgttatcatggactctgtaaggactacgataaggaaaacaacatattttcctacataggtcacaacaataatctatgttcagatctgggtttctaaactgtacaatttagttgagaagcagccttctcttttttccatagatagattagttccttttaagcataaatgcctatttatatttattctatataaaatggcaagtaaaaatgatcatatcaaaagccactgtagaatttgaagactcatctgatgtattaataaacttaaacagcaaaatataaacattagtttacttttttattatgtcttgaaactgcaacatggcagtgtctgatatcaaagcaaatttctttcaagtacattttatatcttatttaacattcaacagtttaaaactaaagattttattactaatttaaatattcttccaagtgtacaaaaattttgcctaggtttctccatgtgactgaaagtctcagtgcaggcaatgcattagtgtttcatagtaaaatggtgtctaacctgaactgtgagaaatgatgtaatcagaaaactttccacagaatccctcctacctaaaaagctatagttacagaactttttcaaagatatgagatactttttctccataacccaaatattgacattattaatctttcctttttaagatgagtttaatataacaacaaaagtgaaaatgccatcctgtcatagttgtagtttttgagaccaacacaaataccatggaatactacgtagccataaaaaaagaatgagatcatgtcctttgcagggacatagatggatctggaggccattgtccttatcaaactaatacaggaacaaaaaaccaaataccccatgttctcatttataagtgggagctaaatgatgagaacacatggacacgtagaggggaacaacacatgctagggactattagagtgtggagggtgggaggagcgagaggatcaggaaagtcaactaacgggtaccaggattaatacctaggtgatgaaataatctgtacaacagacccccatgacacaagtttacctatgtaacaaacctgcacatgtacccctgaacttaaaagtgaaaaaataaaaataaaaataaaaaagaaaatgtataaatagaaaaaatcaggcagaaacaagtaaatgcattacaacaagccactgtgtagagacaacactttttatttataaatagaggcaataagatttttgaagtagcacagtaaataattattataaatgtaccctaaactgcttaacccatttatgcctaaggttgcaattttttgaatttttgcaatcagaccttggtgaggaccttgaacagtagaatataaataattcccacatgcttagtattccaataatggaacactaggataaatagctaaagtgaacatagacaaagatgatctagagcaggactatcagtaaaactttctgtgattggtggttacctgatgctgggaagggtagggggtgaggggatgaacttgattcgattttgcaggctcagagatggaagggaatttgcctcacgatgaattgtgccttgagtctcacccatatctaatttatattagattgcacttttgagtttatgctgaaataagatttttggggctttggggatgaaatgaatgtattttgtctttgagaagaacaagaattttggggaaaagggggcagaatgctatggtttaatgtttttcccttcccaaacttatggtaaaatttaattgccattgcaacagtagtaaatgtgaccttgaagaggtgattaggacatgaaggctctgccttcatgaacggattagcatcattattgtgggagtgagtttcatataaggacaagtttggccccattttttctctcttttggtcttccaccttccatcatggaatcatgacacaacaagaaggcccttaccagattccagccccttgatcttggacttcgcagcctccagaactatgagccaacaaatccctgttcattataaattacccagtctgtggtattttgttacggaagcacgaaaaggactaagacaaggacaacagaagtaggttgcatttggagaaagagattggaagaaggcaaagatgagtttagctttggacctcttcaatgtgaagttcctgtgggacattaacatcgaaagaaagcagcaggatctacatgtctaaaactcaaaagatcattctcagctggaattatagatgggtagtcatcaacagactgaaactacacaagtggatgaattcttgcaaagagtacatgtgaagtgagaaaagaacagggaagaactttatagacatgagtcagaagtagcttggtgaattgcagattctgtacaggctaaaaatgtgagttggcttctaaaattctcatttactttacccataggggaagtaagtatatgcattccttagctgatagctttttggaaccaagccaaaaaatataaactggaagtcattcccatgaagaatccagagaccttgataaaacaattttttaaaaaactgagagagtggcttgggccatcaaggagcatgagaatgaagagaggggtctgtcagaaagagtagtatagatagactagatcagtgtcctcaagctctagtttcataccatgagcaagcttttttcttggccccttagtttatattacctaaactcatcaaattaatctctgactttaatttgctttccccaaaagacttctctttgagaagcagatatttcccactaagatctaatggttgactctctgataccaattgattccatgtgaataattcttcctgaacctaatctgtccctgtttaattgaacacatataagatctgtattttgagaagaaagtccaagccttgccattgagaaaaagtagttactatgagaatttttccaaatatcagctccatattcaagtttgccctttctccaccagggtctttttcatagggctccaattaaaacttcccaactttaggttgaatcttcttttccatggtcttttccatctatacacctactgtctggaattcaggattagagttgctctattccccagggtgaccagcttaaattcagcttcacaggagtttttactctctaatgtctagctcagtttcaaaatttagttggccgcttaatttccatatatcattatctcatttctcctaagacttcctactcttagttcaaaatctgttttggccccagtggtgacttttacttcttgttaaaaatcaccgagcttattttttcagtaattgatgtcatattttggaactcaattatttttcaccgtggtcttcctcatattgtacaggtgctattttttcagcttgcacaaggtaattgtacattctgcaaagggagtcatcattcaaaaaacatttactagctccctattatatcacgtggttcaggacctggggatgtatcaaatgagaaagacaaaatctctgccctcatggcatttagattaatttaaaggacaaatatttaacaattagttacataatttatatttttatttatgattggaataaatgctagtgaaaaaagcactagagatcaagagaggtataataaggatacaaggcttagtttgaggagatactgtctataagcgctgttaatttccattcatatataatgggaaatgaagtgacgagtcatattgccctccacaaattttcccattgggtgtgtggagtgagatactaggatgagaccatgtacagctataactctatcatgaatcccaaagtgacttatttatcagataacaggtaaggcagtgtgcgccatgatgagatagaaagatattcctttggatagagttatcaaagtagactgataaatggctcttctagctataaatcagtattttgctttttgtttaatctcttggttatgtcactacttttgtgacagcgggcaaatgagatcttatgttcctcgtttttaaaatagaagtctgagccaagtccgtgagtttagttggtatttatcgtcttgaaccctcccaagctccagtttagctggattggaaaaacaaatcctcatggtccatccagtttcaccaccccattattacagccaacagtagttttagaaataatgtaattcataccttttatgaatgcttctccaagaggcattgatattctctgttatcatgtggacttttctggtatcatctgcagaataatcccggagaagtttcagggccaagtcatttgccacatctacatttgtctgccactggcggaggtctttggccaactgctatagatttttatgagaaagagaatgaatgtcagttttttttatgaaatctctagttggagtgtcttaaaatacttcgtaaacagcttctgaatcctcaggtcagaatacatatattagattgcttttaacctaccatatgatttagtcaatcatgacagtataaggtaacccacctttcaggacaaacttttcaaatgcagcatcttgagcaataaccagtatcaagtatttcaacttagtagcaattaattggcaataaagtgggcttaattgtttttatcacaagagaaaaaaactacaaaaataagctcatatataattgttgaatatgtgacatataacaacatttgaacgaaaaaaacctcatacatttctttccctcttcattaacttgttgaattgtttatgtaattagtgccatctactggcgttcaactaaacctgcatacagaaaatattgaacaacaaaagaatagtactgttattctagtcacgaattttttgaaggatcaaaatacttttagaataccttactttaaaattagaaaaaaagtcaaaatataagaatcttactaaaccaaatcacctacattttcttcgttgtttgtctttggcaattcagtgttttcaaacttgctatctcatcacttgaaacatatttcaaagaaagaagtcaattaatggtaggttttatctcgaagcatatcaacctgaaatttctattaaacatttctgcaagtgcagagaggaggcttctaagcattaagataatactaattgttaagatagttatatcaaattcaataggatgggttaagtcattgataaatggacacaggaataggaacaggtagttcaaacaagagaaagagtgggatgattttatttaaaaagaaaaaagttaactttcaagtaataaaaaatagagtattaaattgaaaaggtacaattggacaccaattaaattaacaaaaaataaaatccaaagctgaaaagaccagtaaaactagcacattcacgtattactgctggggaccgttatctattaggacaatttggcaatagataccaagtgacatacaaatgcttattcccattgactcaataatctcacttttggtactttatcctgataaaatcttcaaaagaagatcaatatactatatgacttaaaatcttcattaaccaaagcagtaaaaaaatgagaaacaggccgggtgcggtggctcatgcctgtaatcccagcacttagggaggccaaggcgggtggatcacgaggtcaggagttcaagaccagtctggccaagatggtgaaacaccgtctctactaaaaatataaaaattagccgggtgtgctggtaggctcctgtaatcccagctactcgggaggctgaggcagagaattgcttgaacccaggagatggaagttgcagtgagccaagatcacgccactgcactccagcctgggcgacagagtgagactccatctcggaaaaaaaaaaaaaaaaaaaaaaaaaaaaagagaaacaatgtcgatgtttaatgcagggacattaaaagaacataatacatcattccaatggtccaatatgtagcaaatgtgcacagtaatcactgtaaaaagagcacaattttcttgtgtaaaaaacagaacacaatttttaactacactgtgtttatctctaagaatacataatcatgagctgaacacgaaatggaagaaattgaaaataatgcttctgaggagaaaaatcatttttgttttaatatttgttcttttgcgttagtatgatatttacagaataaaaatcaaacagtgttcttagcataatttcagcgtgtttggtgaactcctattgaacatatacaatctatatataatgtaatttctcagttaactaaaacatcctagaatcaaaccaagtaatagtatttactgcatatagcaaatagacccagattaccaaactattatcaagaagctaatgccaatatcactgacttttgctatgaaagcagaggacagtgtctaaaggcacagagcatagttgctgctattacaaaacaattaacatttatccgcgtggaatgcctgccttttcttccatactccttttatcaagcattacagtttctattctccacttttcagatcctcgcactatttgaaagcccttctgagggaacttctgccaaaggcttgccttttctagaaatatcctagggtacaaaattaccacttctttctttctcctcctcacttaagccaaacctaaagtgataaaagaaatgtattccaagatacgaaagaacatgtaattggcccttagtatccagagggtgctatttgcattttaaaagaagagcttattatctctcatctattaaattgctaattaatagcatgaacatccacaaaactgagaccaataacttggttacctttttttcaaatgaattccttttataaaacactgaattgttaataaaatacttatgatggaccagtatcagagcatatatgtaaaagctcaggaatacaaaataaaaacaaaatttttagtaaatatataattaaaatcatttattttactcaagcaagttaaataaccttggaagccacccatcactcataggttcctgtttgaaaagtctagatataagaggttataccatttggatggtttcatgggtatatgcacatgttctagcccatataattttatgcagtttttgtatatcaattacacttcaataaagctgttaaaattaaaaaacataaaatgcagaaggtgccaatgaatctaaaaacataatcaatagatcataaaaatgcctaaaattataaattataacatatcctagaattttccaaaatctctgaaagaaatagtaagctagagttaaatgacagatttcctactaaacaaggtagtaaagagtgaggcttgacgtcaaaccagaactttttgatgtactttaatgcttgaaaggtagaaatacgcgtgccatatatttttctgcaaaattgtattcacagcgaaagttaggactgttatacctaaggaaatcttgactgagtgctaaccctcactgaatactgcccaggttttgtgaggatgtaggattaaaaagtaaaactcccactgaccttgactgacattgagggggctcaggcccttatataaacacaaaggttctcaaaggtagccttttttttttttctcccttcttaaagacattccccacacagaatgttttccctttctcctacggtaatattctgcccgcccaccttgggttttacccaagtgtcattcacactaggaaccatgaccttgaccagctttgcctactgctgtgaaatttactactgggataactccagacctcagaaggagtgtaaattcaaaaatacaacagacttcacacacacccttttctctttctgaattccattgacaatggtgtacaccacagggaattgcttgtgtggtgatcatggtgtgtgaagaaatttaaaatactgtgagcactagcttataaaaaaagattgcctttgtatatgtgtgtgtgtgtatgtgtgtgtgtgtgtatgtgtgtgtgttttctatgaagaatataaaatgctaaatccccaaaagattgtttccccaaccaggaaagaaatgtttcacattcaaacccattatgctgctactgcactatgtgcttgatatatattcacagtatcttaggtagaaaaagtgattgtggactatgagacaacctgaattaatttcaagaattttgagtatttttttctactttaattgtttgtcttctctcatttcttttatgtgtaagaacttattttagtgatattgaccctacatggtagaaaagagaggaggaagagaaagagtagctaaaagcctgagcaatacaatgagcctgctgggtttgaatcctggcgtgatcgcttagtggcaaatgggagagttaattatcttttctgtgcctcagtttcctcctttgctaaatgggaatattaacagtatttatgtggaaatatgattaggtgggttaacttagagaattcagggagaacatttacaaaggtgcctggcgtgcccgaaggattaaataaatattaatcatcatcagcatcagcatcatcatcatcattactactgctagcacatctactactaattttaatgagtcaaactatattccccacagtgtgagccccttctgaatgcaaagcaagtagctcgctgttttatggacattgtctagaaatgctgcaactctaaaattctccctttaacttggaagataaaagcaagtgcatagctctatcattaaaattttaaggttgaatattggttaaatttccttttaaaatgtgttttgtgatattcacctacaagtaaaataaatgtttgttccgggtgaactattacttaaatttttaatgactgtgtctcaaaggaacttcaagaaaggcagtgcagagtaacgaaaggacatcttcccaggaagttttgcttgtccattgttctgcagtttgatcttaaggaagtcattaaccttgtaagtcccagttttgtcatctgtaaactaggatggggttacttgctctgaccatgcctccggcttgtcctgaagtgtcaaaatcaagcaattgctcggaaaattgtaaaacaggatcctaatatgcttatgaacaaaaagttctacatgttggatttgttatttttccttggatcctgtatttacattcatgaaccaagggattcatggaaaaatttaactctgttagctaaccaccaagaggtcgtttgctcttagatccattctctacccatttcctactccactcagtattgagatgtactaactcccataggaggtcagaatttcctgggatttcttgctagctggcttctaactaggttaagtcatgagacacactagtgggagacagaagagcatgagaaagggtgaaacaagataattatcccccttctctctctgtcttggcagtatctcctttgtctccgtttcccactggacggctgctccctctgtaattccattacctgctgtgcagaccttacattgggtgaattagcacccgatggttctggtttctgggctttggtaaaacttgtcggttccccagcccttgaggtggtaatagtttcctgaagttgctaaactctgggttgcctcactgtcctctgttgggtttgtcagctccttcattcctatggaggagccagtcctctgtattgaatttcctctgtttgaaatatcgaatgtggtttacagactaattcctgacaacacgaactgaaagaaatctcacagtaaatgatcctacctacaattccacagggggaaatttaatatatcaaacatacatttcatgaaatatcagactttacatcttgcatccttctctctagtctcagaggaagaggcgacttttctgctattggaagttgatttcaccatctgggcacccatctattctgggatcctcctccacatactccctctctctttgtgtgttccaacttcttgcctctctgcggggaccttctctagagacttcaaacatgagtgtctctctcatctttaaacaacaacaacaacaataatctgcactctatcattttctttcctttcacagtcacactctttagaaggcagatattcactcattatctcaacttgactacattcgtgccactctccaattcatgaaaatcaggcttctgccatcatcgttccactaaaactattctgacagaagtcactatggcaaattgaattactggccccaattctttacctctccctgtatccatgccctttgctaagtaactctgaaattcttcctacgaaagacagcatgcccttgacattgagcttggtcatgcgccttgctttgcctaatcccagtgggatattactagaagtaacacaagcagaggcttgaaatgtatttatgcagtgtggctatcccttttgcacttcaccattaccttaagacaaacatgctctggactagcctactcatctcaggaggagaatgagtgacatatggagcagagcgaccccaatcaacctgcaacatgaagaagtgccaccccacccaagctgaaaattcatgaaaggcaatatgggcttattgctatatgccactcacatttgtgaaaatagttaactgattcagttaccaaaagccaatgcctatggaaagatttaagttcttatttacttgatttatttgcagcaactggtgctgctgactattctcttctcgaagttctctgctttcttggcttccactcttttggtcgcctctgtattctctgagtgttcaagcttttttttttttttttttgcctgtcctttaaatattaatgttctccaaaattctgtctctggatcaatctgatatgttggtcctcaactggagcaggaggcagggaacatactccctgggtagttgtatcataagtttttttttttttttttttaacttttatccaaatcttctacttccattgacactaccttaatttacgtccctatcatctcttgctcaggtactaaaataatcttttttattggctccctccctccactctcaaaccacccttccacctacatacaactgcgtaaatgatctttttgtaatgcaaatagaacctcatttctcctctgtgtaaaacctttcaatggtttgctattacctgcaagacaaagtcctaacctctctctttggattacaaggccctcgaatatatgacccctacctacatattcactttcatcttttgatatcttcttcctttttgagcaattccataattgtccacatgagaatataaatgctctgaaaggttaagtgacttgttcaaggtgacatagctagtcagtgaaagagtcatcataaaaatgcaggtttctggactctcaattcaggtttcatttcaattcagttaaagaagttatgcatccatataaagaaatttaaggaaaaggactgggtttattttaactgagctttgaagaatataaaacaatcttgatgattatagcatgactggaaaattattatgtataataaagtaaggcatttctgaaaaaaagacagcagaaaaatacatagtttatttttgaaaatcactaaacaatttggtcccaagaatgaattaatgttctataaatccttattgggaaaagagaagcacaatttcttccctccttgtgtgaattaaaacgacctataaaacctctttatggatttataatagaaatgttaaaatagctgtaagaaagccatttcaaaagtaaagcctctcaccattaacttcaagactcatctattaaacctctgacattaccaaacaactctgtttcagaaggtaacactctatacagggcatactatttaagaaaatggccctcattttccggcttactgaaaatgattaatctttacaatagctttgaagactacataccaacgtcgttacttttctgtcctttcaacaatgactacaagctgagagcagactagtaaatgtgttatcggccaacccattagagttccattattttctgtcttacatggcttcatgtaatgaatttttataattaaactaatggcatacaatatatttttcccctctttactttcaggccccatttctcttccagctgctttggaataagtttcatacaaaaagaagggaggagaggtctccaagtgcttcgttaccttaatttcattatgacatttttgaaagcattctctttatctgggctctctctttaatttgctgactttattaaaaggcttaagcaatactgtaattaacaaatcacccagctaccccaggcatctgagaaaagtcagttgagagggtgtagaaatggatgggtggaaacgattccagaaacaatgccagaggacagaaccccagaaaatggcgttttttcagctccttttcagaccccatgagcatattgtggtagactgcattattgttctcaaatatccagtgccttttcacgccagaagattatacatcggcattcccattgaactcaggaatggccatgtgactggttttgtctactggtcacttccaggcagaaggctcaagaaccatgttccttgcctctatgatcatgaaagaatgtaccaagatggagataccatcagccatggtccccgagtgactaagctaagtagaatgctctcatcagtctacaacgaacatgtaacatgagtaaaatatagactattaagcctctagatttgaggttgcttattactgtagcttagcctatgctgactgacatacctattcagatatgaccttatttcacatagagtagggcaattctaatacctccagacagtcctggaccaggaccagggctagaataaactagtataatgacacataaagaacaggttctcttattaataaataggaagccacataaatgttgaggaaatgtttagaacaacaatatccctgtttttctgaactacaggtaacatctcagaatatattctataggacagaacctgcctatcttgaccataaaagaaaatagctccctatccattgtgtgatggaggctcccatctaggtagcagttatgttccacagacatggctattttttcatttctatagctggcaagcagcttcatgaaagagaaaaatggagactatgtttctaaaactgtgttcataaaacttgaaaaaataagaaaagatctgtagtcaatgacatgcagatatactttttaacataccataaaattctcccacttaaagtgcataattttctggttcttaatgtattcagggttgtgcaaccattattatgatctaatttgagaacattttatttgcccccaatgaaacccataccaattaacagtccctttctattgtctattctcctcctccttcagtctttactggatgttttatatgaatgtattgatacaatttggggtcttttgtgactggattccatcacttagcatatttttgaggttcactcatgttacagtgcatatcagtatttcatttctttttattgctaaataatattccatttttggatgtagaggacattttaaaatttattcattagctgatggacatttgggttggttctactttttggctattataaataatgctgctatgaacatctgtataaaggttttctgtgtacatatgtatttttatttctgttcagcatacacctgggagtagaatggttttgtcatatggtagcttcatgtttaatatttccaggagactgggaagggtagtggtagggggaaagggggggatggctaatgggtagtgaaatttataatacaaaaatatagtttgatagaatgaataagatctagtatttgatagcacaagaggatgactacagtcaaaaaatttattgtgaatttaaaaataactgattattattagattgtcgtttgtaacagaaaagataattgcttgaggtgagggataggccaggtaccccaatgtgactgttacacattgtatgcctatatcaaaatatttcctgtatcccataaatatatatacctactgtgtacccacaaaaattaaaaattaaaaaaatatttccaggaacttccaaactgttttcaaagttgtttcaccattttacatttccaccagtaatgtgaaaattccaagcattcttcatcttctcaacacttgttattgtctgtattttttgtattagccatcctagtgggtaaaaagtactatctccttgtggttttcatttgcattttttaaacaatcaatgatgttaaccatcttttcatgtgcttatggagatctatacatctactttggagaaatgcctattcaaactgtttcttcacttgtaattaagtcatttatcctttttgttgttgaattatgagtttttatatattcttgatacaagtatcttatcaaatatatgatttacaaatatttttacccattctgaggattgtcttttccctttctttacaatattgcttgcagtacaaaagttttaattttgttaaagtccaaattgtgtatttttcggttacttttgcttttggtgtcatatctaagaaaacactgcataatccattgtattcctacattttcttagaagagttttaaagttttagttcttattaatatatttagctctatgattcattaaaaatatattattattataaagtttattttacaaaagttttaaaacattttatttttaattttattttgctttgacaaataattatatacatttatggggtacatgtatgttctgatatatgtatacactgtggaatgattatatcgagcaatttaacgtatctatcactgcatatatttatcatattttatagcaagaacatttaaaatctgttattttagcaattttgaaatatacaatataatattattaactatggtcaccaggttgtgtcataaagtctcaaaaacttattcctcctgactaaagtttttaaccccttttgatcaacatctccccattttccacccctaaatccacagcctctggtaaccaccattctactctctacttcaatgagtttgacttttttagattccacacataagtgagatcacgcagtatttgactttctgtgcctggcttatttcatttagtataatgtcctccaggttcatccacgctgtcataaacaaaaggatattctttatttaaggctgaataatactccattgtgtatatgtaccacattttctttatccattcatccactgatggaaacttaggttgattccatatcatggcttttgtgactaatgctgcaataaacacaggagtgaagatatctctttgacatactggtttaaattcttttggatatatacccggaagtgggattgctggatcctatggtaattctgttttcagttttttgaggagctaccatactgttctccataatggttgtactaatatacattcccaccaatgatatacaagtgttaccttttttccatatccttgatcaacacttgttatcattcttctctttttataacagccattctaacaggtgtaaggtgacatctcactgcgattgtaatatgcatttccccaatgattagtgatgttgagcatttttcacaaacccgttagctatttgtacatcttcttttgagaaatgtttaagtgttttgcccattttaatcagattatttgttttcttttatgatacatttaagctaatttttgtgtatggtgtgaggtggggccaaatttcattatttttcatgtgtatatccagttattctagcaccaggttgtgaaagactattctttttccattgaattctcttggtacccttgtcaaaaatcagttgaccataaatgcaaaggtttacttttgaactttcaattctatttcattgatctatatgtctattcacattctagtaccacattgacttaataattgtagctttgtagtagtttttgaaattggaaagttaactcctccaatgttgttcttttttcaaggttgttttgactattctacatcccttgcatttcaatagaaatggtaggatccacttgtcaatttctgaaaaaaaaaaaaaagccagttgtgattttgataatgattccatagagtctgtagatcaattggggggatattgatatcttaataatattaagtcttttgatctgagaacatgtgatatttttctatttttttatctttaatttctttcaacactgctttgtattcttcagtatacaagccttgcatctcttttattcctaagtttttaacattttttgatgccattgtaaatattttcttaatttcacttttagattattcatttttaatgtataaaataattcattttgtatattgatcttgtatcctacaaatttgctgaattattttattatttctaatattttttcatagattcttcaaaattttctaattacaaggtcatgttgtctgcaagtagagataattttacttattcctttctaatctggatgtcttttatttatttttcttgcctaatttccctggcctgaacttccagtacaatactgaatagaagtggtgagaccaggcatccttcactatttcctgatcttaggggaaagcattcagtgtttcacaataacattagctgtggaatttttgtagctgccttttatcaggttgaggaaatcctcttctgtattcgtttcctcgggcttctgtaattaagtgtcacaatttgcgtagctgggtagacaaaactcattgtctcagacttctggaggctagatccaaaatcaagattccagcaggcccatactcctgctgaaacctgtaggggagaatttttccttgcctcttccttgcttctaatgatggccgttaatcattagttttacttgtcttgcaactgtagcactttaatctctaactgtaacatcacatggtgtttttcccgtggtcagtgcctttatgtggcattcttctctctgtgtatgcctcttttcctcttcttataaaaataccatcttaacttgactgcatctgcaaagactctatttctacataaggtcacatttgcagatacctgggctcaggcttttagtatgtcttttgggagcgggggacactattcaatccacaaaaccttctttttttttttttttttagacggagtctcgctctttcgcccaggccggactgcagtgctgctgtctcggctcactgcaaactctgcctccagggttcgcgccattctcctgcctcagcctcctgagtagctgggactacaggcgcccgccaccgtgcccagctaattttttgtatttttagcagagacggggttttaccgtgttagccaggatggtctcaatctcctgacctcgtgatccaactgcctcggcctcccaaagtgctgggattacaggcgtgagccaccacacctggccaataccttctattcttcatttgttaagtgttctttatttttcaagcttgaaagggttttgtactttgtcacatgaattttctatatttattgtgatgaccatacgatttttgtcctttattctattgatatggtataatacattgattaaattttggatgttaaaccaaccttacattcctgtgataaatcttacctggttatggtagcaatcatgttaatatgttgttgtattaggtttgataattttttgaggcgtttcaagtctatattcataaggcatattgctctgtagcttgttttcttgtgatatctttgtctggttaggaagtgttcctttctcttctattttttggaagagttgtttatatgtttggtagaattcatcgggggaagacttctgggcctgagcctttcattgggagaagtttttaataccaattcaatttcttgttataggtctatccaggttatctatttgtttagttgttcataatatcctcttttacttctttttatttctgtaatgttggtagtaatgcaccctctttttctctaatattagtaatttgaccatttctttcctaaccaatcagctaaaactttgtcaattttgttgaccttttcaaataactaaatttctagattttggttttgttgattttttctattatattttcttcctctatctgatttttttcacactaattgttattacttcctgctgcttactgtagatttacttttctcttctttttctagtttcttaaggtagaagcttaggctactgatttcagatctttttcctttttaaatataggtatttatagttatacattttactctaagcactgcttcagcctcctcccataagttttggtatattgtatttttatttccatttatctcaagatatttttgtattttcttatttcttctttgtcccattggctatttaagagtgtgttgtataattttctcatatttatgaactcccaaatttacatctgttactgatttttaattgtactccattatggtcataaaatctgcattgtatgattttaatccctttgaatgtagtgagacttattttatgacctagcatatggcctaccctagagaatatttcgtgtacagttgaaaagaatgagtattctgctattattggatgaaacgctgtatagatatctgttaggtcttgtaagtttatagtctttatagtctttttcaagtgtctatttccttgttaatttgcctagttcttttacctgttattaaaagtgagatgttgaagtctccaactatttttgttgaattacctaattcttctttcagttcagtcagtttttgctttctgtatttccttaatattttttctttcttttctttggattggattatcccatttacctattttcaagtttgctgattctttcttttgcagcttgaatctgacgtcaagtgaaaatttaattttagttattgtgctttccaactccagatattccactgagttcttatttacaatttctatctctttattgatactctctatttgttaagacaagcacatgggcttctagatcccgcaagaacatgtcagaggttgccaaaatcccctatggacacctcattctccagagcttcactggaagtttttctccagacctatgtttatctcaactagcatcacagccttaggaacctgttatgttaaagaattgctgctaattggtttggaccaacaccctggagctagggcttttcctagaaagttatctctaagtcgggccaaataaaggcaaggccatgtatataggtttattccagggagctgcaagataggtcaaacagtggcaaggttcttggaataaaattggcctttttgaagaattccaatcctggtctacactctctggtggctaaaaggctgctagttttcacagctattatggttgcaaggctactgattttcaaggctactgtggagctgggagaaagtgacgggaaaggccaacttaaaaaacctcaaactttgccatttttattgagagtcagcatttcaaaaattgttgccagcctttggttaattcccagggttcagaaaaggcgatgtggggccaggcatgttggctcacgcctgtatcccagcactttgggaggctgaagtgggcggaacactcgaggtcaggagtttgagaccagcctggccaacatagtgaaaccctgtctctactaaaaacacgagaaatagttgggcgtggtggaatgtgcctgtagttccatctacttgggatgctgagagactcacttgatcacaggaggtggaggttgcactaagccaagatcatgccactgcactccagcctgggtgacagagtgagactccatctcaaaaaaaggaaaaaaagaaagaaaagaaaaaagaaaagatgatttcgaaaattttttgaggagcagatttacacagttaccacattatattttcaagcacgggataagttaaattgtgaaaagcaaactagagaaaatatggtacaatcaaagcataaagttattcaaggcttggtgactctgcattaaatatttatataatataatagttacctggggaaactagcccattactacctgtgttctatcagcaatgtagagagcactctgtttgtatgctttgagaactttaagagtttcatgcatactttagaaggaaaagtactattgggttattgatcttttctctttaatcacatagaagctttaggggagaacaaaagggaataaagaaaatacatgaagaaatggtaggtcctggcaagaagatttctaataatgcttttcattattgtaccagaaacccaaacctcaaactactagtgtgggtcaatttgctgatttaattttgtacaactccaaaaaatacacaaaatatataaaagaaaaattcagtttccactaccgtacatatttttatggtggatgagatatatgatgccatcgatccttccacagataactaaaaatgtaaggcactacttccatatttgaaaaatgtctccctttttagtaaaataatttgagacactcaaatagctgccttagttactacatacaataagttcaacttttaaaattaattatgtgattatagaatgtctgtgtttcaagtttcctaaagaatgccttcaaaaacacagagattttgcagccttagaaatgtttattcaataatttgaaaagtattgaatttcttgcttcagatagttttcaatattatatagccaaatcagccaggctcaaacaagatttcacttctctattgaattcatgtactcttagctcagccaagcacaaaacagctaatgctgtcacgtttgaaaagcttttacgctgaatttgacacaaaagcaatcacaaagccgacaaaaaggggatttctctttcaaaaactgacaggggaaaaaataaatgaaaactcggagcctgggaaaatctctcttgacactggaaaagaaagtttaaaacgatcaagaaataatttttccaaagaatccattgccaagtttggaccaatcttaaaagcctagggaacaggttatgaactcaaccaagaatccgccaaatgaaataaatcctatgatgatcactgttggcagttttaggtgccaatggcatactatttttgcctcttgtgaaagttctaaatggcatcatctctcataggattctgtcatagcctattggcaaagattttgattagaatgaaaatcttgtatgtttttgcctaacatctgtctttctatctcaaaagaactttattgttgtaccaggcccatagagaagataaaattaaaccatgaagccatgtggctaacaaaattaactactttctaacttcatgtttttgttttagaaaaaattaagggtgaaagaaaacaattaccaatatgttatggccgtctcttgatggcctgctaattaattgttgatactctatgccatctgcattctgttttttcaccaaatcaagactctcctgttgctgtttctttccactctgaccacgctttcaagataagctttttccacatgacatctccggttttatttctgttctgtgaataggttgttattgtccccatttattctccttatttatgtatttttgagacagagtcttgctctgtcacccaggctggagtgcagtggcgtgatcttggctcactgcaacctccgcctcccgggttcaagcgattcccctgcctcagcctcccaagtagctgggactacaggcatgcagcaccacgccaggctagtttttgtatttttagtagagacagggtttcaccatgttggtcaggccggtctcaaactcctgatctcgtgatctgcctgcctcggcctcccaaagtgctgggattacaggtatgagccaccgcgcccggcctcaccattctttttttctaaataaaaggaggagttttttctaaatgtcagaccagcaaggacataaagatggaaattaatgaaataatataaagaagttaaaataattattaaaagatgtttaacaacattgataaatatttatgcaatattaagtttacaaatcagaatttaaaatttaatttacattatgtagacaattaaaatatatgtagataagaactagaagagactgtcaataaagattagcaattatgaatcattaattgctttttggtatcaagcatttttggtaattttctttttacgttcaggtatggtgactggctcaaattttaagagttataacagtgttggtggttgggtttgaaacatttcattgttgctcagtagtgagagttagtgtagtcatcactgaggtgctgcaaaggaggctggctgctgtaatcacagctctccaaggctgtagacatagctttgtgattgccttgtgaggctcacaggctctcttgttaatcttaggcacacagactcagaaagaacttacggagcaagggggtgttgctttagccatttaatgtctcctcctgtctattttcacacttttttcctaaaagaaaattttaagtaataagccagctaatatcacttagtagtgatgacacattcgatgtaaagaccagataaccattttatttgctccctaccttttagaagaattaaacattgtcgtttcattaaaaatgaaatgcagtttgcaattattgttttattttttcatcaaagaatataatatgaaattttttttcgcagtatactatttcattgctttcattttctacctgttggtttatcagtaatgtaatataatcttatttgtcaattaataattacatgagtctttttcagattcttatggggttttcttgctttgttttagccacgtagacaattggaagaggaagcctgtgaggtcatctacaagagtaattgctatgcattcgcatcacaactctactactttcaaaagaagattctgaacttctctagccttcagttttcttctctgcaaactaagaataataagagtacttttcaaagagtgtttttgaaaggatgaaataaaccaatatatataaagtgactagcatactttttgacacacagcaagcattcactaaaagttattattaacattaggattactttaattttagcatacatcattcaagaaatggatgaaaaaattacagctttggccatctttatctgtatcgggaacttacattgaatctgcagcaatacacatcattaaattcctaaacacagagcacaaacaaaaaatgtcaatctctatagatagtggctgagccatttttatgatgtagttttagaccattccaaagcgttttttttttttaatttcaaaagtttgacaaaggatagcaattataatacaattctggttttattttaggtgattaaaacatcttacatgttttgacaatgcaattgttttgttttctactttcatatttccttctgcagatatttttgtctcttatttaaagctacttgctcttctaagagcaattaaaccctaaccattcttaccatcactttaggattttcttaggttaaatttatttctcatttgctaactaccagagtcctcttgccctagtcaaatctatcactgtatgcctctcatctctccttcttctcatctaactcaaggatccagtccaaacttcgtattttctgcttataccttcttaccagttaactactttggtttgtgatccaatagattcatagtatccgaaacttatagagaagaaaaagaagtagcataacatgctgactacctcacgaatatgactagagctttcaagaataaccacatgattctatatattacatagtcagaccaggaattaggaaaatgaccattggagattcctaattcatctatgctcatccattgaaaaaaccattagtggtaacatgtgtctcttgaaagaatttttattcacctagattttgactccaacagagctaatgataagactgtaaaattctatgtggctttctaacatcctcatcatataaactaaaaccttgtcctcatagcagctcaggtcccttcgataaaatggctatgacagagattggctaaaagctcactaattccattaactcttcctgaaattcaatcgagaacaagttctgtgtgatgggatgtggtggaagtgatatacataatttccaggcctggccataaaacaccatggattgactgaccacattctgtcttccttttctgcagtggcttttggcagtgtgttgaaaatgacaagtgtcacaaaattggaaaagtctgggtttccaagtgaccatgttgggggacagctcctaagaatggcttgtcaacctctactggactatgatataaccaagaaagcagtctttattgtgttaagctattgagatttcagagttcatttcttactatagcttagcatagcctaacctgactaatttggaaatggaagccatttcatccaagaaaatgatacggtttccttcttagatgacataaccaatttgagaatcagatactggtttagcaaaaggccttttctgtcagataaaatatctatagagggttttgatcaagtgcccaatctgatcaacctcctaccatgttacttccctgctcaaaataccctaaagcttaaccattgtttaacatttaagggcttttcaaactgactagtaaatactaagtttgaagggattaaacgcatgcaaagcactatgcatgctgcttgataaaacatagttattaagcaattttcttccttttcctttttcttttatcctgaggaattatagactactaagcagacagatatttgaggaaatttcagaggaaagagaaagaagagaagaatgagctgggctggaggtaagagaatggggggagaaagtgagagtactccttattcctccccaatcctgatacccactcacccccatttcttgatccagggcctccaaataagatatgaaagagtagacctgttactttttctaggaaggaattaagcccgaatggttgacttcatgcaactacataaatacgtataccaattttgaagtgatcttaaagatggtgcaacagaaaaccagccaactatatccagattactaaacaaaattaactttaacattgacattagctgtcaattttcctctattctctaccttgactcaaaagtctactggctaggcatgctaactcatgcctgtaatcctagtgctttgggaggccaaggaaggagaattgcttgaggccaagagttcaagaacccatctctacagaaaacaaaaatttttaaaaaattagccaggcgtggtggtacacgcctggctagtagtcccagctactagggaggctgaggcaggaggactgcttgagccccagagttcaaggctcagtgagctatgattgtgccactgcactttagcctgggtgacagtgagactctgtctctaagaaaataaatatacaaagtctactgttcatttcagctttaacgtgattttctgttaataactttacattaaacatcattaaattacaatctatggtataattttatcaaatgtaaccagtattttattttaaaaaggtatctttgatactaaccttggtttctgtgattttcttttggattgcatctactgtatagggaccctccttccatgactcaagcttggctctggcctgtcctaagacctgctcagcttcttccttagcttccagccattgtgttgaatcctttaacatttcattcaactgttgcctccggttctgaaggtgttcttgtacttcatcccactgattctgaattctttcaactagaataaaaggaaaaataaatatatagtagtaaatgctagtctggaggagacattttaaatgtaacttccaaacgttatctcacatttatgttgcttatttaaaaaattattcattgtgttatggctaggatgatgaacaacaggattctttgcttttttgatggcaaatattagtttctgttaaattattttcctgaaggtgacatagaacatcaacatatatataaaattttaactcaattcttgatccctagaaccaaatatgaatcatctgttagaaaagcactacagcagaatatccatatcccctcatccttgccacttcagcacccatcagcctgatttcccagtgccagcatttcattgcctgaaggctttctgttgccacaggagtttgctttgccatccatgtgacaggctagacataccaggcaactgatgcctcccctccagctcccagaggcagcctgtatataatgactaattgtaggaattgggatattgttacactagctcccttgatgctaggggaaataactctgaggcatgtattttacaagggttccagagtttcccaagggataaagctccagtgacccacaacagcagctggcttgataatgcaccactctttactggctgccttgcctcacctgtctcatttttccactcttctactgattaatttaccccccaaataaatcacttgctcttaaaaccttttccaagggtcttctgagtgaacccaagggaagataagtgtattagaaacttcttctttttctttcttttttttttttgatggagttttgctcttgtaacccaggctggagtgcaatggtgcaatctccgctcactgcaacctccgcctcccgggttcaagctatcctcctgtctcagcctcccgagtagcaggaactacaggcacgtgccatcatgcccagctaattttttttttttgtatttttaatagagacagggtttcaccatgttggccgggctggtctcaaactcctgacctcaggtgatccacctgcctcggcctcccaaagtgctgggattacaggcgtgagccaccgcgcctggccaacttcttttaacaatacctaagaattcacgctgggtgcattttgtaagactggcttatattgaggctatcactggtatcattggaagtccaagagggaggtactatatagattctactctgaaatatgttcttttcaaatattaaaataaacaggactacattattttttctatgcaacttctctaagctggttttatgaaataaaaataatacagaaaacaagtaataaaactgccatctactttatcccttaagcatgaaacctgatagacattctagattctttcctaagcgtcacccaacacctcatataattagttacaaatttctctcatatataacttctttcctctttctattggcactgcaaacctctatcattttttgccctcacatccataagaggctctatatcatcctcccagacccaaatctctgttttagaatgtaaattctaccccaattaaagattaaaactaacataaatctgatcactgcactccctcttataaaacccttcaatgtttccctactgtcttctggaatatcttagctggacatacgtgttcttctatgatcttgcctagataatctgagaggtttatctacaaagcaacaaatcacaagataagcagggtataagaaaccatcacagataatacaagaaccttgcaacagtagagctgttactacatctaggcccaagggatgaggggagggaaaagtggccaaaagcagagaattggaatgagaaaccaccctgagaagagcaataaccttttgtcaaaggacatagtcagcctgtggcaacctcaaagggagggaattaggagaataaatatcttgacctcactttacctcctgtcttcaatttccttctagggctcttgggtgcctaaaccaactggaagccaaagggcatgggagcccaatgatgacagaggtcagcctcccagaataaagagcaagggagagaaggtcaaagaatggctacagatggacaaacaaaatgtatatggcacaggaatataaaactatgcttcttattttgttatgtaagtaaagtcctttttaattaaccctgttgcctccacaaagttatgtgaagttataagttaaagaaatacttgagatggccaggtgcggtggctcacgcctgtaatcccaggtctctgggaggccaaagcgggtggatcatgaggtcaggagttcgagaccagcctgaccgacatgctgaaacccagtctctactaaaaatacaaaaattagcacacgcctgtaatcccagctactcaggaggctgaggcaggagaatcacttgaacccgggaggcagaggttgcagtgagccgagatcatgccgctgcactccagcctgggtgacagagcaaaactccatctcaaaaataaatacatagaaagaaatacttcagatattttgtaaataagcatcaggactagaaagaccccacaaaactagtgattgtaacatgaaatcaaaaatatagtccccagaataattaaaactcagtaagtggcacacattatagactactgtttttttatcaggtttatttctgtttgggtgtttgctatgtattgcaaaactagtcgacatattatattgcaacttcagttaacatgtcaacctctgtttaaccgtaagtctctctctaatctttgaacgccattgttttgtgtgtctcattgttgttgttccactaggtagtggaacagctttcgtagttgaggccttgtaattgtttagtcttctaattaatctttggtttataaaataaatggtgtaaatgctcttataagaaagctgtataaagtgtaaatgaaaatgtctttaagtgttctgaaatattctgtggatattccaattacaaaccctttttcaacttatcatagcaggctactttagtacacatacttgggactttttctcatatcctactgttatgtaccatgtgtatttgaaaataatacagttgacattccttaaaaatagtctctgattccaatttgccttcgctttcgttagtcttaattactaacattttactatgctagcaatattttttagaatgcctagtggttttcacataaacatagcaagctcttttgattcatgccagtaaatattttgtacatcctacagttcatttcaatagggaaaacagtctatatttttaaaaggccatctctagatattaggaaaagataaagcagttcttcctattatgtaggaagataattttaatcctggaaaaagaaggaaacttttataacctgaaccattatttcaggcaaacatgggatttgaatgcttgctcaataatagaaggctttcagcaaaaaagtggtcatatgtgtgttatgtagcaagttaaaatggctccttggggtgtgcatcccactgagggtatgctttttcacccttgaccttcaactgtacattatcataatttattagttaattaaaaatatttataggctagagactcactcaataatccatctatccctctgtgcatccccacacatccatccatgtagccagctagtctctattttatttaccatctgttagacaccagccattatgataagaacttggaaaacaaaagggtttaagacagattacctggcttctggtttaggtgcctgttagatagtggtgctattcactgcctatccaaagaatgcagagtgagcatggagaagataatgagttcagttttggacctattcactgggaggttgtgaggaacacacacataaaactaacattttagtcaggaggactgaaggatctatagcatagctgtgtattttgggagagacagaaatctgggattggccgtcactacagagaaataaaaagcaaagcctcaaatgcaagtgcattctcatttatatggcacatagactgagcccaacaccgggctgggaatggactcctggaaaatacaacgtaaaaagaataaataaaacacaaagagcaaataagatgaatgaaagactagagaaggaggaggaatatcaagaaagtgtacttttatagaacatggaaaagaaagattttcaaaaacacaagagtgattaacactttcaaatctcatagatgtcacaagacataataaaaatcataactaacatttatttgaatatctacactgtctgaagctctgtgttgttctttccttgcattaatcacttaatcatcatacaatcctataagtataattgtttacgttctttttctattgctgcaattatcctcatttaacaaatgaggaaataaagacagcgttaaataactggtctaaggtcacatagatagtgattgttagagccgacacttggattcaagaagttagacctccaaagcccatgccaaaagtatccattggctttggccacatggaattccctgaagaccatacacaaaatgatttcagtgcagtggtagaaatcttactgtaggagattaaaaaatacctatgaaaaagtaaggacagtaaattgtagactatccaaccatagatcattataagaaggaagtcagaggggagtttggtgtcaagagaagttttttcccaaatatggaaaacttgagtatgaatataggtattgattggggaaaatggtcaaaagacaaagatgatgccagatggaagaaaagtccctgagaaggtgcgtgtattgaacattaactaactacctccttctcctgtgtttcccctgttatttttccatttgtgcagttttcccacaatagacctctctttgctctgtggatggtgtgtacttagttttaactcatctccctggctttagtggttaattcaaagatggacttatggttccaagtaaggtcaatcagaaccaatgaaacaactctaggatttttgttgttgttgttgttgttcgtgattctaaaagagaaaacccattgcttcttgtttaagatggatgagaaagcacgtagttctgcagtatcctgatatccatcttagaacaattaagaggaattaaacggaacaaatactggggagcagagccatgcaatggagaaggaaaactagaatctggtcatgctatttaattcctgaatcaagcctcgtctatctttcaactgtttaatgacactgatcaatacattttgtctgagtaagtctaagctactttgaaatggattttccattactacaatgtacaagttctaacttatagagagagacaaactcttttgatgtaaacaaaggtctcctaggaattgtacaagaatcatgggaattgtacatgggaatagctttcaaatacaaaagtttaaaagaggactttgatcctgcttaaagtagctttaactagggtatctagataaatacactgaatgcttatatcaccttggaggagttcctacataaaaaatttccaaagcccatagaaccaaaacttaccaaaaatgttatggcatttagacaacattattctgtgagccttatgggtaggaagggatttttgccaccaatgtttacctctttctattcaatttctttatattatgaatacataaatgaaaatgacactcaaaaagagagacatctggggacaaaattatcccaggacattcacatatagggtggccacgcctggttacatccatggtttaaaataattctactctttttcccttttaagtagatctttgataacggaacacccactcaaatgtcatcatcacatataaagacttcccctgctctcatatgtgcagtcattttctctcaccgtggttctcccataacactttgttaagattttaaaacttgtactgtgtgctactatgatttacatttttacattttacatttctgtctctgactctagacagtgtccttgcctcaaaggcaaggacagaatctgtagaagatgctgtcagggcccatctatctgccgttggcactcatccttcaagtatatgccagcagtgtcctagtacaagcatttgccctactgcaaacctgagagattttcctcagcttgctaggtgcgctggccagaagtgctggaaagtttatgtaccaggaagcatttagccaatgatggataagagttggaatagttagccctggttccttgcctttacccccttgtggttgacaactttgaggcatgttttttgtttgtttgtttgtttactatctcccagagctccttcatcaggatcaaaccccagtggcccaaagcaataactagttccataactggcttaattattggcttctttcatttattatctcattgtcccactctcctactggtacttcctgggatcacattacaaccaaaccactttcaccattaatcattgtttaaaggtctgtttctgaaagaagctagcctaagttagtattttatccatttaaaaaaatccttctctggcaaagcggaagaagctagaaaataaaaataaagtaaaaagtaaaaattaaaaacatccttagtgcacaaactagtgtttggcatttggaataccttcaataaatgtctgtcaaatgagttgtacatgtagattatttccattatccccactttctctttataatgatataaaaatgccatttctaaagttaacctttgcccagcatcttcagtctttcttcttaagtaaccactatttgtttgttgcatttcaagttttcataatttgaaaatggactcaagactttcccatttccttccttattttcctcttatgcttatgctaatgatctctattccaggcgaacaaatgtcctctgaatttcctttgtttcttatttaatgcctttgtatcaaccacattcatttgtataaaacatctttaatgtcatgtttactagtagaatatctgtgccttatataaaatccataaattaaaagatatgggagggtcaaataattcagtaagccaaaactaatcaatgacctctctttccctaactttcttaaaataactataggttagagagaatctgttggcatatcctattgcctgtgtctatcttcttaatcaaattacagataaataatttagaaacgtccctctatatattgaagccagtggattagggtctcccacatgacctagggagacaccagctggcatggctaagggagtggttgcaccatacctcccctactcccagcagtgaagcttgcagcaacagaagtgactccttacttctcgttaaggagaagagagcgaaaagtaaagaagactttgtcttgcatcttggataccagctcagccacagtaggatggggcatgggcagagtcatgaggcccccattccaggccctagttcctggatagcatttctagacacaccctgggccaaaagggaatctgctaccttaaagggaaggactcagtcctatcaggattcatcagctactaactaaagaggccttgaacgttgaataaccagttgcaatacccagggagtacactgtgggacttggcctctgagatgtgctggcttcataggtcacccagcaaattcccagctgtggtggttatggtgaaagaccccttctgtttgagaaaagtagacagaaaagtaaaggggactttgtcttgccccttaggtaccagctcagccacagaaaggcagagaagcaggcaggcttctgggatttctgagtcctggcctaggttcttggacagcatttttggtcctgccttgggccagaggggagcccaaggccctaaaatatgggtcccagttctctcagcattcaccacaagctgatggaagagcccttgggctttaagtgaacaccagtggaggccaagcagaaccctcatggtggtgagggccacagggagaggatcctctgccttttaaaagggcaaggaagagcagggagcactttatattgtggtgtgagtgctagcttagccacaatagaatagaacatgaggtaaactgctaaggtttttgactccaatgactggccctcagacagcatctctggatatgcccggggcctaagatttccaccgaaaaatctgctgccagatgtattgaagctccactgcatgttatttgtttcctttctcttgctgcttttaggattctttctttatccttgacctgtgggagtttgattattgcatgccttgaggtagtctctgagataattctgcttggtgttctataactttgtcgtacttgaatgttggtatctttctctgtttctgaagttctctgatattgtccctttgtatcaactttctatccctatctctttctctacctcctgtttaaggccaataactcttagattgacccttttgaggctattttctggatcttgtaggcagacagcctatttgaaaatacacagccagagaagacaaaagaaaaaaataataagaaacaatgaagcatacctacaagatccagacacaaaaaacccttcaaaaaaatcaatgaatccaggagccagttttttgaaaagatcaacagaattgatagaccgctagtaagactaataaagaagaaaagagagaagaatcaaatagatgcaataaaaaatgataaaggggatatcaccaccgacaccacagaaatacaaactaccatcagagaatactataaacacctctacgcaaataaactagaaaatctagaagaaatggataaattcctgcacacatacaccttcccaagactaaaccaggaagaagttgaatccctgaatagaccaataacaggctctgaaattgaggcaataattaatagcctacaaaccaaaaaaagtccaggaccagacggattcacagccgaattctaccagaggtgcaaagaggaactggtatcattccttctaaaactattccaatcaatagaaaaagagggaatcctccctaactcattttatgaggccagcatcatcctgataccaaagcctggcagagacacaacaaaaaaagagaattttagacaaatatccctgatgaacatcgatgcaaaaatcctcaataaaatactggcaaaccgaatccagcagcacatcaaaaagcttatccaccatgatcaagtgggcttcatccctgggatgcaaggctggttcaacatacgcaaatcaataaatgtaatccagcatataaacagaaccaacgacaaaaaccacatggttatctcaatagatgcagaaaaggcccttgaccaaattcaacagcccttcatgctaaaaactctcgataaattaggtattgatgggacgtatctcaaaatagtaagagctatttatgacaaacccacagccaatatcatactgaatgggcaaaactggaagcattccctttgaaaactggcacaagacagggatgccctctctcaccactcctattcaacatagtgttggaagttctggccagggcgatcaggcaggaaaaagaaataaagggtattcaattaggaaaagaggaagtcaaattgtccctgtttgcagacgacatgattgtatatttagaaaaccccatcgtctcagcccaaaatctccttaagctgataagcaacttcagcaaagtctcaggatataaaatcaatgtgcaaaaatcacaagcattcttatacaccaataacagacaaacagagagccaaatcatgagtgaactctcattcacaattgcttcaaagagaataaaatacctacaaatacaacttacaagggatgtgaaggacctcttcaaggagaactacaaaccactgctcaaggaaataaaagaggacacaaacaaatggaagaacattccatgctcatggataggaagaatcaatatcgtgaaaatggccatactgcccaaggaaatttatagattcaatgccatccccatcaagctaccaatgactttcttcacagaattggaaaaaactactttaaagttcatatggaaccaaaaaagagcccacattgccaagacaatcctgagccaaaagaacaaagctggaggcatcacgctacctgacttcaaactatactacaaggctacggtaaccaaaacagcatggtactggtaccaaaacagagatatacaccaatggaacagaacagagctctcagaaataataccacacatctacaaccatctgatctttgacaaacctgacaaaaacaagaaatggggaaaggattccctatttaataaatggtgctgggaaaactggctagccatatgtagagagctgaaactggatcccttccttataccatatacaaaaattaattcaagatggattgaagacttaatgttagacctaaaaccataaaaaccctagaagaaaacctaggcaataccattcaggacgtaggcatgggcaaggacttcatgtctaaaacaccaaaagcaatggcaacaaaagccaaaacggacaaatgggatctaatgaaactaaagagcttctgcacagcaaaagaaactaccatcagagtgaacaggcagcctacagaatgggagaaaatttttgcaatctactcatctgacaaagggctaatatccagaatctacaaagaactcaaacaaacttacaagaaaaaacaaacaaccccatcaaaaagtgggcgaaggatatgaacagacacttctcaaaagaagacatttatgcagccaaaagacacatgaaaaaatgctcatcatcactggccatcagagaaacgcaaatcaaaaccacaatgagataccatctcacaccagttagaatggcaatcattaaaaagtcaggaaacaacaggtgctggagaggatgtggagaaataggaacactttacactgttagtgagactgtaaactagttcaaccattgtggaagtcagtgtggcgattcctcagggatctagaactagaaataccatttgacccagctatcccattactgggtatatacccaaaggattataaatcctgctgctgtaaagatacatgcacaggtatgtttattgctgcactattcacaatagcaaagacctggaaccaatccaaatgtccatcaatgatagactggattaagaaaatgtggcacatatacaccatggaatactatgcaaccataaaaaaggatgagttcacatcctttgtagggacatggatgaagctggaaatcatctttctcagcaaactatcacaaggacagaaaaccaaacaccgcatgttctcactcataggtgggaattgaacaatgagaacacctggacgcaggaaggggaacatcacacaccggggcctgtcgtggggtgaggggacgggggagggatagcattgggagatatacctaatgtaaatgacaagttaatgggtggagcataccaacacggcacatgtatagatatgtaacaaacctgcaagttgtgcacatgtaccctagaacttaaagtataattaaaaaaaaaagtaagttgtgatgttagaaacataaaatgtgggaggagggagagtcaaagtgttgagtatatgcacacaatcaaatttaagttattatcagcttataaaatgttttatgtaagcctcggagtatccacaaagcacaaacttataatacatacatgaatgataaaaacaaaagacccaaagtatactactacacaaaaccatcaaaacacaaaggaagacagcaatagaggaagaaaggaacaaagaatctgtaagacaaccaggaaacaatgaacaaaatgacactagtaagtccttacccatccatcattattttgaatgtaaatagattaaactctccaatcaaaaggcatagagtggttgagtggattaacgacaacaacaaaaaacaagacccaaatatgtgctgcctacaagtggctcatttcaccttaaaggacatgcatagactgaaagtaaagggatgaaaaaagatactccatgtacatgagaacaaaaagagagcagggtagttacacttacttcagacaaaataatctttaggtcaaatctgttcaaagtgacaaagaacatcattatatattgataaaggttatttcatcaagaggacataacaagtatataagcatcccaaatcagagcacctaaatatataaagcaaacattaagggatctgaagggaaacatagcctataacataataatagcaggcaatttcaatattccactttaagcaatagacagaaaaattcataagaaaacattggacttgaatgacattttagaccaaatggacctaacagacatatacagaacattgtgccctgaacagtaggaaaatacagattcttctcaagtacacatgtaacattctccaggatagatcatatgttaggccacagacaagtctcaacaaatttaagaaaacccatcgtgtatcttttctgaccacaatataaaattagaaatcaattacatgagaaatcatataaaattaagaaatatgtggaaactaaacaatatgctcctaaacaattattgggtcaaaagaagaaattcaagaggaaattttttaaaagtcttgagacaaacagaaatgaaaacacaacatagaaaaacttctgggggtagcaaaagcagtgctaagagggaagtttatatcaataaattcctacatcaaaaaagaagaaatatctcaaatgaaatacctaacattatacctcaggaaactacaaaaagaagaatgaattaagcccaaagttagcagaaagaagaaaataacaaagatcagagcagaaataaatgaaatagagactagagaaacaatagaaaaaaagtcaataaaactaaaagttggttttttgaaaagctaaacacaattgacaaatccttagctagactaagaatgaagagagcaggctcaaataaatcaaatcagaaatcaaagagaagacattatgactgataacacagaaatacaaaggatcctaagagactacgatgaacaattatataccaagaaattggacatcctaacagaaatggatgaattcttagaaatacataatctaccaaaactgaataatgaaaattggaaatctgaaaagaccagtaacagctaaggaaagagttaaggagattgcatcagtatttaaaagttctcacatcaaaggaaagctcaagaccagatggcttcatgggagaattctacaaacatttaaagaagacctaacacaaatctttctcaaactcttttggaaaactaaagaggaagggattcgtccaaatttattttacaaggccagcaataccctgatcccaaagccaggcaaagacactacaaggaaagaaaactataggccaatatcacgaatgaaattagatgcaaaaattctcaatgaaatactagtgaaccatatttaatagtttattagaaggattattcaccatgaccaagagggatttatccctgggatagaaggttgtttcaatatatgcaaattaataaatgtgattcaacatataacagaatgaagtacaaaaaccgtatgatcattttaataaactcagaaagagcatttgacaaaattcaacatccttttatgagaaaaactcttagcaaattaggtatagaagaaatgttctccaaaagaataaaagccataaattacaagcccacagctaacatcatgcacaacagtaaaacgtagaaggcttttctctaagatcaggagcaagacaaagatgcccactctccccacccttgtttaacttagtactgggagtcctagccagagcaattaggcaggagaaagaaataaaaggcaaccaaactgaaaaggatgaagtaaaattgccccttcttgctgatgacataatcttatacagcaaatcctaaggactccactgaaaactgttagaattcatacacaagtttagtaaagttgcagggtacaaaatcaacttacaaaaatcagtagcgataacaattgttattgtttgtacaataacaacaaactgtctaaaatagaaattaaggaaacaatctcacttataatagcatgaaaaaatatttggagtgaatttaaccaagaaagtgaaagatctgcgtgttgaaactataagacactgacgaaagaaattgaagatgacacaaataaatggaaagatttctgtgttcataaattggaaaaattaatattgttaaacataaagcaatctaaagattcgacacaatactaacaaaatctgcatattgttctttatagaattttttttaaaaaatcctaaaatttgcatggaaccacaaaagaccctggatagccaaagctgtctttactaaaaagaataaaattggaagtatgtcactactggatttcaaaatgtattacaaagctataataatcaaaacagcatggcaagtacataaaaacagaccaatggaataagacaaagaggactaaaataaacctacacacctttgatcaattgatttttgacaaaggtagcaagaacacacaatagggagaggacagtctcttcaataaatggtattgggaaaactgaatgttcacatacagaataaaactggacccttatctcaccccttatacaagaatcaactcaaaatggattaaagccttaaatgtaatacctgaaactaaaaactacaaaaacataagagaagagctccatgacattggtctgggcagtggtttcttgcatatgacccccaaacacaatcaacacaaaaataggtaagtaagattgcatcaaactaaaaagctttgcacagcaaaggaaacaattaatggaataaagagacaacccacagattgggagaagatatttgcaaatcatacattagataaggtgctaatatccaaaatatacaaggaactcaagctactcaataacaagaaaacaaataaccctaataaaaaaatgggcaaatatatgaatagacattctcaaaagatgacaaacagcatatatatatatatatatatatatatatatatacacacacatatatgtataatactcaacatctctaatcatcaaaaaatgcaaattaaaatcacaatgagatatcacctcatatcttttggattggctattatcaaaaagttgaaagataacaagtgttcatgaggatacagagaataaggaaaccttatccactattggtagtattgtgaattagtaacggcctccataaagacagtatgaatgtttctcaaaataataaaaagagaatgaccatatgttccagaaatcccacttctgggtacatactcaaaagaaaaggagggagtgtattgaagagctatctgcactctcacattgttgtagcactgttcacaacaggcaagatttggaagcaagctaactgtccatcaacatgcgaatggatacagaaaatgtggctcatataaatgatgcggtactatttagcaataaaaaagaattatatcctgtcatttgcaacatcttggatggaactggaggtcattacattaaatgaaataagccagtcacagaacgaaaatcactgcatgttctcacttatttgtgggatctaaaaattaaaactattgaactcatggagacagaataaaaggatggttaccagaggctacaaagggtagtgtggaggtaggggataggtggggattgttagcggctacaaaaaatagttagaaagaatgagtaagacctagtatttgatagtgcaacagggggactatagtcaataataatttaattgtacattaaaaaataactaaaagtacaattacattgtttgtagcacaaaggataaatgcttgacaggatggatgcctcattctccatgatgtgcttgtttcacattacatgcctatatcaaaacacctcatgtaccccgtaaatatatatacctactatgtaccccaaaaaattaaaaataaaaaaaaaattttaaaaacctaggaaattctgtcatttggaataataaggatgagcctggaggacattaggttaagtgaaataaacttggcacagagagacacatatcatataatctcatttgtatgtgcagtttaaaaaaagttgaactcatagaaatggagagtattatggtggtgatcaaaagctgcagtggtgggtggatggaaaaatgagagacgtttatcaatgggtacaaagttccagttagacaggaggaataagttctggtgttcttttgcacagcacaggaactatagctaatattgtcatattgtatatttccaaatagctaaaaaggaggattttaaatattctcaccacaaaaatgagaagtatttgaggtgatagatatgctattagcctgatttgattattccacaatgtatatatatggattgaaacatcacaatgtaccccataatatagttgtcgactaaaaacgaaataaaatttttaaaatgaatattatttgagttgtaattccactcccaggtgtatatccaacagaaatgcatagttattaatatattcaccaaaaaccatgtactagactgttgatagcatggctatggattgcagaattgttgacagcaatttcctcatgttggaaactactcaatttctcatctatatcaacatgtgtaaatacactgtggtatcaatagaatattattcagtaagaaaagtgaacaatccacaactacatacaataatatggatgaatctcacaaacatattgttggggggaaaaatacagccacagacaagtagatatgactgttcgattccttcatataatacacaaaaacaggaaaaagtaatagaaaacttttgaagtaaggatagtagtcacccttgtgaaatgttcatgactggagaagacatgaagggggatcctgagcttctggctatattatattatgtttcttgatttggatgctatttacacagttgcattctatttatagaaattcactcttctgcatatggctagccagttctcccagcaccatttattaaatagggaatttgatttgtgaaatatattctacatacaactttggacaattcatcttttttaaaaaaggtgtcacgtgtgaaatatgtgtcattttggctgctgtgaataataaaagatgcaatcattctgctacaaacacaatacgattttgactgtacattgatgtgacaaagaacatttcagaaattcttattggacagtgaactggactagattcacagacacacatcagcacatacagacgaatcaagcagctattctgctatttaataaaagaaacaaagcagtacaattgattgttatagtagtcccaagagtagaccctgcagaaatatatacaaaagacaattttagaagttttaaatgtatttcattttgtcaaggaatgaaagcaaatctaaaatctgaagatcatcagagcgaagctgttatcctaaaagtggatcagtgtggtagtctgacatcatatagacctggtaattgtccataactgagcatcaatttatactacagaattttaccacacttgcgacacttcacccaggagactgacagatcaaaaacatattatggcaatgtatttggccactagagcccatattgttagatttacatttacaccaaattcatctgacatacaaaagtgaaataataataaagtatatgcacataaacccagacaatctgtgcatgtttgtaattgaagagctacccaatgtacacattttttttttctcacaaaggtccgtcatggaaagcttctcgactaatttgtgcagtaaatagatgttgggtaataaagggaaataaataaccaatgctaagactcaggatgacagactgagacccagcatgtgtcctgatttacgaacctccagaagtgtcaaattggaaactcagcaatcatgtcaagaaccacaatattgcagagaaagaaacagttcagttgattgaatacgaaccaatctttcacttcaagttttttagactagctatgtttaattatcgatatacattcttgactgatataaattcccacaacatctctcttagggaggaatgttatttatacacaagaaatgattaccttttgaatacacattgctacagaacaaagaacagttctgttgcaatttctgcactgactgtacagcacgagaattagaagtctgtgtaactgatttttagaaagcaactttgactagcagttagtcttgggttataaccctggattagcgatgaaatagtggatttaaatgggaaaagttgatttgccacgatctcagtttcctcaactcccaaactgaaataatgacaactgcagaaccacagaattattgtgaagataaaattcaataatgaataaaagcataaaggatcctactaaagcaaggtgctactgcttctctgtatagacaagactaaacaatgaattatagttatcaacaaacattcacgatctgctagggagtgcacactatggatctcactgatcccacagagtacgccagagttccaggtagaaaatgccaaggtgaaaggcttaaattgcaggtaaatcttttgaggtcatttgagtgagtgaagagtgacggacatgactaactgtgggcaactctaaaggaaaaatgatcccaattgcagttaagacaaagatttctaaactatttgttgggatcaggaaaaagggagaaatagcagtagactgttctccgaggctaaaaccatcaaaaaatgttaggcatgatcaagaatgaagctgaaaacaaggaaaccaccattattgtaaccttgtacaaagctaggacacaactatacctagagtaatgtaagcataactcaatgtttgacatacaaagacatataaggaactgaggaaagtccaaataataacacagattataaggaatattaagatatgtcccttctacttccacaaggcatttaaacagggttctgtggaagacctatctatagttaagctttgcaaaagaagtttcaactcaaacccacaaagaggaagaaacatatatgctaaccatgtagctagtatgaacgggcattttttttcacttagatatagaaaaggaggaatgtggttgttttacaaatagagaataaagtatctgagatgtaacagatcaaaaagctaaaaacagaggggagttattggcacataaataaatcctggccactatgatgaccaagttgctttttctctaaatcccaaaaagctagaatgcagaaacagccaagcattttggttaagttcatggaagccagacccagaacaaatgactaaattttaaaattttataatattagcctaacatttaaggttagtttggaacatggaaaagatcaacagtttagtgctattttcacactgtttactcctctattatatggggataataacaagaaaattaataatctagaaagataaaaggaaataatgtacacaaggcactgagaaaagtacctgacccctagacagctctcaattataggggcgtaaataggcaatcgtgtactttggtaacactgttggacttttctggggcttcttaaatcctgagtcataaagcaaaggaggatagattggatgatccctggagatgttttcagctctaacagtttgtgaaatacgtttcttgatgcctctgtcagagctgaaagctcaccttacaaggtttttgtgaagaactcacccagcccagtgcctagatgaacaaatgacgtatcaatagccatactgttcccctggatggacctttggtaaatttcaacttggcaatcttatggtcatatattcagtcatgctacatgtcagttaaaggaaactcaagccaacctaaaaaatgttccctcctgtctgggccaaggctatttttttgtatcttaagagaggcatgtgtcacacaggtatacccattcatcaaaactcatttcataatacacatgagatttacacattctagtctatacaaattttgccacaaacaaacaaacaaaagaaatgtgaacaaatattgagctctggttaatgacatgcatgttgaagaacttaggggtaaagggaaccgatgtcaccaacttactttgaagggcatcagaaaataataggggttggcgggtagagaaagaagtaaagtgatacaacaaaatctagagagtgggttcatgagcactcactgtacaattctttcagctttctgtgtatttgaaaaattttaaaatagaatgttagataaaatgttctctcggctgggcacggtggctcacacctgtaatcccagcactttgggaggccgaggtgaacggatcatgagatcaggagcttaagatcaacctggccaagatggtgaaaccctgtctgtactaaaaatacaaaaattagccaggcgcagtggcaggcacctgtaatcccagctactcgggaggctgaggcaggagaatcgcttgaacccgggcggcagaggttgcagtgagccgagattgcgccactgcactccagcctaggcaacatagtgagactctgtctcaaaaaaaaaaaaaaattctctcacagaaaacacaaagcagtgtattatttaagcagttttctgaatcactaacaccactttccaatgaagaaaaaaataccatctgtgggatatggaagtttaaagatactaaacagaacttatacgagtggaaatggcaaaacgttttgctcaaagtcacaatgtgtatggagaggagttggaaatggaatttaggcaggtctcttaattttctaatcaacagactgtcaaagaccagattacctccttaaaagtatgctgaatattctaatagagaaaatgagttaaccttctaaagaaagctcattctcctgttttggtaataaaacatagggaagtatgtattgcttcccatacggaaagatgagctgggtgagaggaggattgggtttttaccactggttggaggataatagattatgaaaaaatatcaacatccagtcataatgaaacatgtaagttgttttattaattaaataggtgaatgctgaaatgtgatattatttgatcacattaaaatgaataatttttttaaaaacataatgacttctcttttgggggtgttggaaactattgcttaagatgaaagcctgaagttaggagaaaagcttgatgtatatctatgcaaaaatatttcagtttatcatcttaggtcacttacaagtcacagaaaagaaactatctagatgtgataataggcctaacatatcattagatgatccatcggtccagcatctcagtcattaactaattaagtgccaaatgtagcaaataaagtactaacaactcaaaagtgttcagcaagagttcattaaagcgaagctaaaggggaccattataattctagcaccacagatttattaccatgtcaccagcatgcaatgcacacaataaaactcattcatcactgtaaatttgcacatcaaatttgatgcatttgttggaatataaatatttttaaaatcatgtagaataaaaagcatttttttctcccttagcacacactgaatttcatatctacaccttgccacttcaacttttacttgatgagtgcagaaaacggaaattaaccccgaaaaacaaagtggcctcactcttatttttacaagcatactccaccatccaactattcaagttaagaaataaaaataaatggaaaacaatttcttgaacagaaactatggctaaaaagcacaattccatacattgcttactgacagaacttttctgtatttcaattcttccttacctccttctcttcagatttaggtgtccctcctacccatgcctaattccctcgctgtactcaatgttccagtctcttccatcttctatgagaagtgattccatcttttacccctcctatgtcttcaatctccgtctacaaccatgtttattttaagaagaaaacaaccaaaaccaaccaaacaaaagacaaaagagtattatttcctttggtcctacaccccacctgcgtcccctgatggaaaccctatgtcttcctcctttgtgggagagtggcttacaccagtgctacttaaaggatggtttgtgtatgagcagcatcagcatcacctgataacttgttagaaatgcagaatctcaggctccactctagagctaatgaatcaaaatctgcattttaaaataagatttttcaggtgattacattttgagaagcaatagtctatacccactatttccacatccacacctcacatacccttctaaaccattacgttttggcttttgccactgaaattacttttgtaggtgatagcagtgaccttaaagttgctacagtattagagagtctaaagtctttatgttttcagatatcccttcagtacctgccaattgacgaaccctctttgaaaccttctcttttgattaatatggaagattccttcttggattttattctgcctatttggccactcctcactctcttaggcccattccttaaatgttgctattccctaggggtctccctttgatctttttgttttcactttacatattctctctggtgagttcatgtatgtatattgcttcatttactatctctaaaataatcagagtaaaatctgtgttttaagctaagaattgtctcttgaactctgtatccatagagccaaacgcctactaaatctctatgaaatagccaacatatccaaactggattacatcatcttcattcttcctctcccctaatcactgatacacatctgttcctctacttagtcactgaaggagaaacatgcaaattatccttcattcttctttcttccttatactttaaccaagaagatgccgagtcacttctccttaatagctcttctggcctctatatcattcatctctctcttccctagattgctttagttaaaagcctcctgatggtctctctagttcagcggaacacaaccttgtctgtgcatttgaatcaagagggctgctttaaaaactacgaatgtctgggccctattaaggctctgatttaactggtttggggtggagtccaagtattggcattttttttaaactccccctagtgattctaacgtgcagccagggatgagaaccactgatttaatgttagccttttgcactccccatccttctttaaaactctagtcagagaagtcttttttttttttttttttaatagggagtctccctctgtcatccaggctgaagtgcagtggcaccatcttggctcactgccacctctgcctcttgggttcaagctattctcctgcctcagcctcctgagtagctgggattacaggcatgcaccaccatgcccagctatttttttgtatttttagtagagatggggtttcatcaagttgaccaggctggtcttgaactcctgacatcaagtggtccacccacctccagagaagtcttctgaagatgaaaatcttggtctttcatcacttattaaatttccttaatgtcatgcctcccaccccacactgctttcaggatagtattaaaactctttacctatcctacaagatcttttataacgtggcctttgtctacttttctagtttcttggcttctgctgcctgttgtgatgcctatactccagctttacagctacacaggaaggagccctaggtatgtacaatgttaccacacacctcacatttgtctaagtatttcacatgtatctcacatgtgtctatgctttctctctgcctacaatgctctctgccttttcagtttgcagcactctgctcaaaagtcactgccactagtcagttttgtcctgataattccctttcaccctatcaaagccttgtttacgtgccattccatgctaccttgtgagtttctcaagtcataaccaagaacttaagtactcatgtaagtgtccttcctacccatgcctaaactgtaaaagtgaaaatcatcacaaatatgcaatatataaacaaaataaacacatacatttagtcaatgctatgaaaattaagtatgtgatcaaatgttttgaagagtgaaaatggggcttttgtattaaggggaagatgaggaaatgaattgatgaagtgtagcctgaactgatttcttcaaatgcttctccagaaaagcaaaaagaggaataataaaaaaaaagatcaatgaattctggttcatttaacatacatactatattattaagacaaacacaggatcagtgaaaataaaatatattttagactaaaatgctggtagaaaaaccaaaaaggaaggagtatgaaagacataagttacccttcctaggctccattttcagatatttttgattgtttaaacttcagcaattcatgaatgttatagtaaatgatttgaaaaatggggagataaaagtaattctttcctcgttccaataatccccattcaagtaacaaaacagcttaatacaaaatatgtaaatttatttttaatttttttctgatgacttatcctaaaaatctacaaaatatgtaaatgaacttttaaaattagtataggaactcttacaatagtacagcagctccttaaatgcaatgcttgggtttatgggaaacaaaaaacactctgtcaattgctcccactgttttcatttacctcctggaaaatcataactatacatccagagaagaaagacctggagagagacaataccttggtgaaacatatggctacgaaatacaggaacagaatagtataatcaccttaattttaaagggaaattctcctgaaacagaattcccatagtaaaaggaaaaaaaattgaggaatttaaaataaggtaatccatgtgaacagtgctttgtaaactgcaaaactgtcagcaaataataaggtatgattgttattttctttaaaataagatacagaatagcattttgcctatactatttgcagccaagggaagatcctatccttttaaaacatataaaactaatgctttttaacccaaacaaaaagacacacatacgttgccagaacttggtctcaagcaagactatatttttctaagttctttaataaataaagagccatttggtcattcaatactgatttgtctttatatatttgttaattatttgttcctttatgtatgcattcatcacaaacttttttataatctcttatataactgagattgagttaggatgtatacaaaatcaaagctaaaaaagaagtaataaacattctgtaagtaaattacataattgagtattcacatgcctttggaatctatgctttcacgatagactccacttattgaatgcatcactaattaaaaggaaaaactaaaaaagaaaattttcatagctcccagtggccttgtgagttatggtaaagattttggtcttcaacctcagtgcaatgggaatccactgaaaggtttaaagcagggaagtgacaccgtctaatctgggcttgaaaacattagtcatgttgctaattggagagtagattggaggggagggcaaaaaagatgcagaaaaacagagtaagatgttagcataggagtccaggcacagcctgatggtgggtggtagatggaaagataagaaaagattagtaagatttagaagataaaatgtacaggactttgcccaagttcttccctctgcctagaatgcatcatctggtacatggcaggtgcttcatgaatgcttttgatgggaaatgaacagggttataaaaacctcacaattttttaaggggtcttaggagtcttggccctgccatacttttctctcttgcaggaaaaagatgaaactaatggactgtgaccactgcttttcagcaaagtacacctaggtcactgtgcttcttccacaatacaggctgcatgtcgtgtctgaaaatcattttgcttaaagctgctttgttgggaaatattacttgcttggcttttctagcttgactttgagttatttgagataaataagtaagagagaaagttgaccctttctctatcatagtctaaaaaataaaggttgctgttggaaatcaacacggacccacaatttcttgttgaatgtggaattataattatccctcatgatgaaatgtaatatagacagtttgccatatggaatagatgaaataggtgagaggccagagctgtcagtttgagagctgtcattcatatagtgatgaataactgaagccatgagggtaaagaacaagggcaaagccttgggaatggtctgaagaggcagatcaaatgcatgaaattgaaataagacattcaggaaaggttatattattcttactttcaaggcagaagctctggagataaagcatgacaggtggtcctttgacgaagcaaagtgaacctcttgggtggtcactgatactttaccaaagtgattaggacatggctgacaagagattggatgtaaagaaaatgatagaaatgcttgtagagtttattttagctgttaaaaaaaaaaaaaaaagcaaaaccagacaggaaacttaaggaatatgagctacctcattgtggaagcaaagactcagaagaagtagagaacaagaaagtaggaggttgagtaaaatatcaggtagccaagttagtcaacaaaagtggaagatttccacttaaaatttacaaaaaaaaaatgctaaaagttagaattttggaaaacgactgaacttgaagattgtacatattagccaggcagttactctaaactcatactcttatataattattaaaaggagctcctttactaattaaatctctaacctgattttcttttttccaaatcctgccatctttttttgcttttctatcatttccacaaaaaccactcctctcctctctttcataatctctgagtttatcaacatttttttttggttacgtcagactctagttttcctatattccacggtccatttgaaagcactaacttattacatgtaactagtgccaatggaaaattccagctagcaataaacgcatctatgttagtcactgtaggcagaactaatgttggctccaatgataagaatgctcctatggttttctcttggctggcaagcagttgctatattgctcctgaaaattagaaagagttgtgctgtgaagcagtagaaattacatacactgactaatacgttagctgcaaatttctatatggattctttcaatctgaatacagtttgggtaatagctttgtccttaggtatttttgtacacacagataaagtatgttaaattttcttgagacaggcattagcaagaggttcagaacagaattagcatagttgtgttccaaaacaaaagatagctgatataaacttgccatgctgccagttccaatggtattactgaccttttaatctcgttgtttttttttaaatctttttattttttctctgctaaatctctgcctcttgctgtttaataagctaaccgttatttggaacctaatgaaaggatttttttccctcagtctaaaccttcctaaatagcctcttcattattctatttactttgaacattaaaaaaaccaaagctgaaatagctaatatgagatgttcatgaaaatctccattcagggcgtcatcatcctaattggtttataacctgctgtgctgaatagttcttccactcatcctcattttgttttgttttttaacttaaaaatgaaaagttctaccaaatatcacatgttctcacttacttataagtgggagctaagcactgagcacacatggacataaatacgggaacaatagaccctggggactactagagggaggagggaggggagtgggttaaaaaaacgacctatcagttactatgctcactaacatggcgatgggatccgtactccaaacctcagcatcatgcaatactcccacgtgacaaatctgcacatgcaccttctgtatctaaaagttgaaattaaaaaaaagaaaacttctgtgttgtgaaaaggaaccaacaatgagagaaggatataggattttaaaacatagcttcaacaatgaccccagaaacctcagaggcctttatctaactgtctgactggagaaaattatctacaaggtaccacgtgtttgcaagctttcagttcaccttttaatagccacaatggaactatgaattaaggacactaagcccgaatctccctttaattctatgtggaaggaaaagtaaagaaataaacaatgattgaaaaaaaagacttacataaaagtagatggtaaaaataaaataaaggtcaagaaggtaataaataaatcatatttcctgaatgttgttctaaattgtgttcaaatttatatgttccagacagtagaaacaaaaagcaaatccttaatgatttataaatatgtaaaagcattccatcatttgtgttattactaaaaatagatgtttatatttcagctatcctgaaaaaattagaataatattaagtaggtatatttgcacattgcctttgaaacaccagagctctattttaaaaatgtacttaatttttttctaccctaaacttactgaatcagagtcttttggctcttgaactattgcatgcattctcaacagataatgacaccccaagggagtgaaaatttgttcttgagagataaaaattcttagctatttctgagtcacaatggtttattaccctctgaaagccacaatatacgggcagatctaaagcatgtctgtggtattaaaacacggatggatataaaaggaaaaaaatcaagttcacctcaatttcatgagtgataactgcaaaccactttgatgtatttccttccagttataatttcttttgctggttttctctgttttttacaaaattaggatcctatggcataaataattccatatcctactttttttcctgagcattaatgttgtaataattccctatatcattaaatactatttgaaactacttccattaaacattttaatattcagtggtaagtataaatcaatctataataaactttctccaaaaattaatgttttaatagtattagtattataaaatgcattttagattattaatcactttccagtgataaataaccaaattacaatcttaaatgatagacactaaagtgtttagtgaccaaatttcttactcagtttccatccctgttcaaacaatgccattttatcttctgctttctctctctgctttctttcttgctcttgctctctttcttttgagaagacttttgaaatcaaactttctagaatgtctgcatatgagctagattcctacttttgcagttctaaagagagtaaaatcggctgggcgtggtggctcacacctgtaatcccagctctttgggggaacaaggcagacagatcacttgaattcaggagttcaggaccagcctgaccaacatggtgaagtcccatctctactaaaaatacaaaaattagctgggcatggtggtacatgtctgtagtctcagctactcaggaggctgaggcaggagaatcactcgaaacaggaggtggaggttgcagtgagccgagattgagccactacactctagcctgggtgacagagtgagactctgactcaatcaatcaatcaatcaatcaatcgagtcaaatcaagaaaagagtgcagagtacaaagagtttgagactaagctctaagaactgggtctttaacgaagctgtaccttttattttcacttaattttcaattgattcctttgttgcattgtttatatggcaataatgcttgttcttacacataattaccattttaatttaatctagaaaaaataataatagaatgagaaagaagataaataaaaattttttctttatctgggtcaggaattggttgttattgtacagctctctctctctctctctctctctctgtctgtgtgtgtgtgtgtgtgtgtgtgtgtgtgtggtgtgtcagagagaaatatttgcgtttggggtccttatttcatttaagtttattatgctattttcaattaatagcaagttctttacatttttaaactatattttaagagtgcacatatttcttaagagttctaaatggcatatttctatttctatgtatacatatatgtttctattatatatgtctacttctatgtctatgcacttatctgtatctatctctatctctactttgatatctctttaagtctctctttttatgtacaagttcctagaggctctaagtcctaacattccagaaatttcaaagaaactagaaagaaagattttcttctgcaattacaataggataaaagagattgtggatagtaatagctatctgcaaaaataaactggctgagcctcagatagcctggggagcttgttataaatacagattcccaaggccttcttatatccctattatgtcagaatttcttatgttggaagcaagatgtccgggaatggccagtaatactagaaatctttgtgggaaatgtcgttttgaaagggttttggggatgaagtaacccagatgaatctgggggtaacaggtagcaatgtcattaacataaagctaccaactattaacttatactaacatatctgagttttatattgttctgtgacagataataggagagtgaaggtaaagctgtatatctgtatatggtggtggttgggggaaaacctcttgcagggaatctaaaaggaagccagggagcaaacatgtgctattatgttttttgtaccatctgagatgaattgtctgtttctctgtttctattaatatttttaaggtcatctagaatagtaaagatgggtagtttatgtagcttttctcacttaaggaagcatcctttcataatgctttattacccttctcccaattctatcactttgaacaataatctatcatttggtcttctggatagtcctcactggggaggacaccccgaacacattaccattattgattttcctgccagtcttgttgtaaaataatagtttgaattattatttcttctttcaaatggtttataaaccagtgccttgtgagtttgtgtagcatgaatcagtctcccagagcctgatcatctctaggtaaactactaaaatttagttgttggctatgcaaaactgaggattggacattaaatctacgacaactctgctatatgatatgaactctatcaatgacctctttatgcagtccttcctgaaatgatttatatcatcattttttaaaaataatcattaacctgaagaaagagtatattaagatattccaaatccatgagatacatagcactttttccttgattttacccatattctaaacattcaatattaacaggcattaagaatcaagaactctttgactattgataggtcatactcaatataaaatactgtttgattggctccagaccaaaaaaaaaaaggttttgtaaaattgtgcccttttcatgtctttataaagttcctagagtttatttctgttattctcaaaatgtttcctcaggagaatttagtaatatttagatccacttaaaacaatcactagttaagtacaaattagcttccaaaatcaatctgaaaacatgctgaaaacatacatctgctaaaagatggttttctcttttatgtaccccctcccatctaaaagttattaaggaagagtctgttgctatggaaacactcgatttgacaccatctgtattcaaaattcaattgctgcaagccttcagccaatctccggtttttaattggcaagaccttcccagtatgctctacaaatctttttttttattttttatttttaggaagtcaatctatacagcatattgcaatgtaaagcatcaagaaagttcacaatgcaagcctcattccattatcttaaaatcagacttgtgaagtttcaaagcattacagccttctgataattacttggcatgaggttaatgcctaaaatttattgccaagtttttttttttgcctattggatttcacacgtaaagaaaatactcattgtaagagtgactttagtattaggaagaccctgaaaaagagccttagtgaggaacttatatcacaatacacagtttagaatggaaaacaaatatagaaatcagagttaagaatgcaattttggaatagtcagactgaagttcaatattatttggaatacttgttagctactttatgtaacctttctacatcttcttttcctcatctgtaagagatctattatgaggattttaaagtacgcattttggggactacacatacttatacatatatagtatatacatatactataacggcatttgaaaatctgttaatccacatggtcttgaagcatatttctccagaatatcaagtatctgtatataagtgttgctaaaattcatagaagagaggattacaaaaaactggaattctctgaataattatttttaaataagggaaggatatgactggatattaaagaaatgtaaatatgcttctggcaggaaaatgccaaaaaaatgtatgcacagttgtgggtccaatcacgacattttgatgggatagagaagtaattcgccacaattgagcactgctgtggtttcttgggaggctctgtcaacctactaagttatagttatcctatgggaacagaccccatagctaaagataattagaatgttgccctctggagttctgcaatgtagcaagcttgctttaccataccactgtcctactgaacagccagcctctttgataatccttaagaggtaacattccaactacactgcttattgctccaggttaccacacactttgaaaagctcatgtctttgttaattttatttaatatatttttaatttattcacttaatctagtgaatgatgtaatgattgtaatattttcgttcagtgatgactgtaatattttggttccactaaaaaactgactacattaccttcatgtgtatcctgatatgaatccctttatagtcttcctttccttttttcttaaattcataaaatgtataaattgatgaataatcaggacttatgctgtgtaagaataaagacaactttatctgcctttggttctccctttaaatctgttcaagtaggttgttctgttctgttcttgggtgaaaatatgggtaagtttcatgtcttttctggtcatcattaaggaaacaaagtcctgctccatatcgagacattaaaattagaatatccagctcaatatattaatcaatacttcaatctgaactcacatatatgatttcttcctcaattagaagaggatggaagtggacaggtcctttactacctggggtagtgggcatggtgggcttcctctttctgtcttgctagtcttctctaccattcaccagctgctatttctcaccctaacaagggttaatgggagtggaagaagaagaaggggtgcagaaaattcttacttcactcagtactgtcactgttagagtgtgactttgtgctttctaatgtcaaatatcacttctggggtttcacggagctgaaatgtatttctcccagttttaagatccagcctctgatctacttcttctatgatatgttccacaattacttcagtagacagtcagtcaacacaaactcatctgaacctactttgtgccaaacactgatctaggttctggaaaatctatgatgaaacaagacacagtccctgctctcatgcagccaaatatttttctcctttgtactttcatttttctttgcttgtacctctaatttatgctttatatccaagttattgttggtacacatttgtctttccctagattatcaacttctttagaaaatgattaacattttactcacttttataaatcccttttccaatggtcactaaagtattattaaatgaagtaatgaacaatgaataaacggatggatgtacagagcgataaatggataaatgaacaaaattataccttcatacattgttcataaaatattgtttatattactcctatgacacatatatcctatctaatattatactaattttactttttctacctaataataaacactgtaatgaaagaggctgtatcatggtttccttggaacaccacataattcctagccccaataccttgcacactgtaagcacataatcaacatttgatgaatgtgtgaatatacttttcagtattttaaacttatatttttccttcacataatttaaatactaatgcaaattattaagtataaaaattagggcaagttgcaaatataattcagtcacagcctccgggaaatgaataaaataatctcactctaggttgatttctttgtgtaaattagatccttactaaatatttgcagacttacacatttataaaaaaaagtcatcagtctcatctattctgtctctattagaaaagggtcaatctatgtttaatttgctgccataagcttgaaggtgaaaatttatttaggaagcatttgatgactgttttctaggtactgttcttaatctaggtatgttaagggatggtgcctatccttaagttgctcacaacttatatgagagataaatttggaatattcactgctgtacatattgaaggatttattatatttataattaaattctaccaaatcacatatggacataatttaatcttcttgtgttattagcacagtgcactgatatactgaagaatctaatttttcaatgaaataaggatctgtccaatttagcatactaaaatagaataacaattttattaattttcatttcaaatcagcattattatattatcttaagattccctttatttgtattccttaaggatgccaattctggttttacaaaatcaactttatattcaatacttttttgtctgaactagacaactgtatacatatgccaagtattttagaggatgaaattttcaattggaaatctgactcctatactcatgatgaagactgttacataatttctatgtcaaaaacatatttaaagtttacctgttttgaatggccatatagcttgttgacgtatatatttagaatcaggacacaaaaataatgaaatgatacaattaaatcaaaatgtaaacaaaatattatcaatattattaaattaaggaactccgaagtgccctatcgtagattttggtacttactgatgcaaagtattatggacagcctggttaagtcctaaaatttgtaaaattcgttacctacttaatgaagtgtaaagtcaatgaatgtgctgctttagtgatcacaacacattctgttagttgccacatgttgatatttattctacttctcctagggacaacaggttacttagtcaaacactttatatgtaacaggttacttagtcatacactttgtttatataatgcaaattctcattcccattttgtcttaagttataacataacattttaatgagttctctgtaccctctcaaaaaacatcatggtaataagaaaaagaaagttttattaaaaaaccctaatccaaattcctgctttcaagattgggggttggtggggggggagctgcgaaactgaacttcttaagattaagagctggccgggcgcggtggctcacgcctgtaatcccagcactttgggaggccgagacgggcggatcacgaggtcaggagatcgagaccatcctggctaacacggtgaaaccccgtctctactaaaaatacaaaaattagccgggcatggtggcgcgcgcctgtagtcccagctacacgggaggctgaggcaggagaatggcgtgaacccgggaggcggagcttgcagtgagccgagatcccgccactgcactccagcctgggcgacagagcgaaactccgtctcaaaaaaaaaaaaaaaaaaaaattaagagctttctatatacatttcatttccattttgctcaaatcagcagatcctccaaaagtaaactgaggaacatttcaaatggcctagtatgttgtattctgcaaggatgaggtatgtgaactggaatcagaccaaggtgcttttaaaatctgttatatgtttatgagagattgtactaaaaggactctcaatcccttaagactgaaaattcactacccattgcaaagtctgggtctgtttgctttgggtttcttctggctttttgtttgcttttcaaacaaggcgttttattaacctctttagggtaattccagtgatgactcatggtcatggagatgatgatggcagcttgtagcctacactagctgccagctcccctgcgagacagtccaatcaatcagtaagtatttatggcattcccgttattttcagaacaagatgttagaattaaaataattcaaatataaaggagtaaccgtttgatgcttactgtccatcagggaggcgaaacatatactacatggagaatgtcctcagagagacacaacaacgttgaaattcctaatctatggcatttgtaacttacagatgtggcaacatgagaaagcaacttgccctcccatctccgtatctctagctgaaccaccagttctcccacttttcctactcgaatggtgtttattttttaaaaacatgtgttagcggccaggagccgtggctcacgcctgtaatcccagcactttgggaggccgaggcgggtggatcacctgaggttgggagctcgagaccagcctgaccaacatggagaaactctgtctctactaaaaatacaaaattagccgggcatggtggcacgtgtctgtaatcccagctactcagatggctgaggcaggagaatcgcttgaacccaggaggcggaggttgctgtgagccaagatcgcaccattgcactccagcctgggcaacaagagcaaaactccatctcaacaaaacaaaacaaaacaaaacaaaacaaacaaaaacaaaacatatgttagccttttatctttctaaaacgggctaaacattattttgcttaaaggcatagaaattaatgcctctgagaaattttaagtcccatgagtcaataaatacccaatatgtttgaacttaattgaaataaactatcacaaattgatagtttatatatcagtcgtatatataaaattgacatataagcatgtactttataactatctacatgcatgagtatataagaatacacacacacacacacacacacacacacacatatatatatatatatacacatatatttaaactttcaataactgactccaaatgtagcctcctttcagcataggtttggggaaagaatacccatctaacacctatttttagaatcagaggagttggattaaatcctggttccgctatctgtgtgatcttatgcaaaatattaatatctttgatagttggttctctcatttacttaataaggacaatatctaccatagggactgttgtgaaaataaaatccacttatatatgtataagagttcctcatccaattcgtataaagcacagcacaaatctaaagtattactcttttatgagatactttaaaatctgaataaagttagattttatttgtcccataaagaagtgaaaattttgacagtttcaaattgtctgaaatgtttcatattctggagttccctggaacatgtttttagttaccaaaataccaagctactgaagggaaacgtgggcattttggttgccctgccagacattaagaaaaaaatgaatcccattctatttattgctatgtctcttaaagtacgtttggcatggtacccaacattgagagacacataacctgctgtcctaaaactctgagcaatttacaaattcttgtaatcatagaaagaattccccattttacatcccaaaaggactgtgccttctcctcttagtggctcctacaagggattagactaaaccaaatccttcatgaggaacaggtaaagtgccattgctttaaaatgccaacgtgagcctatatattcctgtgctgttcatattaccttatcgttctgcacaattacacttgatgttcacattttcaggttgactgggttttatcacttcatggcacacttttctgtttaattacagagaaaggtgttttcccctcattcttattctgtgcatttgagacttgattttatcttttcaaacattctgttgtttgaacagacaattttctgataacaagtgaatcaaggactccctgcctttcctttcctcgaccagttctacgtttttctgagagccagctgtggcccagggcaacagttccatggttcctgtatgaaagagaaaaatctgactccaattgtcaggcttattgtatctaccactgccttgtatcctttgtaggggacccccaatggctttactcctatgacccagggttagacttagagatggtaataagccaaaccatgcagtaattggaaacactgaaaatagaaaattctgtatacattttgctttatcttaatattgaaagaaaatatcagagcatttcatttattcattcagagaatcttgatggaaaacctatttttttcaaggccctcgactggaatttaagagaagcaacactgtcaggaaagacaaatttctcgagcaagttctaaaaattctgtgcatagacattagaacagttaccaatattcgtgcacccattttctagatgtgaaaatttttttactcttatagctagcagggcactatcattgtcaacccttgagaaggcctagtggaactctcaataatgaggatagttgattgttatggactgaatgctggcatcccccccgccggctaaaatttgtatgttgaagtgctaacccccaatggatatttggaggtggggcctttgagaaataataagggttagatgaggtcataggttgaggcctccataattggattagtgtccttttaagaagagcaagaagagagactagagtacctctctgcaccacctctctccccaacatacgaggatacagcaagaagaaggttctcaccaggaaccacatctgtcagcaccatgatcttgtacttctcaacctccagaaccgtgaaaaacaactgcctgttgtttaagccacccagtctatggcattattttatagcagcctgagcttactaagacattaatatttgtatagtgagtagccatttgaaaaggacttttccatgcgtcatttcattgaatcctaacaccaaactagtatggaagttatcaggatcccagttttacagatgagaaaattaactgttggagagattaaataatttgccatgggtcccactgtcactaagggggcagagccagtgcttggaccaagtgctcttattttagattcagtgctgttactactatattactaaagaaataaaggccaaagaatctccaggataaaggtagaacctgtcaaacggataaaccaacatcagcaaccatttgtttcctgacttctagttttatatgagaaaaaagctcctgtttgttttagccactgaagtaatatagtttattaccttcaactaacaagagtcctaatggttacccctcagtccagtctttttgtgtaatcaggtagatagtatagctttcctctaatccagaaatcaagaatggggattaaggaaattaaggaatgaaattaaagaaggacattcttatgtatttatctcactaacataaaagtaataatcgcaattgctttcatcaccattgttataattatctcataaccaactattagcttcctaggtctttttgttaggcctccaaaattcaaaagctttctttacaatacccatattttccatgtggagccaggctgagtggacctgagataattatcatcatgtcccggagctataaagttttggtgggttcttgtttctttcaagaaacaaaaacacatgttattctgcacgtgtttcctgtacacatgtaggataaaggacatgtacaagtagtctgcaacttttagggcaaagagtatgattgacatttgtgggagtgtctaatggggatattcaaagcaacatgggatcatgtttcagaaaactcagggcaaaactcataggttgcttgtcctggggtaagccagccaccacatcataagaacactcaagtagtcccatggaggaactcgtttagagggaaaccaactagacagcaccaactcacaagctatacaagtaactcactgtgaaagtgaatccttcagccccagtcaagccatcatatgactgcagcctaattgacatctgagtgcaacatcatgagtgatcgtgagacagaacccctcaaccaagcaatgcatgaatcctgacctacagaacctatgagtgataataaatgattattgctactttaggacactaagtttggggtgattgttttacagtaacaggtaactattcaaactctttcctgacaaaagtagaacaagctcggctttccccttttcatgtagaaaggtcacaatctattaatccttcctacttactttataaatgttttacttaagacaagtacaacagaataaagacaggtggcaagcaattttcaaatcatgtataagtaaattttggtaaagaaagaagtagtaggtacaaaataataatccctacaattttctataacttgagagctgagagcattttttaggaacagtccatggcacgtgtttaacccttggcttagttttatctaaaatgcatgatgccatcagggagtaatattcctatttatgcccacaggtaccaaaatataacagaaattcaagactttagttacaatgaccctgtaggtcataagataaaaatgctagcctataaacatgtagagtatctctttctgggctcatctctgtttgtatttgtcttattagctcactttgtctgagtataaaattctttaatatatttactcataatcatctttatcacaaaaaaggaagaaaaactattttctttaattggtttatttatttaatagttttgtttattatgtttaattttcaaggtggatgaataaaacatttgttaacccagatctttccccttaaaaagaaacataatgaagacaaaaacaattagtagaaaacactatttatgttcataattatggtacatcactttaataaaaaatatttttcctattataaactcacttgaaagatttataattaaatataatcgcaacaggtaatttggattttaaatcctattcaaatatgttttgatattaatcctcttaatttaaaaatgaaatacatttatgaaaaatggaaaacattcatttcatgataggtaattagtattaatttaacacaacgtataggaagaaaaaacatacttgttttttatatatcagtttttatatacaagttacaattactctgatagaactctgaaattcattaagatattaaagaccatttctattatttaacgtatatttccaggtaccttattaactaggtactactaaaaaaataaaagaaccacgagatttatatgtgaagaaacacatgacattatgaacctcatgatgatggctgatgatggtaaattttatgtgttaacttggctgggctatggttcccagttgtttggtcaaacaccaatctagatgttgctgtgaaggtattttttagatgtgattaacatttcaatcagcagactttgagtaaagcagattaccctccacaatgtgggtgggccttctccaatcaattttgaagtccttaagagaaaagactgaagtccccagaaaaggaaggaattctgctatcggattacctttggactcaagattgcaacatcaactcttcccttggtctccatcctgccaggcttttggattttacagatttttgacttttcagctcccacaatcatatgagttaatggcttaaaatcaatctctctctctctctctctctctctctctgtatgtgtgtatatatataatattattatatatattagtattattaccaatctctctctctctctcactctctctctctctctctctctctctctctctctatatatatatatatatatatatatatctcctaattattagatacaacagaagatagatggaaagagacagcagcattctaaactctaatgataatggtgaattgataatacaggtgaaatattggactgtgagttttcagatgatgaaaacctagataaatgttctcaggcccaaggactgattaatgcacaatatatttctaatgacagaaaggaaatatgatattttaatccacttaattattcaacaggaagaacttcaccacataatattagctgtaagaattttaacaatcctgttttgctaaaggatgtgtgacagatattatgtcatttatgatgtttgtgcaccaaaatttatttgatacaaaaagtaagttgtatttcttttttattatttatttatttatttatttacgatggagtttcactcttgttgcccaggttagagtgcaatggcgtgatctcggctcagtgcaacctccgcctcccgggttcaagcaattctcctgcctcagcctcccgagtagctgggattacaggtgcccgccaccatgcctggctaatttttttgtatttttagtagagatggggcttcaccatgttagccaggctggtttcgaactcctgacctcaggtgatccatcgcttcagcctcccaaagtgctggaattacaggagtgagccactgtgcccagcctgtatttcaattcttattaaaatttctcataagattgtctttcactatctctttatacttccataagaatttgtagagtaacttagacatatacaaaataaaaagctaaagggttcattagacctacaaggcaaacagtaatggctaatttccctggtatactgagggctgcatcagaaacctggtctacctaaacacaacaatctttaatcctcagctaaagagtttctatactttattcatggtatcattaagaaccaggatgaaacttatgttacttgaatggttgtacagcagcagaaaaaggaaaccatacagtgtagcatctataaattcattatttaggctgggcgcggtggctcaggtctgtaatcccagcactttgggaggccgaggcgggtggatcacctgaagtcaagagtttgagaccagcctggccaacatgacgaaaccccgtccctactaaaaatacaaaaaaattagctgggcatgatggtgggagcctgtaatgccagctactcggtaggctgaggcaagagaatagcttgaatctgggaggcggagttgcagtgagcaaagatggcaccactgcactccagcctgggcaatggagcaggactctgtctcaaaaaaaaaattattattcagtgtgtgtctaaatgcttctatattgtaagttggcagggttgggggttgtgtggggggtgggtggtgctacctcttctcaaattccttaaatgtaaaccaacttctaggctttttcctaggttcacttttctttgcaccaggtaccctctctctgtgcaagctcagacattccaggtaacttttgaattcttgtccaaaagtaacatcactcctgcaatctctatgttttcaaccatttctttaaaatctcagtatggtcatctagcttcatgttaagcacattactttgtctcccataatcaactccttatcctgagtttgtctctggttatgacattaatcttccaaagaattcaatctccaactcttagaggcaggccttctcttagattgacagttttatatatgcaatcaatgtcaaaatcctgttaattctagctccaccttatgtctcaatttcacttctttctttttactccatggtcactgctccagcttgggctctcttgccttctaactggtcttactgacttcatttactcccttatcctccacaacacacacacacacacacacacacacacacacacacacacacacactcccatgctgatattcgtcttccaccccactgttaacaggtctaattatgtattctcctgtcatcaattcctgaaatacccttccctctccagcttccttctgcttttcaaagtcttattcatgaccaggtcaaattcagcctcctcctggaagcattccactaagccctcatttaaaactcctcctctagttttctctcaacattttgtaatactgctctactgaagcacctatcctaaactgccttgcctaaatatacttgtccaaatacccacatttgattgtgagctctttaaagacaaaggctgaatcttacttttttcctgtatcccctctaccatctctgatattagatagcacagagtaggcattcaaacgttcgctgaactgaactgaactctttggttgccagcggcatcctagtggatgtgaattttgagagctgcttgtagctataacaggttgacagcaggtgctagatgtcaaaagaaggaaatttatatggttgactccacttcttctaaaataagcaaccatctaatagacaatacctgagaggaagatactggctggcatttcattagcaacagagatttcatacaaatgtggagaacaacagagcctttttatttcgccatgaaggatttcatagatttggttgcagcaatgaatgatgggttgacaaagctgctataaaactgtcagttaattcaaaaatcgtgtgagagatgtttttttttattctcatacagaagaacattctccccttctatggccctgtataccagttctttatgcaatataatgtgaattccttttcttaaaatttataagctatcactaaatttctctaagaattctggactgggttgaaaaatccttagctgaaaaaataattccaaaataaacgactccctcttaaaacttggaattctgtttcagaagtccttcccttggtttagctaataaaaggccacattatacacccttcatattctcccatctccagttctctctgtaccaaatccatctcaccataacaatatgtaccatttaatgagcatctaatatgtgccacatatttactttagaaacaccaattattttactttcttaatcaccctaccagcataagtactattattagccccacatgacagatgagagaaccacagtttaggaaagagaattaacttggctaaggttacacagctaatagatcattggggtccactagtctgtacatctccaacacatgtaaaagacaatcctttgattagacactcaaatacacagaagtcaaaagtataaacaggagcagcaaaaatgtatatccagactataattacctgaggttagtcctaatattttaagttgtcagataaatataccttcctatttttctgactaaccagccttttccatttgatgtgcctcgggctttaaaatcatatagacgtgggcttgaattctacttcctcacttgtcatcttcctaagaccctagacaagttacgttagctctccgagtctcggttttctgtctctaaaatgggagtagtaattttatctacctattaaatttatagataataaaaattttgcagtatttcccacaaaaggctttcctgaatatttgtttaattctatttatagatcttattccatcttttccaagcaaccttctcctgtcggtcttttaaatctctccttttggggtggtggtggggggcgaaataactaaacagctaccaaaaagctcattaagtattttgcattaagccttcaaagcaccccaatagattataattaaaataacaaatgctaacattcattcagcttttactatggccctgatctaagggctctacattaattatttcatctaatcctcccaacccatgagatagttataagtgagcctattttacagagaaggaaactaagagcagatagtttactgagattagtcatttgctcaaggccacaaagctaacaagtggccagtctaggcagcctgccttttaaagtaatgcatgctattgctgtatagccccgaaatggtagtggtgggggttacggagggagaagctacagaaacaaggctcttaaatccaaatgttacaggaacgacattcaccaatattgtttgtgaaataaacagaatgataaaaggaagcagttttatctttccaaatcctcttcactgctatgcaaggtattatggtattatgccttgcagtattaacagacacgaacaagagtttcatgtaattcagacgcctccaaggaagaaaatttaaattcttctaatcttatctgcttttggtcccctgacccagcccttttgcagaagaaaatggccaggaatgattgacaaattcagacaccaaagagttaaagaaaaatgagcaattcgaatattagaaagagggagaatttttcatttgatctgatttagacaaaatttactctcttacctagattattactgcatgatttccatcaatataattacctgaatacaacagataccacggtaatagtttcatatagtaaaacatggtggtggcttgcacacccaattacttgaagtttaacatgaatatttctagtagacataaatagctttgtactgaacttttctcttgatagactgcaataactatgtatagattttcccaactgttcaaagttatgaaatgggatttaccagagaaagaaaaatgtttcaatatagtattacatacatatattaactattttttctttatttagctgatttctttttgagcatttctagaagtttcatggcaataaaaaggaagaccaaaatcatcaaatgagaaaatacaattttatgagcaagtattttatttctgtccttttcctgaaaaccaaatctttactaagaaaaattctattttgaacacgatcgaaaagtttatgagtattgaatttccatcccattttatagatttcaaagggagagataaactgaagtgtagcagggctgcaaatgacattgtttagataaacatatcttgtcagaattatcctggtaccatttagaggctccaggcatatttggaactaagattccagcttagactcttaataagcgctatgacacatctcgacagacacttgcttttaagaaaatgctttcttggaccatttggattacagcctttccactaggctgcaaatattcataaaggtattcattcctaaaagacaaaagcttagaaaagaagaactattcaaatcactgaatattggcagagagatacaaacttgccctccggtcattcaattttaatctctatcatgaaaaagtcaatgcaatatgaaaaaaaaatgcaggggataatggaaaatgttcagacaatgttgaacaaatactgtataatacattcatattgtcttcctcttagggaaaaaattgaagtgatttttcattagtaaaataacaaatgactctctgtatagtatgttcagatttgcataaacctcactgccaaatttccatatttctcaggcaagaaactgatcacttacctgtgtaatgggaattcagtctcatattgagtaaatcactcactaagattcactcttttgggtcagtgtgttgcaacttgttggagaaccctcaaggttccagtatggtggaggaatgctctgctaaatcaattgtatggctatcttaccaaatctgttcctcttcctaggctcaacagtgtacactatttccctaattccctcgcagttaggtgtgaccatgtgacaagatccatccaacagaatatgaacaaaattaacacacaccatttccaggcgtggctcatgacaaattttcatgagtaatactcattcttcatctgcccattaaatgcatatgagtcttatgctctggacacaaaagatggaaggagcttgggttcctgaatgacttcatagagggctgcttattttggactgcactaaaataagaagtaaatttctgctgtagtaagcctccaagatttgggagattacctgttatagtggctagtgttactgaaataatacattagcatacatccacattcattgtttaagcaacaataaagagttaaactttcaaaaccaagaacagcctattttaattagcaatcactacaactgaaagaagacatgtctttaggaagtgaatcaaaacatacataatttcagacaaaagaagtatttagtcttagtacaatgattaaggtcattaacaaaagcaacaaaacaagatgggaaatggtaaacatactagaaagagcgcagattttcaagtcagaaagagacatttacaaattccaagctctgttctttgcttgtttgtaaacgacgcagtctcgctctgtcgcccaggctggagtgcagtggcgcaatctcggctcactgcaagctccgcctcccgggttcacgccattctcctgcctcagcctcccaagtagctgggactacaggcgcccgccaccacgcccggctaatttttttttgtatttttagtagagacggggtttcaccgtgttagccaggatggtctcgatctcctgacctcgtgatccgcccgcctcggcctccccaagtgctgggattacaggcgtgagccaccgcgcccggccgagtaactgttcttggaacctgttttctcgtctataaaatggggattataaaatatagctcacaagattctgtaaagattttgtacacacacacagaaacacacagaaacacacacatgtgcacacaccatctaatgcttatgaggtactgaataaatactagctattatcaataagtacttacccaatatgtggaagtatgactaataatattttaaaatattaaccttttactctggttactctttcactttccccaacatattgacaactagtcatttccttagggaagggttaacatagcagaatataaattatgaagatatagactctcatggtttccgagtttgaaaagtctaagcctggtaaaagacaaaagatttcaaagagaaaaaaaaagatggctgaaaggttttcctccttcctgcactacaaaggattcttcgggttgtgggaaggaaaatgaggggatattgcagaggaagcaagaaaattcaataccagtgtgtgtccctggagggaaggaaggtagagagaagtgaagaaaccgagagagatctgagagaacctgaaagcagagctgacttggacctcatttctgaggagaatctctgagggaaaccgggtggcgagtttcccctactccttcgtctgtcactcttcctgaccccatggaaactcactgacacaacacacaatcactgcgaatcactctccccattaaatggataggagtgtatgtcagaagaaaagaatatgcacagcgtctagtcagatgggtcttaccaaagttcctgcccaccctactacggcataaggtacagtacgatgatttttgatattacaaaatgggggcatcaaagtagcggagagatatccagatctgaaagtcactgcacatgggaatgaaagatggcccaggaagaagccactgcctgcttggaccaacagccaaggatatgagggagagactggcatctccatggatgccagcccagatgacaactaaagaacaaatgttctgccacaaatgttctgccacactgtggtcaccacacccatcaatgcatgctttgcaactatataagccctgaattgatttaaaaatgtatttcttctattcaatggaattacattcatttattaaaaggtaacattatggactgaaaatctcagcacaattgttatcatttacaattatttcacattatttttataaatgtgagggggatatatgaacttaagtttttattgaaacttgtcatgcatcttgctttgtgtgtcccatgcttgttaaaaaacttacttcgatccgtaatgattgttctagcctcttgattgctggtcttgtttttcaaattttgggcagcggtaatgagttcttccaactggggacgcctctgttccaaatcctgcattgttgcctgtaagaacaaatatcccttagtatcagggttcttcagcgttgtgtattccttttacataatacaaagtaaagtacaattgtgagaccagccaaaacacttttagaaataaaaaagatgttactgtataagggtttatagaaaacaatttaacaggaaatatgtttcattcttagatatcaaaaatatttcaaatgaaaatcttgactatagattttcttcatttaaaggctcaaatggagacattccggagtacctcggattacttaaaccactgtctgaatgccttgagtaagaaatgttattctgaattacgacaatgtatttaaaagatagataactatttatacttataatatcattctgtgtgacgtcaaaattaaggtatatttattttaaaaacagaaaaagcacagaaccgatttaagagatattacttatttaacttcattgtacccctgagatttctcacctgtcaaatgaaaaggtgaagtagacgagctaaatcagcttttctcctaagctgcctgtccgtaagaatcaccaaacctttttgcctccctccagaactaatgaatatgtagtggaaagggctgcaaatcttgcattttaaataaattatctaattaacttttatgatttaggcaagtttggagagcatcagattacaggttagtattcctattcccctgtattataaatgactttaatatagcactattttaaataaaaatacaaatataataaagttaacaatttttaatttataggtagtaatgtaaatcattaagatattcttccctttcttcagtgtctattttctctgtcatcttagtctctctagatttaaggaccacaatctcagaggtatttatgaagaaatttatgaaaaaaaggcatctgactagctctggttctaaaactcagtaaattttattttaattggggaaaatacaagtaatatttactgttagtttataagcaatatgtgacagatgttttatctatattttctcatttttttcttataataaccacactagtaaacaagccagcaagtttgtataattttaaatatgatgttctaccacatgaggccaatgaagatgaagagatgaaagtggtagatagtaatgtatctgaaacttatatgaaacttagttatttactctgtactttgactcctgctgattttctaacgaattttggttttggaaaggccaaattttgatcattctgtagtgtttcttctgtgaagaggtagggagacaggctttgtgatttaaactcaattgcttttggtaatagtaaaataatgcaaaaaacttttccaaacattgtacatctactttaggcactttctcctctctgtattgaaaaattggaggggctaacttttaacaaattttccacatttgtaagctgtgattgctcagaaaaaaaatccaattttcaggtttctaacttttatggtttctttacacaacagagtgtttgaaatatggaacaaattgccaaagacagctattgaagtaagtggcataagtcagctggagagtactgaacaaattttaaagtaggaaccatatagtagcaggtagattttatgaaataagatgttttccagtgttagaatgtgaaactctggtcatctgtgacatgggaagctgaaaggttgctttggaattgcctaccctaaaatgtttgaatatgttcaatagaatttttaaaacggacttacccagaaacctcagatgaagtcaaattttcacctcaaagttaacagagaactttaaatacacagggctggcaaaatacataaattcatttactcatccattcattttaataaatatttttcagcactaggcactattctagggactatgcatgtggcagtggacaaatatattcggtatagtgtgtaactcacatgaaaaatcgtgcttttcgatacttggaaatttttatataacaaagattatctttattgggttgttcttcttttaattcactctcacataaccagattttttttgcttctcagttttagatacattattcactgtttgctatacttttttccttcttttaagatttcaaagttcatttaagaagtatgttgtaaaagtaagttgatcaactttaatctgaaccttaccaggctctaaattaaacctgaccacaatgaacagcttttattgctgaaattagcaagcatgtcaacttagactcaaaacaagccattttcctctctaatgaacaaaataggtctcagggtattgtgaaacctgttctctagttgggtgattctctaattctgctgacagacacatgctttgtaagcacctgagaagattattaatgagatcctttgaagcagcctccttaaaaatctaaggaggttcacaactgcagtacaactatgcatttctaaaatatttcaaaacaaaatttcaactttttatcccactctatggtcaacacatacaaacattcatttcaacaaagaagctgtaaaatgataatgtatattgctatgggatttatcatacactaataggctctttacttagtggtcttttagtatagcagaatgggaattttctcctttgattccctttctagaaataaagagagggatttaatatggcatacgcttcagtattttttcattaagatattataaaaacagtggttaaaagaatttcttgctaataagaacacaagcatatggtgagagtaacgattatttttcatttggtttccttttaagggtattctatttatttgctactatactttctttgacttcaacttagttttataattccagaacttctcaaataaactgaccttcacctctattccttcgagccacccacagatgagaaaacaccttagatctaatcattactcaaactacttgcctccaaaatatccatctataaaattctgttctctgcccccaatctgctacccctaccagatgttactctcccaaacatgctgttcctagtattatcttcatcctcatatgacctctggtccttttctgtttcctcaacctagctttagtcataacaaacaagtagaatgctaattgtgcttatttatttctctgatatgatcccagatatttgtgacacaaataacttaaagcgaacaaaactaaaatcattacatgcttaccagtacctaagcatgataatggatcgtgtctacatggattctatcattctagaggaaacaaaacacaggagaaggaaggaatcaatgctatttctaaggagtcataagtcagctactgggctttactaaaaactgcttaccccttggagatgagaattcatcatggattccactagctgagcaaagatggaggaaaaaaaattcttcaaatacaaagtgaatcagaagtctttaatctcactaagtccccccagagttgagtgaagtggttataaatagcaaccctatgaaataggaagttaaacagtgaaatcatacatattataactagggcattttaggcttttagacaaaattacaattttttattgtattcattaaaatagaattccacctaaataatactcaaataaaaactctatatgttgagttgaatgcttagtatttacatgtctaagaaaagactttgaaaatcaaactggtcatatttttatatttttctataaaaatcaacaatctacatagcataaatgcccatgatgatttttcaaatgttcccattttcagtaaatgaatatgaattaagctgaaatgtaacaatgtagaactgatgctattttatttacaacttcaaaaaattaatataaagaattcagaaggtaaaagagtttacggaaccattttatgtattgaagaaaataagcatagaagtcaggaaggtactaaattgtagcctttctagttaccgaaagggttttactggtgaggatgctgtaatctatctagctttcaaccatctcactgagcatcttcttctggcttctattcttgcattcggctgcctctccaaatagagtggccaaatcgaaaaccatcctcattgtcttccacttacttcctcacttctcatttccattttatactggcttggatattgatattttcctacttggtcaaccttccctacttcttttttgaatgttctactagcacctccatcggtaacttcttaagaatcttcataaccaacttcataaatatcttccaactgcagttagccttttttgttctttattcactgaataaatactttataagatgcattttatttttatataatttcaagcttgcagaatatttgcaagataaagaactcccaggtaacccttgcccggattcaccatttgttaacattttgccacattatttttaattatttatcattttatcattctctctgtgtgtatagatatataactgtatatgtaatgttttatatatatatattttttttctgaatcatttgagaataatttgcagatatcatgcccctttacccttaaatactttaggttttatttcttaatagcaaagacattctcttaaataacctcagctcagtttcaaagtcaggaaatttagcgtggctttagtaccataatcttatccatactctatattcagagtatgacaattaccccattaatgaactttatagctatatttttatttcctggtctggtccagactcacgcattgcttttagttgtcgtatctccttagtcttttttaagttgaaatagttatttgcctttctttgaactttataacacttacagttttgaccaacagaggccaggtattttgtagaatatcccccaaatttgagttatagcaattttttaagtgcttctgttgtgtcactcattgagctaggtgcaggggctgtagcagtgaaggagaaaataattcctgttctcaaagagaaaacaaacgagtagtgatgacaggcaataaaaaagcaattgcaacaacctgaggtattatggtaggggaaacatggagagttatcagagcatatggcaaagatatcacatgaaatataaaggccaaagactgtcttctgaaggaatcaagcttaagtagtcctcagcttttctttatttaaattatacaaaacagttttaaacaccactgctcctcatacccaagtggccaccatgagaatatgcaggccttctattattgggtcttaactgactgaggactcctgttactgcattttgaaatccatgattgcactgcaccaaagccaagcttctcacagacttctcctcacccaatgattgggtgtggtgggaatactaaggcagagagccttccttgggagacatgggacttctttgcctggctctgcctcaatgacttcccaacagctttgccaaaatttccttccactagaccgcacactgggatgcttctgcctagccttctctccctctctcttccttgcagagtcagaattgcatcttgatctaacatctcttgcaccttccttggcttcctccttcttttctttcacatagatatttccactaataaaatattgtcccattttatcctgtctgggtacatataacctcaggccctgactaatacactcacttttgtcctcctagaccctaaacctctcatcagctcttcagttccatgtaacgtgatggttccatgacactactacctgaatgtgtaactgtcaattattgaatattaattagtaacataggtttcttcatgcctcccatgggctggcctcttaagatgcaattcaagtaaatatgtatttttacatactacctctatttagaaatcactaaggtagggtgcatgaccattatttccaaggagcgcagaatttaactggaggaaaataagagtattcagatgtgttacatggtaatggtggagttccattcaacacatgcagctcaagaactgtaggaaactaaagcaagccaccaggaatccttaacagataacaaccactaggtttgctgcaagagatggcaaaaggaactttggggcaagttttcagatgacggaagacagaaagttaagattattccacctctctgagtgagaagtgccctaggtagacaaagacctcaaccaggaccagcttcttgaacgtataacttgtgcagttagttacacaaggatctgcattagaagggattcatacttggtttcatgctctactgttgccatcttgaaattcttaatttttttttaaccaagggccctgcgttttcatttttcactgggctctacagattacgtacctgattgtgacctcaaccctaaggttagtggagaataaaagttatgtatcttggctgaagcactggttaatcgttgatgggaagaacacatttaaacacaaattaaatgacgtcaatcaaatgcctcttgcttaattcctgagaatgcgtttcaaatttctggaaggagcagttatgaagctaaaaaatgtattttgggggaaatctggcctcaggaaaagctgaacaggacagttagaagtggttccaaggtgggactgtcatcactatcaatggttattggagaacaaaagtcactataggaaaaatgaagtagggaaacgacaaagaaagtggtgaatcatctgaggaagaaattggagataaaaaggagaacctgtggcttcagcaacaatgatggctgctgaaatctcaaatgacatttctaggtttagctaagtgttagctgtttccaaggctaggatagacttgggaaatacataagaaacaactaataatttgttttagaaacatttactaaactgcaactatttgccaagcactcagctagtacacatagacaaataaaacttgtcttcttttttcaaggaacttataatctagcaaacaaatactcataaacaattattttttgtgtaataatacaatgggaagtaatgctaacgacaacaacaatagttgtttattgagtgcataccatatgccaaaagagtctatcacagcatactagttaaaagaatgaactctggagtcaggctttcccaatttgcatactggctgccacctattcggtttactattttcagtatgttacttaaatgctgtctgtatcatttccagcactgtgaaatggagatactgagtctctacctctcagattcattatgagaattaatagagttaatatttgtaaggtgtttagaacatttcccatttcatagtaagaacaataaaagttttaaataaaaactatcagtcaatgtaattatcatattactctgtgaggtgggtactaatattgcccctattttactagtaaagaaaatgaatgaaaaagaagttaaacaatttgtctaggatcacatggtaataagtggcagaacttctaacataggtaagttggccccaaagcccacacacttaagaactataatatagcatgatatacttacaaggtactcatgtcatagtataatataaggtagctatatgatagtatgatataatataggaatggataaagggacagggatatgaaacgagaatacaaaaggggaaattaactatttcattcaaggacagattatattctgaatcagtcatggttcttgcaataaatagttcattcaaagtgggatgaggaggctttcctcctcaaggcctgaaaggctaaggggagggtatagttagtagaatctgagaagtggctgcagggacaagacctcttgacaggagctggggctgtgagtaaaggaacctagccatccctcgactcactctcctctcatccattgatctgctgatgcctcccaacacaaggaccaagccaatagacaagcaagcccaatgctactgccatattggtcaacctcctagggtagaacaacaggttagagattggatctgcgaaagtatccagcaacagtataaaaaaaataataataatggcaacaactattgaaacaaatcagtgaaggaaatgaccacatatgggaattctcagcaaagacttcatatcaagtatggcactacagctgaactttggcagatttggctagagaatgagaagagcattataagggaaagacagacatgaacaaaggcatgaacgtaaaataaagcctcaaatgggctggttagagcctggaattctttacaaataatggcaaataagtttaggtagacatagtagaagcagtatatagttggctttttaaaaatcagtttgaggttttgaattttatcacaaggacaactgggaagcagcgaacttgcagaaaaaaactgaggctataggagcaaagctttcagtaatcctgtgcctccatagattttgttctttctggttgggataaatttctcaattcttggtccattcctagaaatacagttaacagatacccatacgtaaaaagtgttgattgaccaaatcactgactacaatgaagggaaacagtggtacaagaaacaagtaattagagacttgtggcagatcaagaatacatacaaatggcaaacaagcatatgaaaaggtgctcaacatcactgaatcattgataaccagagaaatgaaaatcaaaattacaatgacatattacctcactcccgttaaaatggcttatatccaaaagacaggcaataaccaatgttgacaagtatgtgaagaaaaaggaacccttgtatactgttggtggaaatgtaaattagcacaaccactatggagaaccgtttggaggttcctcaaaaaactaaaaatagagctaccatataatatagcattcccgctgctgggtatatacccaaaagaaaataaatcagtatattgaagagatatctgcactcccatgtttattgcagcgctattcacaatagccaagatttggaagcaacctaagtgtccatcagtagatgaatggacaaagaacatgtggtacctatgcacaatggaatactactcagccacaaaaaagaatgagattctgtcatctgcaacaacattgttggaaatggaggtcagtatgctaggtgaaataaatcagacacagaaagacaaacattgcatgttctcacttatttgtgggatttaaaattcaaaacaattgaactcatggacatagagagtagaaggatggttacctgaggatgggaagggtcgtggggaggtgggggtggtgtaggtatagttactgggtacaaaaaattagttagaaagaatgagtaagacctactatttgatagcacaacagggggactataaccaataatgatttaattgtacattttacattaattaaaagagtataattggattgtttggaacataaagaataaatgcttgaggggttgaataccccattttacatgatgtgcttactacacattgcatgcctgtatcaaaacatctcaagtaccaaataaatatatacacctgctaggtactcacaaaacttaaaaatataaaaataaaacaaaaagaaacaagtaattagaatcagaaatgtgtggaaattgctagaacacatgttccttttctaagcagtatttatcagtattataaaaatcactgatcatttggctagctttaaaaataaaaaatatgatagctgtttaagaaatcattattagctattcaaacttaaaaaacaataagacagtcagtgaaatttatttctctatttctttgtagtaatgtttcaatttgttgatattttggggagttaaaaaaactcttaagcctagcactgcatgttctcactcgtaagtgggaattgaacaatgagaacacatggacacagggaggggaacatcacacaccggggcctgtcaaggggtgaggggcaaggggacagagagcattaggacaaatacctaatgcattgggggcttaaaacctggatgttgggttgatgagtatagcaaaccaccatgatacatgtatacctaggtaacaaacctgcacgttctgcacatgtatcccagaacttaaagtaaaattaaaaaactaaaaaataaataaataaatataaaataaataaaataaaaaaagagcatagtaatctcaaaaaaaaaaaaaaaacctcttaagcctaccaaatttggtgacttctttgaaatggtaataatattaatctactattagtgtgttatttttaaaataaattatctccctgtgttgaaaaaaagattaagatggtcctttccaagctattataccacacggaacttaaaggattgatttacttgtcatttactaaaacccttaacatccaaaaatgaaaatgcctttcactttcacaagccagtaagtaaataatgtggtgtaaattgcggatcttgaaatacaatttcaaagtcaagaaaaaaaaagaattttatgctacaatttgttgataatgatttgcaaacgcatttctaaagtgatataaagggcgttgataattttagctattcaacgttagatcttttagttattctacattgttcacatttcttgaaactctattgttctataaatttggcatattaacaaaggataatcaagacaggtttaagaccagtttttatcatgtgcatcagattcgcaggcttttgatattatggcccagtaacataagtgatataattttttctcctacacacattttagaagaaagagagacatgaaacaatatataggactgccttggaatattgtgtgtttggttccagactgctgcaataaagtaaatatcacaataaaatgaggcacacgaatatttttggttccccagtgcattaaatgttatgtttacactctactatcatctgtcaagtgtgcaatagcattgtatctaaaaaatgtacataccttaatttgaaaatacattactcctaaaaaaaatggtaacaatcatctgagcctgcagggagtcataatctttttgctggtacaggctcttgcctcagtgaggatggctgctgattgatcagggtggcggttgctgaaggtcgggatggctgtagcaatttcttaaaataagacaacaacgaagtttgctgcatcgattggctctcctttatagccaatgatttctttgtagcatgtgatgctgtttgatagcattttactcagtagaacttctttcaaaatttgagtcaatcttctcaaaccctgatgctaatttatcaactaagtttatggaatattctaaatcctttgttgtcatttcaacaatgttcacagcatcatcaccaagagtagagtgcatctcatgaaaccacaatctttgctcatccataagcagcaactctggatccgctgaagttttaccttgagattacagctattcagtcacaccttctgactccacttctcattctggttctcatgctatttctaccacatctgcagtgacttcttctactgaagtcttggaccctcaaagtcattgatgagtgttggaattaactacttccaaactcctgataatgttgatattttgacctcctcccctcaatcatgaattttcttcatggcatctggaatggtgaggactttccgttttcagtttactttatccagatccatcagtggactcaccacaatatagcagctatacctttatgaaatgtatgatttaagtaataagacttgaaagttgaagtgacttcttgatccaaggactgcagaatggatgttgtgttagcaggtatgaaaataaaatcattctctttggacatattcctcagggctcttgggtgaccagggacattgtcaaagagcagtaatattttgaaagacacatttttttgagaagtaggtctcaacagagggctcaaaatgttcatcaaaccatgctgtaaagagatgtgcagtcatctagtctttgttgtttgatttacagagcataggcagactagatctagcataacctgaagggccctaggatttttggaatggtaaacgagcactggcttcaactgaaagtcaccagttgcattagcccctcacaagacagtcagcctgtcctttgaacttttgaagccaggcattgacttctctctagctatgaaagtcctagatggcatccttttccaatagaaggctgtttcgtctatattgaaaatgtgttgtttagtattgccacctttattaacttagatgttagtttgatcttctggatagtttgctgcagcttctccatcagcacttgttgctctgccttgcacttttatgttatagagagggcttattcattaaggctcatgaacatacttctgctagcttccaacttttctgctgcagcttcctcacctctctcggcattcacagaattgcagagaattagtcctttgctttagattagccttttgcttaagataatggtgtggctgttttgatcctctatccagaccactaagacattctccatattaaaaataaggccgttccactttcttattcctgtgttcaacagagtagcacttttaattttcttcaagaacgtttcctttgcattcacaacttggccaactggcacaagaggtctggctttcagcctgtcttggcttttgacatgccttcctcaccaatcttaatcatttctgacttttgatttaaagtgacaaacatgtgactcttttttttcccatgaacacttagaggacattgtagggttactgactggcataatttcaatattgttgtgtctcagggaatagggaggcccaaggagaggaagagagatgagggaatggctgatcagtggagtagccagaacacacaaaacattgattgattaagtttgccatcttatgaaaataagtaatgggaaaaggactctgtatttaagacatgatgctgggatggctggttagccatatgcagaagaatgcaactggaccccctccttacaccatatacaaaaattaactcaagatggaataaaggtttaaacattagatctcaaattataagaatcctataagaaagcctaggaaacaccactctggacatcagacttgggaaagaatttataactaagtcctcaaaagcaattataacaaaaccaaaaattgacaagtggaacttaattaaactaaagagctcttcacagtgaaagaatttatcaacagagtaaacagacagtctacagaataagagaatatatttgcaaactatgcatctgacaaaggtctaatattcagaatctatagggaacttaaacaattcaacaagtcaaaaacaaataaccccatcaaaaaaaatgggcaaaagacataaacagacactactcaaaagaagacatacaagtggccaacaaacatgaaaaaatgctccacatcactcaacatcagagaaatgcaaatcaaaaccacaacgagataccgtctcacaccattcatactggctattattaaaaagtcaaaaaaatgacagatgctgctgacgctgtagagaagagggaactctgatacactgttgctgggaatgcaaattagttcagccacagtgaaacagtttgaagatttctcaaaggacttaaaacacaactatcgttcaacctagtgatcccattactgggcatatagcccaaataaaacaaattgctttactaaaaaaccacatgtattctcatcctcatttcagcactattcacaatagcaaaggtatgaagtcagcctaggtgcccatcagtggcagactggagaaagaaaatacggtgcatatacaccatggaatactatgcagccataaaaaagaacaaaatcatgtcctttgcagcaacatggatgcagctggaggccattattctaagtgaattaatgcagaaacacaataccaaataccacgtgttctcatgtggagctaaacagtgcgttgtcatggacataatgatggcaacaatagaaacggaggactactagagtggggagggagggaaacaagggttgaaaaactaactatcggttactatgctcagtacctgggtgacagtatcatttgtactccaaacctcggcatcatgtaatatatcaaggtaataaacctacacatgtactccctgaatctaaaatcaaagttgaaaaaatgtttgtctttttttttttttccacacagggtcttgctctgtcattctggctggagggcactggagtgaacatggcttactgccgccttgacctcctgggctcaagtgatcctcctgtgtcagcctcccatgcagctggcagggctccttacagccatgtgccaccatgcccagttaatttttctacatatatattttaaagacagggtctcactttgtttcccagactggtctcaaacttctgggctaacacgatcctcctgccttggcctcccaaagtgttaggattacaggtgtgagccactgcaccccacaaagtttgccatctcatatgagtgcagttcatgacatctcaaaacaattacaatagtaacatcaaaggtcactgatcacagatcataacaaatataataataataataatgtttgaaatattgagcaaattaccaaaacgtgacacagagacgtaaagcgagcacatgctgttggaaaaattgtgcccgacggacttgctcaatgcagccttgccacaaactttcaatttacaaaaagtgaaatatctgcaaagtgcaataaagtgaaacccaataaaacgagatacgcatgtacatatttggggattattactcctcaattttttcagtattaatttcttgttctaccttgaataacatcattttggaatccttcgaacttccacttatcaagacgaattctcttgtccctattcagaggaatctatacagcaaattgaatcataagtgtactaaaataccaaagcagaagataaattacaagacatgaatagtgaaatgtaactatttgagggcattatttgtaatagtttgcctggtacatactcctcctaattttgcatcctaaagatactatccaaagactgtagaaattccagatacaagaggctagagttgacaggtaattaagctttggtcaatcaaagagctagaaaatatttattgaaataattgtatgcataacacatcacagtagggaatgtgcctcatggatgacatgaaagagactctctagtgaaataattgaacttgtgatgaactttcaatgcagttggggaggtgaccttcaggccagcccatgcatgctcgcacacgcagttacccaataatagaagacaatatgtaaatgacaaacgtaatagtctacagaccacatatcctaccctaatgggattctgagagatgggattttatatgggaccaggttcagggaaggtgccatagaggaacagcaacatgaactgtaacttagaggatgaactcaattaataatgacctaatgggagaaggaatttcaggacaaggagtagctttaaaactaaagtgtagaagtcagaatacagcagagtggttgagaaagagtgggaagggcagctgtgtaattagttagcagaattacgatggctgtgatcaagttgagaagggaagctggggccagaatgtgagggctcagaacactagatgcccaaataaggacatcatgttgaaggccatgggaaatcatcagaggtttgagagcagaagaatgccacaataaaagtggcatgttagaaatattaacctcgtacaactgcatccaatgtcccttccaagaaagaaatggaaaattaaattgcagtaacccaagaaaagcctcttgtatctcctctttgattaaatgtcctgtcatgaaaacatgtaaaacatttctaatttaccttcatgcatctttttaagaagaatataataactccactgcacacaaggaacataaattcaaccccattgcttgtaaaaactgtcccaaagaattattaaacaaatttgctgattctacttgtaatattatattttactatataggggtaaaaagggattgtagtttcagtttagaaaaaaggtaaacattcagaatgttttgttaaattcttacattcctactctaaaggataaacagagactttcagagtgtgagaagaaattgagatctctctggaaatacaacttcaaggattattatcagtgataagaagtattaacatatgttatgatgtcacattttgtgaatataacttttcaatgcccttaatacgtattgctgcactagacctgatatttttctttgggaaataagtcttcaggtagtactcctatttctaggaaaggagtactggggtattgtgctcatctgttcaaaaataaaagtcaaagctaacaaaacatttgttaaaaatgcattcaaccttttcacgttttaaaaacattttgaagatattattcatttaagtactgaaacaaaaccatgctttttatttctaacggcagccatcaataaactgaggcaaagcaagagatgttaccattcgctgatactacctgtagatgggaagtgaagtgaagaaatgagtgattatctagaggcgattacactcatgaacacagttaatcagaataattcaagccccctaaccctcttctgctgtcttcacatggtagatgtgaaatttgaattatcaaaataattggcacagctgttcaattcatgtttcccatatagggatagaatcaggctcagtttattcagctataaagtggagataattacattcatataaaccactcttgtgtgattaaagcaatgaatctatttataagaattcaaataccttaggtagaaattagtcaaatatggctagtccaggtttctttacagtaacagcaattaagacatatgttatatagaatatatttaatccatgaggtttcagccttctgattttgccaaattctgagtgctacaaagtgaagatacatatggatggtgaacaaccatgtgttcaccttaaacaatgctatattaatggcttggaaatccttgtgagttttacaaataagtgtgaaacaggagtgcatgtgtgtatgtgtgcatgtgtctgtgagcactcacacagacaacatccgaatggagaagagaggtatgaataaatatatatcctaaatttgcatcaaaatggtgtaatggttacctttggacgtacatataaggggaaaaagtgcttaacaactaggtctcattcttcaaaataaacaacatcctttgtacattttctcagcagttgtctgggagatcaacattaatctatttcttctcagaacttatatgactgggaaaaagataaaaatctgcccttgattgggtgctatgtgtttaagctctggtttagctgtaaatcatttgtgaagatcatttcttggtaggtgagtggaattgctattatagagtgttaatatacttgcagtgaagtgttgctgggggtaggaggtgttagacattgatcaggagcttaagagatgagctatttatttttgctgttgtaagagcaaatttctataataaaacaatgattctgcttctctgtcaaaaaacaccattttatgacatgaaagctctcttcagtaaacaaagaacagactgttattggagaacgtaaaaattacaatagaatatatttccctataggagcacagtggcctttaactcagctggaacttacagtatgacagcttttaaaggaagggacatattctatggggaggattttagacatacttgtctattccctaggccgtactaattcttatcatataaaaatgggtctacattagcacatggtgccagtatatcacacacttgcactgcggcatgaaaggagcccagcttgagggggagaactgctttctgtggcatagttccaagcaaacacatggcacaaatgaagccgattctgaggaatatggaaactttatgtactgtttgatagggaaatgtgcacagcttctaaacggtgagcttctagttctgctccaagaacaagtacaatcaattcttaagtggtttctgtaatgttgtgttcctaaccgagctgtttacattatagggaagtgttaagtttaattttctgttttattaggcaggtttctcattatgaacaataatttcaataccttttaagtaatttaaaaataagcagtaatccctgcagaaaggctgcagtaccatttctctagtgattcctttttctgtgttttatttgtataaggtgagcaaaattgcttattctttgttgcctcagagactttagtggcatgaggctaggcagagacaaaaactgataatcataaataaatcaacactattgggtggttccaatatccagtatctcaatgttctctgccctttgtctctttctgctatattaatgatctgtcttaattttacaagttttctgtaagatagtagacagaataggtgttactgaggtgaaggcttcaatccaaactacaaaactaggtagcctagaggcaacagctaattccatgcttttggttcacaaaggaatgctaatacacacaagtaataacaaaacaaactcacagtacatgtgctactgaagaggtgttgggagcattaaatattcgtacaaagggcagcacaaaatgggaggttaaaaaattaagcaacattaggaacctgagagatgcaactaattaaccagtttggccttaataaatatccatgctgtaatattttaatagtaatatctgcccctaatatctatccatttatgtaatattccccattactatctactcaaatgttctgctacactttctcgtaaaggtcagtgactctccactgccttacaattcaaactcctacagcgtagcaattactacaacaagagtaataactagttattgtgcttttcctatgtgctagatattgcacatgggatggatttgatttgtaattatgtgctagatattgtacataggaaaagcacaatatatattaacttacagacaccatttgaggtaggttaataatgaccacccctcaatggttctgtacttacacccttttatagacaaggaaaatgaagcacggaatgaagcataatttgcccaaggtcaccaagctaaaaggtggtgaaggtggaataaaatggcccatatcctccttttccagtgtttttctcttttacatcgtaactacaatttcgtaagcagctataatgtagccgaagctgggctagatgctttatagtcatcatttaatcccaacaacaactctacctagctgggtactatattcatttttttacacatgaggaaataagcacagaaaagattaccaacttccccaaagacagccagccagttaggatcaggatagcatttgtttgtttctttttttaattattttgagattttattattattattattattatactttaagttttagggtacatgtgcacaatgtgcaggttagttacatatgtatacatgtgccatgctggcacgctgcacccactaacccgtcatctagcattaggtatatctcccaatgccatccctcccccctccccccaccccacaacagtccccagagtgtgatgttccccttcctgtgtccatgtgttctcattgttcaattcccacctatgaatgagaatatgcggtgtttggttttttgttcttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtaaatagtgcctcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaagagtgttcctatttctccacatcctctccagcacctgttgtttcctgactttttaatgattgccattctaactggtgtgagatggtatctcattgtggttttgatttgcatttctctgatggccagtgatggtgagcattttttcatgtgtcttttggctgcataaatgtcttcttttgagaagtgtctgttcatgtccttcgcccacttttggatggggttgtttgtttttttcttgtaaatttgttggagttcattgtagattctggatattagctctttgtcagataagcaggttgcgaaaattttctcccatgttgtaggttgcctgttcactctgatggtagtttcttttgctgtgcagaagctctttagtttagttagatcccatttgtcaattttggcttttgttgcccttgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagtggtagatatgcggcgttacttctgagggctctgttctgttccattgatctatatgtctgttttggtaccagtaccatgctgttttggttactgtagccttgtactatagaagcattccctttgaaaactggcacaagacagggatgccctctctcaccactcctattcaacatagtgttggaagttctggccagggcaatcaggcaggagaaggaaataaagggtattcaattaggagaagaggaagtcaaattgtccctgtttgcagacgacatgattgtatatctagaaaaccccattgtctcagcccaaaatctccttaagctgataagcaacttcagcaaagtctcaggatacaaaatcaatgtacaaaaatcacaagcattcttatacaccaacgacagacaaacagagagccaaatcatgagtgaactcccattcacaattgcttcaaagagaataaaatacctaggaatccaacttacaagcgatgtgaaggacctcttcaaggagaactacaaaccactgctcaaggaaataaaagaggacacaaacaaatggaagaacattccgtgctcatgggtaggaagaatcaatatcgtgtaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacgctacctgacttcaaactatactaaaggatagcatttgaactcaggtctttctgactcctaagtctagccctgtccacatgtcataaggtctcttcccaagcaactctgcttcctattctaacacttattccttactttcctgcctctgtgactctggttctcatgccaccaaatccatcaacacttccttgcagtcctgtttctaaaatagaattcagtgggttaaacaaatcatgattttaaaaagcagaagggaaaactacacaattggcttgcttctcctcatctttctctaacttcatttccagctggacacttttccctttttgttctgctttattattatttcacacaaatacattcagatttgtcaccttttgttctaatgctggaaatacaaattcatatggctaaaacggagtggaccatgacattgcccccagaccccacttttattccttgtaattaagaaaaaataaaccttaataagaagcttgtattaaaattgtgcaaagttagtcattactaaatgttcatggctgtattagctgcctgtggctgttgtaacaaatgattacagacttaatggcttaaaacaacccaaatttattatcttacaattttggaggtccaaagtccaaaaaatgggtctcacaagctagaaacaatgtgttggcagagcttgcattccctctaagggatgtaggggaggattcttttccatgccttttccagcttttagagcctgcctgcatttcttggctcttggccctgtccttcatcttcaatgccagtagtgtagcatcttccaatctctcttttactctgcttgtatcatcacctccttctctcttaggaggactcttgtgattacattgggcgcactggggtaacccaggctatctctccgtgtcaagatttttaacttaaccacatctgttaatacaaagccttttgccatgtaaggtaacatattcacaggttcctgggattaggatatggacatctttggcgggggaggagtgggcattattaaacctttcacaatggttctgcatttacttagcatgagaagctgtttgtcacaatgtgacatactgacatacttcttcgggtgggttcggtactatgtgtcatcgacaagagttacagtatctcacaatctagaaagcacaggaggcaaaaaagcaaacaaaaaacaaccagtcataccaggctcctgtgtccttgtggcagacatggtttaaccaaaggcctccggaagtgggaaaggtgtattgttgggtctctttcaccctgtaaccaaaagaccatttgaattgaggtggaaactggagttcacaaaagcgttacattaaaaaaataataataaactgtgactccctgaggaaatcacagtgtttctgtttggtgacaagctgctcttcaggaatgaatcctataagaatttcagataaagctcttatcttttggggagtgaaggctgcaggaaaggctagggtattgccttctgggatgcagaaaaaccatcttccccttagctcagctttgttcattcaacttagttcttcccctccacacccactcataaacattaagccttcttcccagctgtcttcctctctctttttcatttttaaacttcatctactttttgaattcttttctctgcaacaactactactaaaatctgaaagcttcttctattgttaccatggagagggcaattttctcaacaagtaaaggaggtggtgcagagggagagggaagaactacatatgaaaattgaaagttagcctctgtgtcttttcaacaacatcaaattaaatcttttcacttccatacacaaaacaacaggaacacacagtgggtggcaaattcagcccagggatgtgaatgaatcagtaggctttgtgataatatgctgggggtgtgagggaggtggcgaggcagcccctcaatcctaaaacagaaaagtaatgaacaatgataactgatatagacaattactctgcagttgtttgaatatatgctgctttctatcattttcaggtaaatgaccttcagaatggcagtagatggatttctaagaaatcatgaaatacaaacatgtagacaaacaaagcaggcagaaggaagtaataagtttaaaaaatgaagtgctataagaactgagagagaaagattatcaatcctccctttttctttcttctattcttctctatacaagttatgaagtggaagaaaatacaaatataaaatcatctgatggtgaaacatcagtgagattttaattatatctagattttttaaatctcaaactaggaaaaatctgctgattcacaaacatgaaaatattttaaaagatcagagatatattaattctcatgttctaattctcctgacatgaaccatatatatgctttattctttctgatgattctgagaaaaatcaaattctgaatttttaaaatgatgatgttgcccaaattgtaataaatcaccatattttccaaagaaaaattctacacaattcctgtacataaattttgtgtggaaaggcttgtatcataagaataatcaaaggaaaagaactgcaaactagtagaagcataaatttaaaatgttgctgatgatgacatcgagtaaagatttgaagtgttaagtagcatgttaaccaactttttctatgatcctcttccccttctcaatacccactctagcttttaaaaacacaatgagattgttttctacagcacaatgatgaacatttcaggtgtataaaaaatataaagaaaagattacaagtgaagtctatggcatggctgtactaatccacacacacgtacgctcggcagtgtaaaagttacctcactgatttgcttgaattaacaatttaaaataaaattttatactgaattaatgtttatttttataaaatagcagtgttattagaaagatttctgacaagtagtgtacgattacaaatatcatctaccttggagttaccatgaaattaggagggtaaaaatagtaaataaagatcctattctagacatctggcctatatgcagacaaccaggcagcacaaactcaagagtccgcttgtaattgcttttgaattcagagaaaattaatggtaagttggttggtttacaacacacaattctcttatttgcaaagcaaaactgaaaaatacagatagatagccaggcagggaaaaagagagagagacagactgactcattaaaagagagagagagagacactgactctgatttataggatacttgcttatctattcctgttagaattttctgcttgccacttcacatagtatcaacaaaacgaatgtattacccccaaattacagactattaaataaagataaaaactaagatgattttcatgagaagtaaacaataagctttttacacagcacaaactgaggatttcattacacaaagttatgggaaaagctacatattgatatctttgttattgtgaatatctcagttattgtgaatctgtaaattccatgccctattacccccatacaagccagggagatgtactcgtataatagcatttcactcatgattgaattgacaccaaatggttgcctctttgcaatatatacaaagaaatttttagttgtgggctttgtgttttgttttgtagttagaccgctaaaaataatcaaatgtctgatatagttaagccataaagatgaaagaagtgtctcacttaaaatatttattaattacatatgtttttatatctataatatacttatattctgatgtgcaggaactcagttacttaagtcaggaattcacgtggggatagagttagaatttaatcagaaaggccagtctcctggggtgggttctaccagcatttgaactattttttatcacagtcaacactagaggccttgctaatgagcaaaatgaatattagaaatgagttttcacttatgagattagtgttacttaagatacatgctttggttaaaatatttgagagcaattcctcatctctagcttgctaggtataaaaatatagtaagttatggaacctgtattctttggaatggtgcccaagatttaatgcctaaactatgctttgtttccacattgaatccgaagattctagttgtctgatgccttctctaaggttaactgcatcctgcctctagattctggaatattctcatgtctcccttgattgaaccttttatacggagtatgacaacacctgagagtgagggtatgggagtgtagctaacctttacctattatactaaagttttgctgtggttatctaccaaaaataacctaatagttggccttgcataatagtgttgatctagggcaattcataacaccacgtaagccacaaattttaaaataacctccactataaggaagtgtaaccaactccttacattcaacaatacatttgactttattcttggagtatattattacatttttctttttatttcctcatggttatatttgttataaagcatggttttataactaggtcgttaaagatctttaaagattgtgttattttttgcatactattactatcatatgaataatttcacaatcttgccttgtctttcatcttgaggcacctattcacataattattttttcacagtccaaacaataaccaggccttgtaatttagttatgaaataaaaaggctggtatttacataatcgtcttatgagttatgcatgtgcaagaaatgttctgcatgtttgtgtgcgtgagagagacacagagagagagcgagagattgagagtaagcccgatcattattgaggggtgtaagaaattactttatggagatgcaaaaacctggggttcagatacgagactgcggtgagatcattgcctcccaccctctgggggctcatctgagctgccaaaatattctcctctctgacatttttatcttggctcttcgacaagttctcagttgcctgctcaagattcatattctctattatttcttccctgggtatctattttcacagaatagttgaagactcataataaagcctattttaatgtatcatttttcctaagcaaatccatttcaatctccactgtttttatttgccaaacatgtcctaaatactaattataaacgcagctcaatgcagtttattatgtttccacgtatttataccatatatgttattcgtgtatgtgtacacacacacacacacacacacacacgcgcatgcacgcgcacatatggtttgttgccaataaacctgtgatagaatctggcacttatcaatggcattgccttgggcaagtcacttaacctctctgagtttctccctttcaaaacaagaaaaacgccagttagcttgtaccacttttgagaggattagaaatattgaatatgatatgcatagcacaatgcctggtatatactagaaattaatgcatggtaagcatcatgaattttatggtagtatatatgacctaacattttgggccaaaaggaagtgtttgaaggcaatttggtcaaagccaaacactgtatgtttaaataatgatggttgggcaacaatgctatgtctttaagcatttctttccatttttcaaaatctgctctttcttattcacaattatttctactatttaatattttaatgggaagagttggataaacctaaatgtgcagcattgggattcttttcatagtgatcacttaaagtttgttttgctttttttttttaccttatatcaagaaataatatataaccaatacataattatatgaaaacatcgatctttaaaatagcataaataacatcaacaatccttccctatgtgtatataaaatattcatagatatatatgtggtgtgtgtttctaaaagtaatatatgtgtgtttgggtatataataaatattgcaacaaaaacaatatcatgtagtacatactggtttgaaggtgctctcctcactatactccaatttacacaccacaatctatttcagcatcccactaaattttgggcaatttaattttttcctgctagtccctatttgaaataatgagcttatctgtagtgaaaagctgtaaatatgctgcctagattcccctttggaaatgaaggacttagttccccagctgctaggagtgctgctggtagacagccttcagctgtcagcccttgtcttagtctgggccgctatagctaaataccttagactgggtaatttataaacaacagaatttattgcttatagttctggaggctgggaattccaagatcaagacatcagcagattcattgtctggtgagggcccactcctgttaaatggcatcttcggtgtgtccttacatggtgggagggcaaggaagctttctggagccgcttttataagggcactgatcctgtttctgaaggcagagcccgcatgacctaatcacccccccaaacccccaccttctaataccatcaccttgagtgttaggtttcaacatacacattttggagggacaaaaacattcagaccatagcagcccccttatggaaattcccgtggctaaagagaatcatcttgctaaagttcgttgccttcctggagtagcccacatccagtgcatgacttgacacggggttataaagatccagtcccctttcttcgtttcctagcacttctgaagggtcattccagcttaagaactccctgaacggtcagctgaggcccttactaagactgcgtcagagctcaacttctccctctgcccctacacgttgaccccaagaacactcctaaatagacatactgcatgctcacctcaatctcagggtatgcttcccagtcacccaaactatgatattatctttaagtaagtaaaccctaggcatttgggactgatttctagaatgctcttaatctaaaactctccaaagtgtaggtcaaaacttttccataatagtgtgcatattttctccccattgctcctttatcaagtacttgggaattaaggtaaagaatatttggaagaattaaagtggggtagacttcctgcatatctctcaggggtcaaacacacctgtttgtggccactgactttcgcaaaaccatctcatctttggccttgggcacactctgtcgtctgaacacctctcaacagaaggtgccctcctcactacactccaagacttccctttcaatccaactgaaaaatttgaatctattaagaaaatacgcttttttggaagctcttagaaaacaattacagtgaaacatgtttctctctctctctctctttttaaatttgtaccatcaattggaaaggggctttgagacactatactaccattgcccttttgattccctctcaaatttgaaagctttatttatgatgcaaaaatagccatcatgattaattggttttttcaagtgtctatcatttttcaccaaggataactgctatgattagcaagaagaacctccatacaaatctatttaatcatctaaaattcatatttgttttaaggatgactgttattttgactgataacgtaaaatactactatgatttcagcgcaaagttaaagtgtgaagaaaagtaatacagaggttggcataaccatcaaagggaatttcttaaagaatatagaacaaattcaactacagagtagagatttattatttactaagatcttaaaacatgctttttaaattctgataacgaaaatatgacatagagtttgctatcctagttttacagttgaacaaactgtaatagaatagatcctaaaatttgtgcaggttgtcaataacatacagggcaaggttttagatgcctgactttaaacaaagctcatgctatttctacaaatacaagaaaaccagaaaaaaatattcacatagtcttaaagcttctctatatttcaggagggggtgaagtaactgaattatattaacagtgttctttaccatgatacccaattcttgtcatgaataaaaggtgatgttcagagatgtcatcaaataattgacaaaaaaaaaaaaaaggataagaaaaaaggaatgaaataaggtagtgaccaaaccttccctttttatcagtgatcaaaatccttgcttttacatatttataaaatccattctatttctctggatgtgtaatgaaagaaaatgaatatgtatgttcatttctaatccatttgaaataacaaaagagatggcattctgagtccacattctctttccagattttaagttttataattacttacgtaacactatcaacgaataggacaatagaatacaaacaaaaagtgaatcctttttagaagacagtttgagtacaaactgctatatattatgtactactctttaaagctctcatgcagattttaataattaatcaatattctaaatataaattactatatgtaaagcagtaatctatttttataaataaaatgatttcgtagaatgctgtgttaaattctttccctcagacagttgctctagagaaggaatggctgcttggaccctggtaggtacatcatggtgagaggcacaaatgttatcctggtaacaacttcacaaattatagacatagtgcgaagagaaaagatttctaaaagattaatttggtaaaagcatatgtagagaaatcaagtgactcagagggacatacacatccaactaagataatgttctctcagctgtgctcctcaagatgctctacacaaatggtttccatggagaaatcactgagaaatactgagctaacaatactaacattcctaaaagacttttcagtgaccttactatggagatgtacatcatagattgctaggataggcaacgtctatgcatgtttttcagcttatttgaccttttcatgaggatcatgtatgaacacctgatgaacctggttttctgtaggacaattttggaaatgttgagatcttttatcaactagaaatgatagtatatttcctagtcaaaatattttttaaccactttattgatttcttaaccactttattgacataaaaagctatacacatttaatgaacacagcttgatgagtttcgagataattacagttatgtgctgcataaggacattttgatcaatggaccactatcatgtgcacagtctgtatacatgtaggacagtggtcctataagattataatatttttctgtaacttttctatgtttagatgtgattagatacacaaatacttgccatcgtgttccaattgcctgaagtattcagtacagtcacatgctgtactggtttatagcctaggagcaataggctataccatacaacctagatgtatagtaggatgtaccatctaggtttgtgtaagtacactgtatgatgtttgcacaacaagatcaatcagctaaccatgcatttctccgaatgtatatctgttgttgagcaatgcatgactgtatacccctgtgaaatcatgtccagaatctatgccataaacctatgcatcacctccaaaatttttctcttaccttccttatttactattatttttgcatgtacgataataacaggtaaaaaaagatttactctcttagcaaagttttaaatataaaacattgttaactacaagccctaggctgtacagatttgtaggacttattcatctcatatgactgaaacctagttagtattttttttttttttttttttgagatggagtcttgctctgtcgcccaggctggagtgcagtagcctcccgagtagctgggaccacaggcacccaccaccacgcctggctaattttttgtatttttagtagagacgtggtttcaccgtgttagccaggatggtctcaatcttctgacctcgtgatccgcccgcctcatcctcccaaagtgctgggattacaggcgtgagccaccgcgcctggcccctagttagtatcttaatactcattattttccattttaacggcacaaaacagctgagattatgagagacaagagtggttattcttattagaacaaccatagaaggagggcaatatctacaagtttgggccatggggtggtgctgctatgaatagactacgaatggccatgtaaatattggggtttgtgacaaaagataggaaagcctatctcaagaaggaaaaaaaagtgttacaagaaaggcaacattggtaaggaagaaaaacttgatctttaaaacatgttattctaaacagactatattacttgttttcttgtttgattatcattgctagaactggtaatgtttttattgctcagtgtatactttctcttgaactcagtgggtttatttgggtcttaataattcagaatataaaaactgatgacctaataccacgtatattgatgctaacggacatgtttagaatttgtcagactatgtaagctattatgaaagttactgctttctctttctccaacataaaaatattcagaggcagaaagatagacatgaataatagagttttttctccattttatttccttgatttctgaaacaaatttaaacagaactaagaagacaggaaaacaatcacatcatatttagctaagttaaaactgcttatgtccaaagaagaaaaatgtgcattattaagagtatcttggctagcatagccagctgcctatccgataccctttctttccttcttagctaaaaaaatccaaattctgttcagactagcaaggttttataactaagttaccaattttcacattttgaattatgaagaaagaaacacacctattcagttaaaacactcaatcctcccaagatccttagaagttaggaatggtcacgtgacacatttctggttaatgcactgttcaagtagaaactcttctgtgtggggctgccagaaaagcactggttttccttacaaacaggagctgacacagctggaatatgcttttactttccccattttcccttcttccattttaaagtacagacatagtgcctggaggcagagtagccatgttgagaccacaggaaaaaaagtcttgctgggcacggtggctcacgcctgtaatcccaccactttgggaggctgaggcaggcagatcatgaggtcaggagatcgagaccatcctggccaacatggtgaaaccccgtctctactaaaaatacaaaaattagctgggcgtggtggtgcgttcccgtaatcccagctactcaggaggctgaggcaggagaatcccttgaaccagggagtcagaggttgcagtgagtcgagatcgcgccactgcactccagcctggcgacagagactccatctcaaaacaaaaacaaaaacaaaaacaacaaaacaaaacaaaaagaaagtctcatgttggagatgactggggttggaggaaaaagttgggacatacggttttggaggtgctgcactgaccctggaacacataattctggaagtcttgctctatgagaaaaagaaactatctggataagccactgtagtgagaatgctgtcacgcatagctaaacacaatcttaacagagtaaactggaaaaaaaaaatcctttaatttctaaaattcttagagtgtctaaaattatgattgtttttgcatcgatgcagtaaatttaattctcaggagactttcattcatcattgaccaaaacaagacatgaatcatattgcatttaacagttaagataaacatatatatgaatatagctctataaaatgttgtcatattccaaatactaagtaaaactagtaatctgtgaagataaagtaaatcaacaatatttataaagcacctagtacatctttagcggctatgtcaaatagaatattacaccttcctttacaggaaatttaaatttatttcgaggaccagaaaataacaatctaaaaagtcaaatgacaacatacatttgaaaagaaaagttcaagacaacagaagcagctttacaagaaaatatatagttaaaggacaaaatgattttggactgaatcattgatgaaaaagaccaatacatattggcagccgggcacggtggctcacgcctgtaatccccgcactttgggaggccaaggcaggtggatcatgaggtcaggtatttgagaccagcctggccaccatagtgaaaccccatctctactaaaaataaaaaaaattagccgggtgtggtggtgagtgcctgtaatcccagctactcaggaggctgaagcaggagaatcgcttgaacctaggtggcggaggttgcagtgagccgagatcgtgccactgcactccagcccgggcaacagtgcgagactccatctcaaaaaaacaaaacaaaaacaaaaacaaaacaaaacaaaaacgaccagtacatactggaattaacaaaacaacctttacagaaaaggcaggaataaatctcaaaggcttcaagctgtgacataccagtcaactatataatcattatattaatcaactttaaggagtgtgaagaaaccttaagtcattggtatggttaataattggatttggtcagaactcacaccttgaatgtttgcatggtcctcacctacaaagtttccaaatgttaaaataaaatatatcctcatttttatttatttattattttagttttatattttattcttttttagaaatggagttttgttccattgcccaggttggaatccagtggcgctatcatagctcactgcagcctcgaactcctgggcccaagagatcatgtcacctcagcctcctgagtagctaaggctacaagcccacaccatcacagccagctaactttttatttcatttttttgtagagatgaagtctcactctgttgcccaggttgctcttgaacttctggcctcaagggatcctccatcctggcactgatattacaagtgtgagccattgtgtctggacccgtcctcattttcatttagaaaacaattgtactgtaaaatctcattatatatagcttcttgcctgcttgcattctttccaactactgatctttgcccccagtaaatgtcctcttctagtgcctaacatctattacataacttaaaaaaatcaaacttgagtaagtgtggtaaagtggcaggctaatttttatgtagaatttctcagaggggacttctgattctatctgtggaagcatttcattactttcgtataatataacatgacagaaagcttagcctcaatgaagttgctacaggttattttccctctcactacaatctacttctttcacatttagggaaaaaatatgggattaagagtaaattactctctccaaattactctctcctctccactttcttaagtatagaatcaactcaatttatctatatgcttttggcaaaaatcgtcttcatggatttaattttttttaatttctagtttgagtgttcaaaaataattctggagttgaacatagattaacttgatatgggggaggggttacattggtcattacagtttattttgcttccataattgaagagagaagatgacagttaaatcaaagcatttctgttcttgaaataaataatacagtatatattcttttcttgaataaatcataggagatatataattcttaaatattatgtcacttgtttacacagaatataaaatataaaggtaagggaactgaaagcatttgtgaattactaaaattgtattcaaagttatttttataaatcgaataagaaattgactcaaatcattttagaaaccgtggcattatttttaatgaattctttaaaaatcataaaagcacaatcaaatcctgttgctttttttttttcaaaaacaatgcagccattactaccttggaaattactgatcaattcatttatgaaatttaaaaacattaaaacatatgcaaaaatcaactttcactcccaagttattgaataaaaatcaacaagatccctggaaagataaacatagcttaattttcatctatatgaaaaaggcaggcacatatttagaataagaaatcacaattgatcagttgatttattcattctaatacatatatgattgaaaccaccataacacttttttcttttgtggccatgactgccctatcttttatgtttttcttatagaggatacactctaaaattagggcctatccctttttaatttttgttccctaagagcagataacactgatgcctttcaccagcaagtgttcaataaataacagatgaatgtaaactcagtattgtatcaaaagctcttaaaagacagtcaatatatttctaaagaatctttatgacactgtaactcgaggtatcaaaagtaagcacttgaaggaggaaagaaaatactagtagtatttaattacagactattaaaatatctacttaatgtatacgttaattttatataatatgtatcactttaacataagtaaccatatacataaaagtgtggatacaggtacagaaacacttttactaatagtgatgtgtgatcactgcctcatcttattcacacttattcactatcatacacaaggaaatcaaatttaaatccaaattattactctagtgtctctttctattctcctttcttaatagtcttcaacctgactctagagtgctttgtaacatgggtttcaaagacaatttgttgaacgaaggaatgaaaaaaacaaccatatacctaacattaacattagttaacattaccctaacattaaaggtaataataagaaaaatttacatcataacacactgtaacttcaattacagactttaaggaccaaaagttatggtgaaatggaaagcctaaaaggcaggtcctaaactttagggaacaataacattatataactttcagaaaattaaaaaaaaaccttattacattgctttcctgtaagaaagttagagaagacccagattctacgtatttctatgaaaacaataaaaatcactccatataaaggagccctaactagatccaagaaaggaaatttgtaaatagaattctctaattatttatttatttgagacggagtttcgctcttgttgcccaggctggagtgcaatggtgtgatctcggctcactgcaacatctgcctcccgggttcaagcgattctcctgcctcagcctcaggagtagctggggctacaggcatgcgccaccacgcccggctaattttgtatttttagtagagacggggtttctccatgttggtcaggctggtctcaaactcctgacctcaggtgatacacccgcctcagcctcccaaagtgctgggattacaggcgtgagctaccatgcccggcccagaattctctatttaaacacaatggcaaacataaacttccttatcagaatcccactggtattttatggaaaacacagtacagtgacttccatcagaattcatgtaaatatcctggatcagttttgcttgataagattttgacagaaaagtttacagtgaattgaattaaaatataataagatacacatttccattcatagactttgaaatgtgtagtttagtatagtttataagtttatgtagtttctttaagaaaaaagcatatggtatcattttccataaaaaggtaattaggagacttagaaaatatgattttgtgtgtgtgtgtgtgtgtgtgtgtgtgtttgcaactctatgacctttttatttaaggggcggtttatttttgttatgaccagagaatataaaataagtcacattactgacactgacatatctttacatccttcgttgaagataatagtggatttggtctcattaggtaaagaaagaaaattatataaatatggatcagtcatccagatggtcgcaagctgtctaccagagacatgtacatttgttggaagataattaaagcacaaaatttgtaaatatcttcagccaaacagattacaacattaatttcttaattaatttcttaattggtatttcttaaacaagtttgtgcagaaatgaaatgatgagatgagaagggctggattgttgatcgatgaaagagaaaaacagaataatcaatctcctcaccctaagatgactgtcacccaacctcgtgaaatccatttgatgcccatggaaataaaccatgtttgctttgttttgttataatttggatggagaaatgagatgtgtaagaagttgaggggggtggctgaggaaatagaaaagaagtaagaaacattatctattcccaagaggtctgggggtctgggtttatgttaggacaattacatttactaagtgactttagatcaattaactaaattgtctataacttctctcatttgttgaataagggaaactattgtaatagccactttctgctgggtttgtgacaacagaataaaaccaagaaacattctgttttgtattgcttttagtttaaatagccaatgccactttacccacacattgtcccatcaattcttccagggctatactacacaagttgtttagtaatcagattttgactgaatctattcaccaaaagttataatcagaattattctgtagctaattcaaatgctttttgtgtatagacagagttttaaaaaatcataatttttaagtactttgaccttaacaacaacaacaaaaattaaactcattcaagtaattatgtcccatttaaatatacactatacccactaaaactgctcattcaatttttagataatgaaatctcccaggtaacagtgcaatgtgtggttaaaaattaatcttgaacaatgctattatcatcttgtccagattggccaatttgtctcaaccccaatctggaaaggtcttactggaggataaaatgcctttgccaactcaattctttattcaatacaagtgcagtggttgagattttgtggtgaattatcctgaacacctggccaaacggaattgaaaaaaaagactacaattaactcagcacaggcaatcagacaccagtattatgaaaaataatatcatatggccatctaaattctatttgttgatagcaacactagtctccactgctgggaacctctcttcatatttccccctccacctttctccctcctgtctcccaccatccctcttccatttcctcctttcctcactcctcttttgtcctctttaatattcctttcttgtctttttttctttccttgctacctttcttttgtcttttctctctccttcccctttttcctgctttccttcctctcttccttctttttttccctttcctcctccttccttccctttctttcctcccttctttgttctctccttcctttccttaagggtcagatttagtaatcactctcaaagcaaaacccaggacatatttttcccttcatttgatagattatgtcaaaaaagaaaactgctaattcttgtcaaatattgttgtttcagagcaattttacttatgtttatgtgatgaaacagaaaaagcattttttaatcagatttctccgacactaagctataaagtacaaatcatccactgctattgattcacaattctagaaattaaactttgaacttcatgtgtgctttacttctaaaggcttaatttgcatatttcacatctctattcttctaaaagataatggtatattttctactgtctaaaatgaagcagatttgcttaatttttttaaatggctgtattcttaaaacttaaaaaaattaaagttgtaattgtagcttccatttttttcactgaatataattcacttagtaaaaattatttttatttcaaaatggaagcagctcaccattttctaaaataatactttaatcaagcaatacatactaaaggggaccataagcttttcaccaaatatgttttctgagttcaaagtctaaagctagtgaaaggttagcttacttgaatgtcatgtccttataccccttctgtggcaaatatttcaattactgcacgtctaaggtttggtctgaatctcataactaactttgccttgagtcataaaatgtctcattgcattatcttatctatcttctggtgctttggaattataatcctcacattccagtctttgttgaatatgaagtttccttatcacattgcattcacattatccatcaagctatccacatttattgagaaccaattactgtacgtgtcatggtcaaacaaatttatatttcaggtattggtatatgaatggtctttatttcaggtctacacgttgtgaagttgagtagatgaacctgttgctttagatcagctgtatccaatcttttggcttccctgggccacactggaagaagaattgtcctgggccacacataaaatacactaacactaatgatagctgatgagcaaaaaaaagtcacaaaaagtatctcatgttttaagaaagtttacaaatttgtgttgggccacattcaaagccatcctgggacgcatgtggctcacaggccatgagttgaacaagcttgctttagatcataataattacctcctacaaatctcctttatttgctctatcctccaacttattctacatgttcttgactgagttcagtggacaattattgtttagtggttggtcagaatcatttccttcttctattgtcaatagaacccagtttctattcaggagaattgcctttccctaattttgagactttgggaggagagggatttaaatcaaagttttctgctcccttctagctcatgtattaacatgtgacccaaacaaggtgaactggactctcttttaagactttaaaatttgaacagagttacacacaggatggagaaaagagagtatcacaaacagactggaatacttcttgctagccacatgcccagaaaggcatgctcagattctttttccttttgtaagttttgttccaatgcctttgtgctaattacagcacatttactttctgcctgatttaatcagagaatgatttctgttgcttgcatccagagagctctaattgataggcaactaaactatatgtgatgattttattttcctgtttacaatcctttcagagttgccactgcctgtaggccatcatcaaaattcctcagtctggcaacaaaggattcccattatttagccccagtcctctctattcaacctcatcaatttcttcctcatcatatacccttaacttcagccatatggaatcacaattcctctgatatactctgttttttttccacctcagtgaaaagcacagtctgttccctctgcctggattgcccttctcgttttatctagctaggtaattccaactcattctttaatgcctggcttaagtttttccttcttcaggaatatctcactagcatccattctctctcctggcttagttttccctgaagaaagccccaacagcatcacccacacaatatcagagaagttgaaaactatgaggtttaagggagaggactctggaaccaaactgcctgagttcacatctcatcattgtctttcttcctcgatctcaggcaggttattatccttactgtgcctctctatctacctcacagtaatgttgtaagcattaaagaattcacgtgaagtacttagatcaatgactggcatatcatatgtgttagctattatcctaaaatttatctctatcatagtgttattattttcttccttcaacctcttttacctgcacattctatgttgtacaactttatgtttcccaggtacttagtggcagctcaatagaagttggttaaaataataaaaatggataggtgttagtaaagtttttttcagtttataaagcccttttggaattttgcctaatttttcacacatcaaacattaaagttgggattgctttatttaaaactttacataaaattgatattgatttcctgaaattataacaaaatcctccccatacttacttatccttcttatttcccctctcacacacatttgtttaatgattatttagggccattttaccgacaatttggtgattgaggctataaaagccaagaactgacaatgtctttaagaattattttttaatataagaggaagaggcaggcaaagcatccccctattcagcaagcaagagaagggagattagatttttttataaatatgtaatatatgaacattacatatcattatatataatatgctatatatactattttaaaaatatttttatatataccatatataatttataaatcctgtatttttgtgtctcagaaatggcttttgatttttccccctaaatttttttttttctgagatggagtctcactctgtcactcagtctggagtgcaatggtgtgatctcagctcaatggaacctctggtccaggattcaagtgattctcctgcctcagcctccctagtagctgggattataggcatgggccaccacaccagctaatttttttattttcagtagagatggggtttggccatgttgaccaggctggtctcaaactcctgacctcaagtgatccacctgcctcagcctcccaaagcgctgggagtgcaggcgtgaaacattgcacctggccctctacattagtttttgacctatatttaaagacgatctctgtgagggggcatcaaatcagtagtcctttctgaaaaggacacatttatttagagaactctggagactactgagcacatcaatggcttccctaaatgctggactcacaaacccgtcacaaggaagtgtggactttctctcccaatctattatctggtaacttctgcaggaagctatgtcaatggtagactaggctacagaagcggaaacaagctctcatttccatataatattatgatgtgatatacagtttgcataatacaaatgccatcattggttagatttctagagttcgtggtggaaccaaatataattactaacatttgttcaatactagcagtaagcagtaagcaaggcaaagtgggaagcatttttcatgtaccaaccaacttaatcctgatgacaaactgcaaggcagatagtacaactatccccattttatagctagataaacttgggctcaggtaggcagaataacttactcaaggtcacacagcttgggagccaagctttgaacccagacaatgtaacttcaaaacctgggctttaaacattataaaatattgtttcctttggtaaataaaagtcctgggagtattatataactcaatatggtattgtaaaagaacgtacctcttgtttctgtatgtatcagtacatagcaaccataaaatgctcagcatagtgtctgacatagactacatctacatctacatacaaatcactaaatagtaactgcagttacagttattaccgcagcaatagtatgtattgcttgcagtacatatattacttgctacgtatactctctgcagtagcaagtaataacacaagcttaggaatcaaatggacttggatttgaatccttgttctgctacttactgggaatttgacatctatgagcctcagttactttttctgaaaaatgtggctataattactttttttaaagcagaagtaaaacaaattttaggtacatatatgtagtatttacatatatttatatacatccatatccataactatattgtgaatgtgaatgtgtactctgtatgctctgtactcagaataggaaacgaagatccagagatggcttgaccacaatcatcatttgcaaatggcactgaattcaggtcttctgtattcaagctcaaggcctttaaatgcaggttgtttactatcaaattacttttattcctatggaattggtgaagtttattttacaaagaaattccccttactctgtctgcctcacttcttgttttttcaaaaggtagtactttaatacctaaataccttcagcacaactttgtatttctttagaaaggcttgaaagctgttacaagtgaaaaaactttaatgtataacaattccaacattatttttcttaatcattcacaaatataaaagatatatagtatatttgatctagctaggtaaaccatatttacatcaatgtattctaatgtttctagttgatgtcataattttaccaaatggattacactgaggctgaaaaatgcactatttgtattaaaaacatgttcatttgaacatggcattgcataaatgccaactttaagatctagggtaattttaaatatcttatgttttgttacttttctctttttaagttatagctctctttcaattatccttatcattggagaaggcaaattggcacagacaacttagaagagtggataataatcaattcccagactattatatttgattctgcaatatgttgggctgcgtagtgccaaaacaaacagtttaaatgtaaatagctcagttgagtgacttatttggtataaaatagatttttaaaataccaggttgtttagtaaatttaactgagacaactattcttgtaaggtttctgcttttttttttttttttttttgtatatttcctttttaatgtatggctacttttgttatttgcattaatttatatccttgattatacttaggctgaatagtgagagtaatgtgtttgctgagagagaaacagttgcctaagaactggtgggaaatggtctaggagagtaaagtgattggtggaaaatcttcattttaaagaaaaacttctgccaacttttatcattttttctcataccttctgcttgatgatcatctcgttgatatcctcaaggtcacccaccatcaccctctgtgattttataacttgatcaagcagagaaagccagtcggtaagttctgtccaagcccggttgaaatctgccagagcaggtacctccaacatcaaggaagatggcatttctagtttggagatggcagtttccttagtaaccacaggttgtgtcaccagagtaacagtctgagtaggagctaaaatattttgggtttttgcaaaaaggaaaaaagaagaaaaagaaaaattagaaacacaagctaaagagccaatttcaataacaataagtcaaatttaattgaagagtaacaatttgagccaaactcttattcatgacattatatatctttttctaacaatgtggatactttgtttagcaatacatggtagaaaatgaaaagattcaaccttttcattaatatacatttaacaattttttaaaaaacgattttgctcattctcatgcctggacaagtaacttaagttaaataagccttctcagtaacaatcatatacattgtggaagtggtaaagaaaacaaaagttttcagaccttgccagggaaataaattttacttattttttttttattcaagaaaaaacaaaggcaaaacaagatgggataagatcttctttctgatttaaaattcccttgaataggaagtaaattaatttgaagctggaccctagggaaatcaaagccaatgaaacgttcttgtcttagctctgtattttatactgggagcagtttatcatatttttttctttttatttcagattgttagtaaactggccagcagtgaagaaaaaccaagatacaatattttcttaaaaatgcgagttagtagtttttctatttagacatgaaatactgtttcaaagtcattaaataaatcttaatatgaatagtgttggacactgtagagtaagtcagcctatggtaatggttaagatgcatagtactagaattaaaatgtctggtagacaatcctgttctctgccctaggaactctgggaccttggtaaagccacataacctctctaagtttcagttctaacatttgttcagtactagcaataagcagtaagcaaggcaaagtgggaagcatttttcatgtatttaccttaaaagaggaataataacagggtaaatgtcataagggcagttgtgtagattcagtgagtagtacaagcaatacacgtatgacaatgccagaaagagcagcataatcatcatcatcacaataatattattacagcgcctgacactatagtaggtgatcaatagtgttaggtattactgtttttataaacgcctggctagtaagaaacacagtgatgaacaactgtggtgagaaactggagataaggccccaaaatgtgaaatacttggggagtagtcagtcaaaagtccgtgtgtggccctatattgattgaagagggctgaacttgctggtgtgaattgatactaaataccaacacacagctgggttatcagaggtgagtggtgaggggaaggaatgcctaatcaagtttatagacaacagactcaagagcataatataaccagaagattggtggcaaaattattggactatgtagtttggaatgaaaggtttcaaggaaagctgcaaaagacatctcaacaggagactcacactggacaaccagtgaacgattctaagaatattaaaaaaaaatgagacattgaattttcattctgaggtagccaatcattaatttttatggctatgtaactgtgcttttaaggttgtctcctcattagagaagaagatgagtagaatggaagaatgtttcttgtctctcaagcttctcagggacaccaagagttttctatgaatgaaggaactaattttgatcaatgcagacagaaaaaaatagtgttttaattgtcagagagaataaaaaaatttgtgtcacgaaacaatgattgaaaggcagtaacagtgaggcaataaagaaaaagttttgtttctcaaagctatctgactactctgaggctctttctagaaagaattaaatgtaatgtaaagaagaaatagcattttgtgtcacagtccaggagaagaaatcatggaagcaaaaagatctagaaatcttaaaagggattccaggaaaggagctaaatatccagagaggatgcatgtgtgaggatgaaaagagagctaaattaaaatatcactgtaggaactaactgcagaacaccaggctgactggcaaatgtggatggagtgttcctaaaatagatacacaaggtatactgaggcaatatacagcaatttaggaggatttcaagcttatgggaagtgtcagaaaatgcttttttaaaaagtgacttattgaaaatttgaccctcaaataagagcagagacaagagattttttttttttctccagacttacttctgaccatgaaagaagtacctaatgaggtggaaatgatcatgtcacactaaatttcaataaagtgaaggatgaggaactagagaattatcagacttcaacaagcagaccactgtttcctgaaaagcacgtttggaaaaagacagaaaggaagaaggaaagaagaaagtcagggagggagggagggaggaaggagggagggagggagggagggaatctattgaaaagcaaggcaagacaaggcaggaaggcaggaaggaaggaagtcaggaagccaggcagtaagggaaggaaggaggaaggaatctattggaagtctattgaaaagcaaggccagggcctgagactcaaaaagagagaatggttcatgatgactaaatatgccattgggatgataaattagctgaagcatattcagaggatgatggagaggtctagcaatgcggccatccctgcgccagtcatgggcagataatctcatctatagacccgtcaggccagtatttctggtcttctcttctccagcatgcaccacctgaagaacatctatctgtacactgctgggaaagggaggggaaaccttatcagactttctcactgctctatctcttgcatcttgcacatgtcctggagtataggaggtgctcaattgattccctttgaatctaaagaaaagtcaatgtgcagtaagctctttagtgaacttagaggtcttctacatacaatgagtactaaaatttaacagccacccattagaatggaagaatggaggctagaacacaaaacatgcctaggtttttactagttaggtgattttagctattttcacgagaagataatggaggaagacccactgcttggagcagacaatgaaagatcaaatattaaagagagaaaatacagccagtcaatttatttgcccccaaccccacacacatacattttttttcctatcgaagggagaaaagcaggaaatagctctgaatcagaaagcagggtgtagaatatttaggctttctaggaccagattgttgtatttgaatccttgctctataattttttttttttttagctgtgtaactatagtcagatgacttaacctctctgaatctccatttactcctctgtaaagtggcgattataatagtacttccttcatagacaactggccttactttttcctaaatagacaatcttggaaaagtaatgttcactgacattggaggcatcttgaggtaaggaattatactatgcctgctacaatgaacatcttgaccctcaaaagttttcacctgtgtaactatgaaaacagtaccaatctaatggaattgtgttacggattttatgacatcatacatgtaagtcacctcctaggattgttctgactgtaagtacactatgtggatttttttcttcctctttttcctgcatttctcacacaatggttattggctcctcatgttctacattcgtatgggattttatgctctgtactctgaaccagatttgaccctccagacttacctctctccattctttccaggctcctccacacccatgtctattgtgcattctctcatgagcacaggccatttcaaacctgtgtcctttcatacgctttctatacttcttgaaaactttttctctcctgtttccagacaaaaatctcattttctctttaaatgtcaactctagatttctgtgttttggggaggaccagaataagaagtgtgtaactaaaatatctccatgaggaacagaattacacctttcttgtgggtcctaaacactttttagtctttaacgttttcttacttaaatctagttatcactaggaaggacaaaatcttgcaccactattaggttttggaggattttgaaagtgtctagaggatagctgatagtagttgagagttggattctaaagtcagaaactttgggtctcaaggaatatactttaaaacataaagaagcaagaggctaatcttcatcgacctctcacattagagccatttctgttcagaaaaacattacttaaaatattttatgttttctaaaaagacttgcctctggattcaggcatgtatatatttttttcattttttaatcaaagtgtttcaaaggacagaagttttgaagtcctgaaattttttttttttttttttttttttgagacagagtgttgctctgttgccaggctggagtgcagtggcgtgatctcagctcactgcaatctctgcctcgcgggttcaagcgattcccctgcctcagcctcctgagtatctgggactacaggcatttgccaccatgcccaactaattttttgtactttagtggagacggggtttcaccatgttggccaggatggtctcgatctcctgacctcgtgatctgcctgcctcggcctcccaaagtgctgggattacaggcatgagccaccatgcccggcctatttatcttattttattgtatatatcacattgattcttactgcactttcagatgcgtttacctttatctaacacatatgcggttctttcttttccaccatgtcatagtactagaaatatatgcaaatcacctttttcagtgaagtgtaggctggtcagatttgttagtggttttgtacagtctgagcaacctgttcacagttctaagggtcaggcagggtcgtattgttgtgccaaggatatttcctgttaagtcaatattttaaaagactgaaagaggatttgttttgctaagagtgcctgaatccataatctagaacgaacgggtaaagagttaggatatataaattattacatagaattttcaatgatgttctgggctgggtctcctgttgtcatccctaaggagcatgggaaatggcttcccctccagctggcggaaatcctttcccgtgtaccctatttaatcttaaccccaagtctgttcatgcctgggcattcaccccgtttcttatgcccctatcttgggttacaagaagctggctctggtattagctggttcagatctcagcctctctaaccacctcagagactaagggtattcttctcaagtccattggaggaattgtcttttcctgcctagggtccttactgaaaatagtctttctgatgttatgctattaaaggttcctccagtaacagatttgggtgggttttgtttgtttgttttttgctcaatcaccttatgccagaaccagatgtattacaatgtacaaaattaaactgtatatctaggtagacagatagatacacacattgtgtgtgtgtgtgtgtgtgtgtgtgtgtgtgtaaagagagacagacagagacagagcaagagagagagagggcatctgaatagtctgaggacatactatgtagcataatacctttctcatgcattcattagaaaattaaaatgactctactaaaattgtggttttccctccatagttaagcagacagaaaatcaagctcaaaatagttgaaatgaattgagtttggcacaccagaatggtagcatgaataacagtaggtgtaatatactattgcaaaccacagctttgctctgagtattttgttaattaaaaggtgttggctttaggaaggaactcttatttttttcaagtgtttgaagaacacttctctagtctgaaaatttaattggtttcaggggtacatgattagtcagactaacagctttacttagagctttaaaggagctactaaatcttttaaaacacacacacaatgtgtttggcatatttcctttgaagtattcacacatggttttcctgtaattcacaggtctcctttggttgataagaaagcaagaagcacatactctatttctagctttgttgaatgaatgtgggtaactttttttgtttgcttcacttttatatttgaaaaatcactcaacttacaaaataagttattgggctcacattaacaattctatgagagaatatctaaaaagtgctgttagatattcccttcctccttatcattccatgtcaacaggagagcaatgttatatgtgatcaaattgcattactatttaatactatggggtataagaaagattgttagcgacttccatctcactagtagataaaataactctcctccatgtaagcaacattggagaatattttctttttgaatatttgaaaggatggcatttggattaatgaattccgtaagaattcaagagaacttctgaagaaaatttgaaatcatgtctagattctaagaaagacaatctattgtgtaggtaaggaagaatttcatgtcttccctctaaatatttacagtctgcacatacaagttggaaaattagaaacaaacactatgaacacataaacacttatttttgtctgctttcttttctgtcactctaaagagtaaataaaatatatgacacacctaacatcaataattctcattttagaaaaataaatgcttgtactctacataggcaaggccggagtactggaactcaaggattcatgataaccatttgtatttctggatttaagaaaaaaaaatgttaagtttgggagctatggatttttaaagcttaatggtgctatttgcttacattttaatagattctttcttgctattaaaaatataatccaaataaatatttgctactacttacaagtaagataattgccaccaacactgccatcacccccatcatttactcagtgattcttatgtgctaggcaaggttcttcataaaccctcttttatttcacctttaccaaaccatcttcagggtagatgttatcatcccccttttaccaaggtaacgaaacttgttcaggatctcacattaacaagtgatgtttccaagacaatgtgcttaaccactgcacatatttctaagaatcataggacatcaggtatctttcttacatgtctcattcaatatgcaagaattattaatcactcaaatacttctaagagctatagcttataatatatggtatccatgaaatatatctaatatccattttaatttgggagagaagatcatttgatatagctataaaaatatggattgtaacaatcaagcgcatctggcatccactcacaacttaaatattacccttgagaaatatctccaacctgactttaaacatatccttccttcactaacttgaatagagaaataatcattgccttttcctgttttagttggcatcatctaagtgcccttctataactaacattatatgaattcatctacatgcgctcagtgaaaagcagggtttctcaatctcagcactattgacatttttgtcccagataattttttgtcgtgagtggctgtcctgtgcattgtaggatcagaattgcttgtcagtatctctggccagagctccctcctagatgtacaaccaaaaatgtctcctgacattaccaaatgtctcctgaggaaagaaaaattgcttatggttgagcatgtctcaattaaaaggattttccatctctccctacccacccacctctcaaatagctgcttagaatttgtgctggaaatcatttatgcctatccaattttttttttctcattcctcagaagtagaaattaagagaaattgttaagggcttctctttccaacatgatattgggcaggcactgaagtatccataagtaaaccacaaacttatggctgccaaggaataataaataatattacacaggaactgtcttagtgacaaaaatgacaacatctctgctggagagtaaatgtccacagattctcctcttgcatctacacttttgtcaagagatattccagattctcccattaagagccatagtctgtttctccactccttgaatatggattggtcaagtcacttgtttcggctaatgaggtatcagcaaacatgacataagcagaggcttaacaatgcttgggtgttgggctatgcttggaactcttccaccgctatggaactatgctagcctgatgaataattacaggcaagtgatcctgtcacccacaccgtctcaacttataaccaaaaagttataccagacatatgaatgccacatgtggtcatcaactaccagctgaccacgagtgcatgaatgagcacagctgagtctagcaaaagaatcgcctcgatgaaccaagccccaagcagaatcaagaatcatgagctaaaaaaaaaaaatgattcttattttaagtctctacatttggggtagcttgttacacagcaatagatagctgacacagcatccatttttacctgttaaacacttgtacgcaaaacaggatttaaaattcccttcccattaccacagaaattaaaagaaaaatgcttatccagcagagagaacacagctggaaaagacggagtctttaagttaaaatgtggaatggaattccacagagaatggaagattcacatagtcactctatgaggtcaataaatcaggcagccagcatttgacaggatatttgaagaaagtaacacttttagcagaaactcactattaatgcactaagacctttgtatatgaaaaaagtagagtatgtaataataagagccaagaagtaggcagcccagtgcagaagacaagggaagaaaaagccagatgaaaccataataaagaccacgctattgatgaagggtggtcatcaattgcaaaactgatatcagaataaaatccatataaccatttgagtataaccagctagagaacattgtgtagttcttattacagaaaatacactgctattctaccaaaattctgagcaccttaaaaaactcctgaattaaataatttattctgatttgggtttgtttattcaattttttaaaatagagttcctcctacctgaatgttagagacaagactctgcagtgaaaactaagcaaaatgaggtaagcagtgttttctacagaattcagtctaaatctcttatttgtttgggagagctacgttttcaccttaagcagaaaaataattagtgatgtgttttgaaagttgttatataatgaataagatcctctaccatgtgtcaggccctcacaagcctcatccaccagaggagatgataagctatttgagataagtatcagaatcatcttttccttcctcacaagaccaaaggtctgaaaaataacagggtctcaatcaaaatttgttgttgttttcacaattagaatgaggtgcaagttgcaatgtactaagcagagtccttaagtgtaatctcgttctctctctaaatatatatatgcatatgtatatatagtctaaatatatatatttagagagagacagagaagttatataaattaatataacagagttatgtaactgtgatttacagtttcctcagagtttcaatctagaacttcatcagtgagaaaaaagaggaaccattagtgcaatgtaaatgcgacaatattaaatagtcttaaaatgtagattcttttggttcaaatcaattataatatatttgcacaagatctggacagcataaaaatgcctttttagtcattttctgcattggttcctcatcataccactctggtgtggatagggaaaacatgattactatcaatttatagaacgggaaactaaattcagataaattaaaatacttcttcaagatcaacatttagtaaattagatgaaaggttctgagaaatctgtattttaagaagaaaggctctgaggtgagtaattaataaggaattcaccaaaaacaattaacctgattttaaaatgggcaaggatttaaatagacatttctccaaagaaaatatatacacagccaacaagcatctgaaaacatactcaacatcgtcaatcatcggggaaatgcaaatgaagaacgaaaaccacaatgagatattacctcacaaccatgaggatgaccacgatcataaacagaaaataacatgtgctggcaaggatgtggagaaactgaaacacttctgcattgttggtgggaatgtgaaaaggtgtagccactatggaaaaccgtatggaagttcctcaaaacataaaaatagaattatcatataatccagtcctcaaaaaataaaaatagaattatcatataatccagcaatcccatttctgggtgtacggttagtccccaacttactaaggtctaacttgtaatttttggactttacaatggtgtgaaagcgatatgcattcattaagaaaccatacttcaaattttgaattttgatcttttctagggctagtaaatatgcagtatgatactctcttctgacatattgggttgcagcatgatatttatcatgaggataaataattgatactctactatgtactgtgttgcaagatgattttgcccagatgtactgtaatctacatgttctgataacatttaaagtatgctagactaagcaatgatgtttggtagcttaggcatattaaattaatttttgacatgatattttcaacttatgatgggctgattgggatgtaatcccagtgtaaatcaatgagcatctgtatatccaaaagaattaaaaacaggatcttaaagagatatttgcacactcatattaactgcggcataattcacaatagccaaaaattgaagtaactaaaatgtccattgattgataaacggattaaaaaatgtggtataggacacaacggaatattattactcggccacaaaaaaagaaggaaatcctttcctatgctacaacatgggtgtaccttgaagacattatgctaagtgaaataagccagtcataaaatgacaaatactgcatgcttccttttatatgatgtatctaaagtagttaaactctttagagacagaaagtagagtggtcatattgccagtgctggggtacagggagcaatgggagctcttcagtgggtttggagtttcggatttgagagatgaaaacattctagagatctgttgaataacaatgtatgtatagttaacactactggtttgtacacataaaacagttaagctggcaaagtttgtattatgtgggttttgtttttcaaccacattttttaaattatactttaagttctgggatacatgtgcagaatgtacaggtttgctacgtaggtatacacgtgccatggtggtttgctgtacccatcaacccttcatctacattaggtatttctcctaacgttatccctccctctgccccccaatcccccaactggtgtgtgatgttcccctcccccatctccatgtgttctcatcgttcaactcccacttatgagtgagaacatgcggtgtttggttttctgttcctgtgttagtttgctgagaatgatggtttccagcttcatccatgtccttacaaaggacacgaacgcatccttttttatggctgcatagtattctatggtgtatatgtgccacattttctgtatccagtctattattgatggacatttgggttggttccaagtctttgctattgtaaacagtgctgcaacaaacgtacgtgtgcatgtgtctttacagtagaatgatttataatcctttgggtatatacccagtaatgggatggctgagttaaatggtatttctggttgtagatccttgaggaatcgccacacggtcttccacaatggttgaagtaattcacactcccaccaacagtgtaaaagcgttcctatttctccacatcctctccagcatctgttgtttcctgactttttaatgatcgcctttctaactgatgtgagatggtatctcattgcggttttgatttgcatttctctaatgaccagtgatgatgagctttttttcatgtgtcttttggccacataaatgtcttcttttgagaagagtctgtttatatccttcccccactttttgatggggttgtttgtttttttcttgtaaatttgattaaaccacattttattttaaaagggaattcatagaccaggtgaattgtggactttttaaaattcccttctgagttaaggagatttaaaagagatttttttgagtactataataaatatcatcctgtaaattccaatggttctgatatattaaggcccagtggaaaataatcgatttattttatgtcctcactactcctacttgcatcctcattgcaatatttgtggggtaagcagaatatgccagtgcctctctgtagtggatactgtaatgcttcatcaagatcctcttctggagtcgatgcacccacactaccaatattattcctagtatttgtggtgtggttgcattgactccagaataataatatctacaaaaggatcacagctgcatttctccctggtgcctgctcttggctagtgcaaagatacaaaagtctcgcccatttgcctcaatttggtagaactctgaaagaccatcccagctccagtgtccctgtcacatgggctgaagcctcagtagcaactgcagtgtggatgagcttttctctctgcccaatactgcctccttcacttccttataaatagcaacaatacttctcaaaatactttctgtgtgcaactttttgtctcagagactgttgccaaggaatctcatctctgacaccgtatctctggtctatttacgtaatagtttgtttttaatacatagaagtaatatgattttttcaggcattcgatagtagaatattttttaaagttaattataagccaggcgctgtggctcatgcctgtaataccagcactttgggaggctgaggtggtagaacacctgaggtccggagttcaaggccagcctgatcattatggtgaaaccctgtctctactaaaagtacaaaattagccaggcgtggtggtgcatggctgtaatcccagctacttgggaggctgaggcaggagaatcacttgaaactaagaggtggaggttgcagtgagctgagatcatgccattgcactccagcctgggagacaaagcaagaatcattctctaaataaataaataaaaagttaattatttattggtatcacatgttatataattcaattgaatgctctaaaaaatgacaaaaagtatgcagaggattgttggcatatttattgtttaagggcttataaagtagttttacactccttgggtatatttgagtttcaatgtatcatcagagttgctgtttcttatgtgaaatatgcacacttcctgtaactaaaagacccatgagcttgacaaattcaactgctgaagtcttgaactccgtcttcataatgaccttggaaatgtaactgctatcttaagttggtttgaagtgactgtattgaactaaacttgagttttaacgttctgggtcagtaaacatgttatgaattgcaggtatggaaaacacactaactgaaatagtggaactagctacatcaaaatcaatttatgtttttatttaacttgtagaaaaccatactatgcccagaagtgcgacaactaccaaccatacaaaagagatcaaaatcaaggggagaaaacaggtaacacttacgtaggaaaaattgcttgttagaagcacaacaaataaaaatttggtgtttgtttctttaagacatccctgccaaaccatctcaaattctttttgaacgtatgaaaggtaatcataaataaaacatggtttcagtggttttaaattatgctattgaaataacaatgttcctcagagcattagcatgacagttttgatgcacatacttcctattgtcttggacttgaatctcattgtcttaatccttttgatgaatgggtttaaaattaagagtgtaaagagtgtatggaaaagctgtgagcccacagtaaatggtttctgaagtagaaacatatccaactctgtttattcagaaagatctgtgaagctgtattattacagttgcttcattatgaacttatttttgctgcttacaaaggggaaatcccatcagatcagggctaagataattcctttttaaacaatcagtaaatcatatttaaaccttgtttacactagtactttttccatgatggcgttgttttacataaaatacatgctttcaatcttgttaaatttgttaggactcattttgtggcctaacatatgatctaccctgaagaattgtttcttgtgcacttgataagaatgtatattctcctgctgttagatgagatgtactgtatatgtctgctaggtctatttgatctaaagcataaagtccaatgcattcttattgattttttaatgtggattttctgtctattgttgaatttggggtagaagtcccctactattattgtactgtagtttgtctctttctttttatcactttatatttgctttatatatttaggtactccaatgttgggtgcatatatatttacaattgttataccttcttgatgaattgatccttttatcattatttaatgaccttctttgtgtctttttagtttttgatttttaaagcctattttgtctaatagaagtatggctatccccattctcttttggtttccatttgcatggaaaccaaaatatctttttctatctcttctatttcagtcaacatgtgtcctaaaagatgacgtgagtctcttatgggcagcatgtagttgagtcttgttgttttaatccatttggccactctatctttagactggtgaatttaatccatttacattcaaagtaaatattgataggtaggaatttactactgccatttaaaaagttgttttctaattgttttgtagatcctttgttctatatgcctttttttgttgtcttcttttatggtttgactgttttgctcagtagtatactttgattccttactttttaccttttgtatatctactataggtttttgcttttgctactataggtttttgcttttctttacatcttacgtaagggttttttaagctggtaataacttaactttgattgcatacaaaactctacacgcttacttccctaatccacattttgtaatttcaatgtcacaacctatatcttctttataatttgtctcttttaaccaattattgtagctataagcacattgggatgtgagagttctttttagtagagatcacacaaattttgcattttaaaatgttacttgaaaataaaattttcaatgaagttatatttaagattcaattattccaaggtaaagttaattacaaagtccagaatggaaaatcatgctatttttttcattagtagaaaaataataatccttaaaaatgatgtttcttttttcctaagatatctagataagaactaaaagtaaaatgtatttcctctactgtaaaattacaatctatattaatccattattttaaaacaaaaagatacgaagggagaaaatttttatcaagttatgttacaaaatctctagcttattgcatgaaattaaaccacataaaagaaataataaacctaactgaaacaacattaactcctatctagggtttatcaaactacagaaaacagaaaggaaaggaattatacatcttgagaaacataactactaaatactggtggaaactatacatgtgcatagttttgaattggtaaaattcttcatttttgccctgtaaatggtggaaagaatgaaaaaagtcactaaagctctgtttcctacttttgtactaattcaaaggcatgattatgctatacttaataactatttctacttaaaaattgttaatcattgtgattttaacacctaatgtatatattttctgtggaatacaagaacgtgaacagaggcaaagagctaggtagaaagaccaatttccaaagagaaagtagggttagtttactactgggggcctcacattcccattcaatctgacgtaaaagtggaattgaagggcatatgggctgaagttatcagagactgtattgctaaaatggataatcttcccctattgacaatgggggcctgtggctaccaaaattaggtgacttgaacagataaaaccataacaagttcggatcctttcatgcatctattttcaaaaatgatattttggtgattagtgaatcagatttattattatgataaaaatgagtaagtaaattatttataaaaacgtaagctatcaaaaacttagttttcagtgccatgaaaatataggttatagtaacttgtgaagatcttcaggaaggttaatttatactgtacattctaaaccatagatgctacatctggtaatattaagttgggaagggatttatctgggaaaacaccatcatttatcaattaaaccaaggcagaaaaggttgaatagtttgcccaaaacccccaaaccatagccaacaagagatcaaatgaggactagatcccaggtttattaattcccaatccagtgatcttttaacagtgcctggtttacaatatcatgagcatgcttctgaaatattaaaaatgttacgtctctatataataactttatatctagcatgcgtagattgagaaaaatagtgacaaaatcaacttattctgaattcagtaatattgtaatataattttgcatttattaattgcagtagcatctacatcacttaaaaaatgtctactacatgtttgtgggtaatgcatcactcctttgattcacagacaacacttgaggtggttgtggatttgagaatttctttcaatggtcctgggaaattttagctatatccagcacacaggttgagaacttctataatgttggtctctgccttgcaacattactcttaaccaaatatctttaaaagtcgtactctttactcttagagttgatttcagtttcattgttgccaaacaatgatatctcaatcatttgacaatgggttgtggcatagatataaaatatccaaattgtctaaatatttttatatttttttataaattagaaccaactaaaggttgtcaatataagagtactctcgcattccaaagtgcttttctgagtgagagagggtgcacagtcagaactagtgtgcttgaattttgctatttaacttcattcacctttacatatctgtagcccctgacatgaatatctatcttcaggcaagtgagtgaatattgccaacatctgtgatgatactggtaggatagggatgggggcaaaacaaaggttgaaaaatcctatatgaccatatccaatacctgaattctcttccactttacttacagaaagtgatttcccactgcttaccccaaaagtacacattgtgtcaaactagccagtctctttatgtaatacccaatatgctttcactctttacaaaataaatttatccttgttgtttcttagacttttttttgcacccattttattccttactaatgtctacgatcacaatcttctgtgaagtctttgttgacaactctagttaacccatacagtcttctttccaaactcctatgttgatttcagtcttacatatttatttatattattatttgctatctcaattgtaaaattctacaattggaaggaaattatggaaattccaatgctgaactttaaaatctttctcctttgagcattgtaaatcttagactgaaatgctttacatataatttagtagatgtttaatattctcaagaggtatgcctaagagtctttgcaaatcaaaaagcagatttatatgatctgatagtcttacttaggagttaagggattcatccctgcccagtagtttcccagtacatgaaattagtactggaggccttccttacatgttagaaccacccaattacccaataggatcaatgctattaaacacattagaaatcactacatatcatggacctttagaaagcaatattttatcacttcatatgagttatttagcttaggacaatgttttgccatttcttatttagattatgagaaatgtcacatctcattttaaaaattatttcttagtatatcacatcattctgattatctgcactaaagcaaaatcttccaaacataaaggagttttcaaaatatgttctaccattagaaattagcatgacggctgtattttcatttaacatattttacaaaaggaaataataggttcatgaatgagaaagctgttttctgtcgtgtctttgataatctgaatttagtctaacagaatagctttcatttaagtattattactgaataattactaacttagtaaagggtttatacctacttagtaacgaagcaggatatttccctgacccctttgtggaactcgcaacaggggtgccttatttacttagcccactgctctcaactcctcactggagggagtgtgcaagcaaacgaggtgggaactggagtgcatgagcactggagcagcatctaggtggaggcgtctgcgacccctgaagccccagagggtgtgttacagtgctctgttagctctgccatccacggacagcttaggcgttaacagctcagtgggccatttgtcttttcacaggaggcagctgccctccaccagcaagggcaaagggccttttgtattcacacttgtggctcctgagctcttgtccagcatctagggaaaatgaggtcacatgaacaaattgaaggattgtaaatgtgagggattgtactgccgatgaaagtggctctcagtgggaaggggagctgaaaaggggatgggggtggcaagtaatcttcccctgaagtccagccggattcttctctaaagttatgccatcaagttgtccctctgaagtcaagctgcttctctctgatgtccagctgtagtcctgtctaccagctgagtctggggtttttataggcacaggatggggtggggtggggccatgggtggtttagaaaaaggcaacattcgagcaggaaaactgggatataagttcccactttgagctgcggtttcaggctttttggcttgagggtggggttttcgctggggaccatcccttttctgcctagagcttctctgcctcctgccgctatcagtacgagagttgtgtaaatgcctatattgatacaggtgctcctcaacgtacaatgggattatttcctgataaacccatcatacgttgaaaacatcataaattgaaaaacccatcataagttgaaaacatcataaattgaaaaatgcatttaataaacctaacctactgaacatcattgcttagcctagcctaccttcaacatggtcagaacacttacattagcctacagttgggcaaaatcatctaacacaaagcctattttattaaaggtgttgaacatctcatgtaatttattgaatactgtattgaacatgaaaagcagaacagttgtatgagtacttgaagtatgatttctactgagtgcatattactttcacaccattgtaaaataaaaatatcctaagccgaaccattgtaaatcaaaacatttttagattgggaccctctgtatatttctttatttctcaggcccttgacaaaaggagataattgaagcattcttatttttattaaacagtgaacatatgtgctaacaaaggaaaattatattcagagaaatcagcacttgcccttgtattacacaggaagtgctaaaagctttactctttagagttaaatgctaagaaatttagattggtataggttacatacaagttttcccgacaattctatatcttgaaaaaaaaaatctaacattgtattatctgagactacagcacagttggactggtttagactaaaactagggtaagggaagtggtgttaaaattgattgaagattatagtatacgtctaaaatcttgggcatcattaataaagcccactctacttggacttattgctctattcatatcctttctgaaagataaactacctcaaaattcaggacccaatagtaatatactattattgcggagatgccatgaaacattcctggggctgtgatcgggatgattgagaggagcgctaaatgctgaaaagtggatgtgaccagggaatggcttagctgtttgccagtgtaaaaaataacttgatatcaacattaagcagcagctgaagaatcttttaatagtttaggcactttttctaaatccttcagttatgcttcaccgattaaattattaagaacctctgatctagctatttcatattttagatgtgagtgaagatgttttgaaatcattttcattgttcatggtttcttgttttttaaaattaaacctagaggacgctgagataatctctttttattaggtctgcagaaaccaagaatacaccaaatgctgaatagctgcatggaagtatcacttgccttgacaatattgtattatgataagctagttcctcttttttttttttttaagttgagctatatagattccaattaatgttgttaaaccaattgtttaaaaaatggccagaggcttctactggcttttagatggaggccaagatatgattgcgtcaaagatcaagataaggatcagaaacgaaatttaggaagagcctcccaatgtgaatgactaaattgtatatgattaacttttctaaaaatacttctcgttgtcatttagtttataaatagcttgcagataatattgtcttcctataggttcgttgaacaaatattaactgggtacctttgggcccagtgtcaccccaatggagtgaatattgttggtggcttaaacaacttccattcaaagatatccctacacccactctgaaattctgctttctaggagaattccaattgtcttcaagtttctacggaatccatcctcagttctggagatggatttagattcacctaaatcttcgattctaagccagtcaagataatctcatcctcttggttcaggaagaaaagtttaaatcaaccagcttatgaaaccattctgaatcatctttagtacaatagtagatatatatgaatacctaatacatatactaatgatacagtagatacacaattaaaattttgattgttcttatctgagggtgaaatctctgaatctgtgaggtaagtgtttatgtctctcactgtaacaagaaattatgttacccatttgttgctggcagtcatcttggaacctggagggcaactagtgaggaggtcaaagctgacgcagagaaaaaaatcaggacaaagaaagtcatagagaaagagtgacagagctctgcttgtacttcatctggagccagctttaacctctgaacttccagttatgtgagttgaattattcttatttttgaagccactttgaaagtgcattctctttcttgcagcccaaagcatcttaactattaaatatgtcaccagggtaacataaatatgccaacaattaatctcagtaaaatattatgatacttgctgaaataggagtaaattttaaaatgataatatggagagagaagcacatgcattcccctggaggactaagtaggaaaaaaggtacttacacaaataatattataaactgagaatgtaatggtaagtttaccaaagagcctattatgacaaatgtatttctagcaaaaggaagaatatatgttaaagtataaaggcagcaattggtgattagggagttacaaatagtttagtattacttgatttttcaagagagaggagggaagatgtaggaaataccctagatagactagtaggtaccaaatccatgaacggccttgtgtaccaagctgaaaaatttagcttttatcctagaagagaaagagaactattatacaacctttactaatacattatgattggcatgttaaaaagtgtagttttaatggatttgcagtgtacaagatgagctgagagacagaaaaactagtgaagaggttttgtagaagatgctatctgaatgaatgagaaaacaaaattgcagtgctaaataagagataagaaatttcaagcttatttgtcttaacaagatcgaaaggattggtaatttatcgtggggcttaatattaaggaataaagaaagtgccagaaaaacttcctgatttttaacatggccagtccattagattgtgtcattcacaaaaatagggaatatagtaagaggaatagattttcagaaaataatgataacatcaattttacatatcctgagttagaaatacctgtggaacatctacgtggtagcttgtcagcaggtgaaaatatgagtttggaattgaagagagaagcctgaactagagataatcattggcatagtttcagtagtcttaatcttagattctctaataaatggaattggtagtaaaattatttgaattaagataatgctatagttcagatgttgtcccctccaaatctcatgttgaaatttgatcctcaatattggaggtggggcttaacgggaagtgtggggtcatgggggtggatccttcttgaatggcttaatgcccttcctgggggcaggttgagtgactgctcattctgttaggttctgcaagagctagttgccaaataacagcctggcacttcccctctctctcttgtttatgctctctaaccatgtgatctctacacaccagctcccctttgcccttcaccatgaatggaagaagcctgaggccctcatgagaagttggtagtggtgccatgcttttttgtacagcctgcagaaccatgagccaaataaaccttccattctttataaattgcccagtctctggcattcctttatagcaacatacatgaacaaagacagatggtaaattttccgttatgtgctgtttgccacaataaaaaatttaaaaaaattgacaataagtacaggataggtgatggccaatcagccaagatgctggccatagagcaatgcagactaggaatgggttaacttccaggtgatattaacactgaagagggctaacagggaaaaaagtaaactaagtagaaatggttggaagtgaccacagagatcactgaaaaaccaaaccaaaccagagaatgtgcaatctcagaaactaacacaatagagaatttaaattgaagagggataggtgatccttgggtaagactatttaaaggcactgagggtgagattacagaaccctagcaaagggcaaaacagttaataaataaaatcttgtccagtagattaatactaattacgtcttaaattaatactcaccatgtgatgcaatttaaaaaacaattatatttaccaagaatgttaggtaaaatgtgcataaaaatagaattacttgacctaatatattaataatttgaactcaagaagcaaactatagtaagaaagacagagtagaaagttttcaagtcaatggattactgaagagtacatgtgacaggcaaataaacactggtagataaatatattaaggaatttggagtggcagattctttctgacatataggatgacaaagaatgtaaaaaatgaaagactggaacaaaaatcagaggagataagggacatataaagtgaaatataaagaaccaggaagatttataggtggtaagaattggaagtgaccaactggtttcaagaaaacaaagaatcttcagtgagaggagctgaagacaggcgtgatgtggcaacctccaaaaaaagacttaaagtgaatttttccgctactgcaatatttttttgttctcaaacaatatttttgcttttcttttataggtggaaatagtgaggatgatagtacactgaaaagacatttcatggttctgacattcaaattgtaaaatatatcgggttgaatgacaaaattacttcatcccccttttaaaatttctatggtacttttgagtctcaaaatcaagggaaaactaatacttttgaagctcatacagtttttgttctagaagttttgtcttttttgtgagcataaatttacccagtgggttcaggaagaagatgagtatttttttttttcaaagcaaacaacgagacagcaggaggttgaaagttctccacatggagttgtcactcaagcactgacatcaaaatcaatgaaaagtggctccagtcttgtgctaagtataatttgtagcagagaggaagttggaggcaaagtgtgaggagaagagagctgagaaaaatagatagtcagatattcagcaaacacaggggaaataaagaggaataaaccctaaagttggcaaaatgatccaaattccaaatggaatgaagtaaaaaaaaaaaaaaaagtggcagcaccatgtagtgcaaacatcactggactgagaatcatttgacaacagacactctgggagtctacttgatctgggcaccattctaggcactgggagtacagtggtaaatgtggcacaggcaatggcctcatggaatttatattgtgatatagaaaagagacaggaaatatacatttaacatcattttagattatatgaaaggcagtaaagcaaaacagagccaggaaaaaagtaagagagtgagagggttgcaagttgggctagggtctatgaaaaactagcccttagctcattatgaaggtttggatgagactttttatccctctaaatttccttagctcccctagctagctttgtctctggaacaagatgacagtttatttcatctttatttccatttctttacatacttcctcttttactgctactactcattctccacttctctttttcactcccctttggtactccttgtttccagaagactctgatccccagctcaagggttccttctctgtactgagtcttgctcgtaattatcttgtgtaacttcaggatttctatattgaacaatacgctgatttctatttctgccttcctcattcattcccaggtaatggggattcaatgaaaatcgacaagaggggatgttggttgtattagtctgttctcatgctgctatgaagaaatacccgagactgggtaatttatgaagaaaacagttttaattgattcaccattctgcatggctggggaggcctcaggaaacttacaatcatggcagaaggcacctcttcacagggtggcaggagggagaatgagtgccagcaggggaaacgccagacacttataaaaccatcagatctcatgtgaaatcacccactatcatgagaatagcatgggggaaactgcctccatgattcaattacctctcactgggtccctcccatgacacctggggattttggagattacaattcaaggtgagatttgggtggggacacagccaaaacatatcattctgctcctggcccctcccaaatctcatgtcatcacatttcaaaacacaataatgccttcccaacagtcacccaaagtcttaactcattccaacattaacccaaaagtccaagtccaaagtttcatctaaggcaaagcaagtcccatccgcctatgagcctgaaaatccaaaacaagttagttacttccaggatacaatggggggtacaggcattgggtaaatacacctgttccgaatgggagaaattggccaaaataaaggggttacaggccacatgcaagtcttaaatccaatagggcagtcattacactttgaactgcccaaatgatctcctttgactacatgtctcacatccaggtcatgctgatgcaagaggtgggctcccatggccttgggcagctctgcccttgtggctttgcagggtacagccccctcccagctgctatcatggctagcactgagtatctgcagcttttctagatgcatggttcaaactatcagcatttctgactattctggggtttggatgatggtggtcctcttctcacagctccactaggcagtgccccagtggggactctgtgtggagctccgaccccacattttccttctgcactgtcccagcagagaggttttccatgagggccctgcccctgcagcaaacttctgcctggacacctaggcttttccatacatcctctgaattctaggcagaggttgcaaacctcaattcttgacttctgtccaaccccaggcccaacaccacatgtaagccactaaggcctgcaccctctgaagcaacagcctgagctgtactttggcttctttgagccacagctggtatgcagggcacgaagtcctgagactccacaaagcagcacggccctgtgcctggcccgtgaaaccatgttttccttttaggcctctgggcttgtgatgggaggggctgccattaagacctctgacatgccctggagacatcttccccattgtcttggcgcttaacatttggctcctttacttaagcaaagttctgcagccagcttgtatttctcagaaaatgggtttttcttttctatcacattgttaggctgcagattttccaaactttgatgctctgcttccctttaaaacaaagttccaatttcagatcatctctctcaagttcaaatttccacagatctctaggccaggggaaaatgctgccagtctctttgctaaagcttagcaacagtgtcctttgctccagttcccaagaagttcctaatctccatctgagaccacctcagcctggacttcatcgtccacatcaccatcggcattttggtcaaaaccattcaacaagtctctaggaagtttcaaattttcccacattttcctgtcatcttctagccctccaaactgttccaacctgtgcctcttacccagttccaagtcacttccacattttcaggtatatttacagcaataccccactctctgcagtaccaatttactgtattagtccgttctcatgctgctatgaagaaatacccaagaccgggtaatttataaagaaaagaggtttaatagactcacagttccgcatggcttcagaggcctccggaaacttacaatcatggaggaaggcaccttttcacagggtgataggagagagaatgagtgccagcaagggaaatgccagatgcttataaaaccatcagatctcatgagaactcattcactatcacgacaacagcatggggggaaacaaacccatgattcaattacttccccctgggtccctcccacaacacatgggaattacagggattacaattcaaggtgagatttgggtggggacacagccaaaccatatcattggtcaaagggcacaaactttcagttataagatgtctggggatctaatgtacattatggttactatagttaataatactttactgtttacttgaaatttgctacaagactggatcttaagtgtcctcatcccccccccccaacacacacacaatagtaactatttcttgtgctagatgtattaattaatttgattgtggtaatcatctcacaatatagtcatataaaatcatcatgttgtataccttgaatacatacagtttttatttctcaattatacttcaataaagctaggtaaggaggaggcagagtatgtcctcaagaagctcacaattgagtagggggaacaacatgaattcaaattgtcccacaaataaatataagatttggtgtgtgctctggaagaggagtataaatagtgccatttacactaacctagtttgggaggtaaggagcgtctttcctgagtataacatttgagctgagacctgaaaagtgagtaggtatgaggtcaaaaattcaaaaggatagtgtctcaatcagagagaccaatatgtgcaatggctttaaaaaacagaaaataagcactttcataagcaaaacaaaactaggagggaggtcaatgtggagataagagagtaagtagttcacagtatctggtataaggatgatgaaatggaaagggtcacactatacaagatcctgtgggatatcatttctttttttgaaatttttattttgagataaatggtaaggtactggagcattttaaacagagttctgtctgtcatcaaatttatattttgaattttcacacagctaagatgcataggagagaagaaatgaatgaggagagattaggtttggatgacagtattatttaacccaataacctgcatagtgttacaagtgaaaggtgggactattagtcactctgaggcaatgacataaagcatgttttctctaggcaaatcaagactatgatcatcctaatataagactactgtaacagtccaggaaagagatgatgagattgtacaggggtatgcaggataaatctaaaaatgaaagctgaaccaagaaatatttaggagcaaaaaaatcaactgaacttagtggtggatgtccagcaggggtgaggtgggaaggttttaagaatgacccccaagattttgttactggatagctaagtggtgctacaaaacctgaagaaaggaatatatcaggggaaggtcatgcatttcatagcagtaaaagatcatgagattatttttgagacatctaagtggaactgttgagtaggcagttaaatatgcagtatggaatacagaggaacttttttcatgccttaaagtcttctcctctttcagttccatttttcttattgttgtctttgggtcccctgaaaacagggcctggatgaggacttgggtacagatagctcatttggaagctgatccctaggaagcaagaatgaaaaaccaaaagagtgagacagagggggaggaaatgccaatcaaatgtattatcatcaaggtaatgcttatggaccatggggactgtattttgacagaacttttgtatgttcctgagaatcacagagaattccccttgcccccggaaggaatagtggttaaaaatatatccatgggctcccatctccattggttgaaggttgctcactcactaaaacttcaagggtgagaaagctcacaaaatctgtgggctcctgggatgtcagagaagtcccttagatagaaagtagaaaaatgggagccattcccttgacatgggatgctgtcagctaaaggcaagtctgaactcacacagggctgtccactgcagctgcaactgcagtgcaggaaaatggcgtgtgactccaggcaccaggggaatctgttacaattgtgatgataatcttttggaagcttttattttcttttacagtgaaatctgtcttatctatagatgattacatagaacgtacacataaagtgtgaagaataattataaagcaacactttatgtaaatacaaccccaatcaagaaatagaatactgctaataccttgaccccacccttgtgttccccacagcacaatcgcctccatctccctggaagtaaccattctcctgaatttttctccttttcttttctttccctccctccctccctccctccctcccttccttcctttctttgtcttcctctctctctttctctgtttctctctctctctctctctctctctttctttttattttttgagacggagtttcactcttgttgcccaggctggagcgcaatggcacaatcttggctcaccgcaacctccacctcctgggttcaagcgattctcctgcctcagcctcccgagtagctgggattacaggcatgcgccaccatgcctggctgattttgtatttttagtagagacacggtttctccatgttggtcaggctggtctcaaactcccgacctcaggtgatccacccacctcggccccccaaagtgttgggattacaggcgtgagccaccgtgcctggcctctccttttactttttacctgctgccttctccagcctagatgtttaggtgttcttaccctcgagacttcagctttgttttatcataacgctggttaactctggcatccatatttttagcctaaacttctctcctgactcatatgctcagttacctcagtggccttgcaaaactagatgtctaaaattgaactcacagttcccctgaaccctaaaatactccatagtttagtaatttctaccacggtctactcggtttatcaagccaaatgcctgggtgttctattcgcgttctctgtatctctccattttatgtccaatcagttaccagggcctgttgtttccacgtgccaagtatcacttgaatctgtctactttgtctccattccctttattacttctttagtttaggtcattattatctatcacctgaaccactggaatagcctccaaagttgctcttatccaatcagttacctattcttcagccagagtaatccctctaaaacccaaatatgctcatgtcactagtctctctacaatgcttcagtggctttcaattacccttcaaataaaatgtgtttgatttctctaacatgtcttaaaatgcagtttgcgaacatgcatgcatttccagcatcatctggaatgtcctccctgacacatcgctcctcacccattcccaaccccaactcagtgcttcagccatactgatatttttaaaacgtgctaggctccattttgcctccaactgttacttgtttctcttgcctggaacactctcccctacttgtttgcctaggtacacctacttatccttcaagtctcatcttcaaatttccttttttttttttttttccagaatttttcctctgacatcgctctgttgcaatactccagactgggtgaggtgattcttcctgattcttccctagtattctacatcctagtatttgtcacgtacagttatttagttttcttactttctaggagtctaggaatcacgcttatcttgatccatattgtatccctagaatctaacacacaggagggcacacagtaatccttaataaattatttgtcagattagtatattgataaattaaggatacaaatgagtaacctacagttaaagaaggaactgcaccagttaagtcaaatagtgtactggaaaatggcttcttatccccctgatggtgacatctcctgctgcctgtaactatataatttaactcttcctaactaattcattatttaaatgatagtcagttgaagtggcattatcatagctcttttctgctaatctatgacgctgctttgggagaccattctacctttgtacaagtatgccatttcaagtttcaaagaaagctgagatgtggtgtataacattttaatctcgagaactatgagcagtaattagatttcccataatatcgaaattattacttctacttaggtatatttaagggtacttcaatatctaaatatatgggacttatagtcatgagaatttagaaaatctaagacctagttatcccctttctttgtattttttgatgctgagataggaaaacgttatccaaagtgagaacaaatgttttaggctcgagtccttttatataactactactcatcattttttcaaatgatagtggaacactcttaagagttgtaccaggtatttcacatctctttattctttccatgagtggctttataaatgtccattctatgctaagtaagtggtattctttgttctgagtaagcattaataacactgctgatgataagaaatattttttcccctggaggaagccttaagaagattagggaaacacattaaacaatctatattccctttattagctacaaggaatctattgactagtatttatctaaaacaggggtcagtgaactacggcttgtgggccaaatccaaccaactgcctgttcttgcaaacacacttttattggaacacagccacacttatgcatttacaaactgcctatggctgctttgcacctcattagcagagttgagtaacttcaacaaagatcttctggcttgtaaaacccaaaatatttactatctggctttttacagaaaaaattggcaaaacttcgaccaaaaccttcttgaagtgacttacattactaacctatacctcccgctgaaacagtaaattatataaaccaataattgactttataaatatggattttttatttgcctcaaatcgtgtcttccaagattcaaatggcatcccctaattgcaatgtattatgatttggtgaataaattcttgttctcactactgtagttagaagaaaaatggactaggaatacgaagagaaaagattctgtcctgattctcctcttattcagtttcctcaactgcgggaatttataatcttcattcttaagggaaattttagataatatatacatgtaaacaattttattattttttgatcagatggatttcaatattttgttttcttcactctagggttcactaactacagtcataacttgtttcagttgatattcatgtgacagtctgatcaaatgtatcatttgttcagttattctgctacctccaatttattccttgagtgtgcatcccttggtatggcttattgctgacctcattatttctgcccacgcaggtctatccactcattcatctcaatccacttgcatccatggccttgctcacactgggttttactataatgcttcagatttatccagatgagaaaaataaattccagccaagaagcatgcttaagtgggacactggctagaggaaaggtcaacaatatccattatgataagtggtaacacctctgttaactccctttttattttacagaaattttattatcatctagtccagtgacttttagtatttttaaagcatacaacccttttttcaagtgagctcctaagaagaaatccggtatgtgaagcctaaaaagggcgagagcaacagactggttgaaattgcagatgggaggcaaagggaagtatgaacatatgttggaggaaactctacccttttgacggccgaaggggacgctttccagaagaggtgatgaactctatgtttctggtttgtgtgattgattgaagttccagcccatattcatttctacgatttcatgctgtaggcaattgggtccacttattcaccacagccaccgaacaaagaaaacactagaaaatactttcagagaatcaggtctgaacacaaaaaagaattttccaagggagtcgtggtgcccttaagattaaatgaagtgctgtttaaacatatttatttaattgattttgacttgcagcagggtgctggactatggtaccctatagattttccagatctactttttgtaattctgctgctgtactggctttttgaccttgaattgacagttacagatgtgggagaataaataaagctaagtagtaacactgtgggagaatcaagcctatcatcttaatgtctttttctctcctgattgccttctattctagaggagccaaaaaaagaaaagaaaagaaaagaaaagaacgtatatatttcttcatattgaaaccacttccgtaactctgaggttatagtattaagcttcaaaggtactactacttaaggcccaattccacccacggagatttaataaaagatttagatgtcatgcaaaacggaaaagaaaggggaagagagagtattgttgtttaatttcatttggaaaatatgtacaaaagcatgcacaatatggtagaattggtcctagagtatatggagtcttcattcatagactgcatgaccaagattcagtatgtttaacataaaggtaaaagacaggcatgaactttataaagactcaggttcaaggccatgctgtgcccacttagtagctgggtgtttttggataaccattctctctaggctttcatttcctctcatggtgaaaaataataataatgtagtacctatttcataaggctgctgtaagattaaacagaaaaatgcacaaagaatacttggcaaaatgcctggtacagagcaaggcattaatgcgtgttagccctaagataaatattaggtatgttcgggtcaatgcaaaagctagggggaataatcgaaatgaaagcaggtattatttttgaaaatggctatgataggcctatatattactggaatagaaccaaactgtgagaccttagagaccctccaggagagttaaacatgaagtgacaatgttgttttgcctgatttacatcagacttatgttgttaaagcaccccttttttcaatatgaagcatttattcacccagataatggatacaaatccatgcattcaaatgttccttggagtcagagatcaagatggaaatccccagaatcatagagatttgcgtctgtaaactggcttattatattcacattcaaagaggttggaaggggcagtgtcagctttttaactagaatcttttcattacttctccctgttggggttgcaacacatgctgtgagtgacctccagagattcctcaagctgtatgcaggcagcaaattgaatctgaaagctttattagacaagtttttcttgtctttcagctggtgggagtggatgtcagttgtattggaaaaaataaaacttcttgtgaaactgggtcctgaccttgaaaaaaaagctcaaatcgaagtgtacaattcaatcctgagttatgtgcttatttgttaaacagtgtgcaggttcaaaggaaaagggcatattttaccttaaagaaataagaatcaacaataaaaataataggagttctgttttgatcatgctgaacttagtaagcaaaagtgcctatcaccaaatcacatagttatgaaaagtatgctaataatcgaagaaacaattcccattcacttcagtatgacaagaaaactattataatccataatgaacattatagaacatttatttatattgtgtattcatacatttctttgagaataaagaagagtcctgggaaaatgaagggacattggagattggctagtttgttttatttcaatattgtctctcatatatacatataaaatctcttatatatatatgagtttatatataaatatatatgagtttatatataaatatatatgagtttatatatatatgagtttatatataaatatatatgagtttatatatatagtttcctatataaaaactatatagagatatagctatctgtatatataaccatatatagtgacatgtaatatatatataaactatatacagttatatgtctatatagctatatatatatagtgatgtaatttagttcctggtttttaatattggagaacaattatgagtttttttgaaggtgtgataattattccagaagtaggaattgaaagtagtataattttgactttttttttcctattgtaggtttatattgcaatttaagtgggtactggtatagttagtgctgctagcaattttacctaaatattaggatacctagattgtttgtctaatgaactcagcatgggctggcaagcactttggaaataagagtaaaacatattttcataaaaatactgaagatgagagaaggaataaaccttatgaattttaagaggaaggtagcatgtaaagcagaggttctcaaatttgatttcaagacacagtcaagaatgagggtttaaggagataggggttatatctggcctggaagatttgcatcaatgccatagaatatccctctttgatcagcactgtaatcttaaaaaaatagggcttactactgagattgtgaagatatatatatatatctgtcagctgtgtctcagcagggaacaaagttgagatatataagaatgctgaagagcactgaaattaaactcaggagatgtggggttgggtccagattctgccactaaacagctggtcaagcacgcgatcatttaatcttcttggtattattattattacatgggaaggttgatgtatttgatctatctgtaaaatatatgttcacttgaccaaaaaatattagtgcaatacctaccatatgctagtcattgaattaaagctagacacacctggtatttggcatgtaaacgtaggaaaagggtatatatagactttatgatgtgacagagtcatgggaagaccagtaattatggaacagcatccaattctgaagcccacaacagaaaaatagtatggaaaacacttggaagggtaggaggagggccacagagacgttaaaaatttgagaaacagctgttttgttgccagaccatggggactcatctgatttaagatagaaaagaaaagtgggaaggagattaaataacagacctcaaagaatgaacactgtcgaaatgtacagtaagcataaatgtatttttcctattcgaataaaaataatttagacagtaactggaacttaggttaggtagttgaaaaactgtcaagtatagcagattggtagaactccatctgctcttcactttttaagaagagagttggcagttacgcttctaagattgcttctaatagaatgagagcctttcctgagatagtggaaaagaaagaatgactgttcaaatacttttcagaccacaatcttaaaatcgacaattgaagtacaaaactgctacaatttcctttcgaaatcttgtttctctctgaaggtaaagttatattcaattttaaaactattcagtgaagttttaggaaatattaggaatacatgttgaagccttccattttgagcggtagggtacttactctcataaatatgcctaaatagttctggtttcttggtcagagtatgacagtcaagattatggtatactctgtagtgatttcaagcaaaagtcctttcttgaagagtgttaaatagcataagaaggttaaagtaagtttactgtaattaacattttatttctgttaaaatgcaggacataggtaatcaaaaaatctctaatcatcagaattgatgttagccttctctttttcctagaaatgatgaactagagtttctcttccttcatcagttcagaccccaaagcacaaccctaactggaaatggtaaccatgcaataaaactaccaaaaggttaagagagggagaagaaagggaacttcatcacaaaatggataattaacatctaaatgctgaatactaaatactaaacagtagaagtttcacattctatcactgtcttggatgttaacaatgatgccactgtagtgcctttcctgttaaccagtgagcattgttgaaggacctggcctgggaccagggaccccctactgccttcatggaaagacttccttctgatgagtgtgagaagtgctggggcctcaccagccagggctttctgttgtcactcccctttctacagtgtgacacatctcattatatttcaagcactcttacctcactgatacatacaaatatgaatttttaaattaattaattaatgtcaagagttaaggagtctctccagctgctccaaggccttgcagtatcttgggatagggtttaaaatggatttattttgttattggaactgattaagggtcttcacattttttgtacaaaagcttgctcctgacgtattagactttgaggaagttttcaaggtttagagcctgtaactataaaaccggcaatagtatagccatgtcgtaagtgtttttagcagagaaatcatctgttaatgaggaagaaaaagatttggcctcacggaaatttatttgcctaatcctaaaggttcacctgaagcagaatcaacagtggaaacataaccacaacaggaaagggtgtgggttatatacccctcccctgccatgtttctattaatgagaaggatcaggacccaagagaggaataagaatgcaagaactaattgccatcctctttttcctttgctgcagataaacgaaggccattttcacaaaaaaaatgatcactgcagataaatgtagggtattgtcacaataaattaaccattttttttttttgcaatttaagccaacaaaagtagtatgacaagagtacatttaagtgccaagtaacctcatgctttaactgcctagatatttaaagtattattgaaatggaaatggaatgctttatttaactttgtagaggtgagtgaagttcaaattaaaatgtataaatcaccatggaatactatgcagccataaaaaatgatgagttcatgtcctttgtagggatatggatgaagctgtaaaccatcattctcagcaaactatcgcaaggacaaaaaaccaaacaccgcatattctcactcacaggtgggaattgaacaatgagaacacatggtcacaggaaggggaacatcacacactggggcctgctgtggggtggggggaggggggagggatagcattaggagatatacctaatgttcaatgacgagttaatgggtgcagcacaccaacatggcacatgtatatatatgtaacagacctgcacattgtgcacatgtaccctaaaacttaaagtataataaaaaaaagttaagcaaaaataaataaataaataaaacaaataaaaaggtataaataaccttatatgtgaggatttgatattcaatttaaatagagacttcaaaaaattcaaatgaagataactaaatcactgcttgatacatggtgcactgattaatagcataagctctggaatcatagagacttatttttgaatacccactctgtcactgactagctctgtaaccttggacaaattatttaacctttctgacccttggttatctcatctataaaatgggaattgcaacataacttactcaaaaggtataactgtggcactaattctaagacttgtattaatttaggtttgctcagaagtagaccctgagacaaggatttaaatacaaataattcaattgggagctgatcccagaaagccatggtagaagagaagatagagctgcagagctgaagatacatatatatctgtcagttgtatctcagcagggaacaaagttgagatatatgagaatactgaagaggactgaaatcaaactcaggagatgtggggttgggtccagattctgccaaaatgggaagaaagcctacacatcggaaggaagcctatacgaggcatgctaataagtatgcttatcattgtggtcaactgcccaattcactggagatttttagtgtggaacatgcattggaggtgtcctacccaaggggagaagaaggtgggatatttattgatatggtttggctgtgttctcacccaaatctcatcttgaattgtaactccaataatccccacgtgttgtgggagggaccatgtgggaggtaactgaatcatgggggtggggttttcctgtgctgttctcctgatagtgaataagtctcatgagatctgatggttttataaagagcagtttccctgcacatgctctcttgcctgctgtcatgtaagaagtgcctctgctcttccttcgccttctgccatgattgtgaggcctctccagccatgtggaactgtgagtccattaaacttctttttcctgtataaattatccagtctcgggtatttcttcatagcagtatgaaaactatgaagaccaacacctttatcccccagcttttgtccattggttaagtgctattccagagataatctcctccccagcttccagcctgctctgcaagtgggagagctactcctacaggcagagaaaggactcaggaagactcacaggtacttgtagttagacgcttcatggtttataggaaggctgagtgctaaggggaaatgggtagcccactaagggtcaaatctatcttacctgcctcgtttctgtaaataaagtgtcactggagcacagccatgtccctttatttaggtattgtctgtggcttttagtatacaatgacagagttgaccacatgacccataaagcagaaaatatctagtatcggtcctttgcagaaacagtctgttgatcccttatatagttggtagcacaactgagatatcagaatttaggcttcttgacctccaatactgtgctttcctaattacacttgagacttgctctctccaaacttaattacaggaagagatgattttaccagtgtttaatcaactagaaaactctgggccgggcgcggtggctcacgcctgtaatcccagcactttggaaggccgaggcgggcggatcacgaggtcaggagatcgagaccatcctggctaacacagtgaaaccccgtctctactaaaaaacacaaaaaaattagccgggcgtggtggcgggcgcctgtagtcccagctacgggggaggctgaggcaggagaatggcgtgaacccgggaggcggagcttgcagtgagccgagatcgcgccactgcactccagcctgggcgacagagtgagactccgtctcaaaaaaaaaaaaaaaaaaaaaaaaaaaaaaaaagaaaactctgttaactggctcttctatatgtccatatacaatgggttattcattccatagttattaccaagagacatttgaatcaaatatcctgatttggagtcttcacattaagcatgtctatatgcaatttctttcaaaaatgctaaatcgggtattgtagaacattaatgttctcaggcccagcagcttgtggataagaaaggattcacattgacatttacaaccagatttgctggctctttgcctccatctgccatgcaagccttcagacccatgcaaagtcctgtctacctaaatgattgtgaaagtctctagaggaacttatggcttttcttctcagaggtctcatccaggaacactgaacagctctgcagggcaaatactgcctggtttagtgtgttgtccatctccttgaacttctaagctataacatcctcggggtggggagatggggagtagaggtgctaaaataagatggatttccctttagcattcacagcactggatctcattggaatcccactccttgctgcacacagcagaagggatgaatttattcttccccactcactgtatgtctgtggtagtagttctcaaagcataggccagcatcagcataacctaggaacttttcagagatgcaagtcttggctgggcacagtggctcacgcctgtaatcccagcactatgggaggctgaggcaggtggatcacctgaggtcaggagttcgagaccagcctgaccaacatggtgaaaccctgtctctactaaaaatacaaaaattagccaggcgtggtggcgggtgcctataatcctagctactcaggaggctgaggcaggagaaccgcttcaacccaggaggcagaggttgctgtgagccgagattgcaccactgcactccagcctgggtgacagagcaagactcagtctcaaaaaaaaagagagagagagagatgcaggtctcaccccagagctagtaaatcagaaactctggggttgaagcccagtaatctatactttgcgaagaactgggtggttctaacgcatggtaatttttgagaattaagttggattaagaccaacacttttgatctccagtttccctccttttccccaatgtagtgatttgtgtataaatacggtgacaataaaaccttctatccccaatatgcatacccctttgatatgcgatgtggcatctcctcctttcacgagatgaagtaatttcctcatctcttgaatctgggctgatcttttgaggtgctttgaccaatataacttagcagaagtaacctacacgtttcaaagcctaggcatcagaaggtcttgtagcttccacccgccctctcttggaaaactgccctgagaataccatgtaatgaagcctaatctagcctacaggatgatgagtggccttatgaagaatcaaggttctgcaaccaacagccagctgtcagatatctgagagagtgcattttagaccatctagctcctgttcacttgctagataactgcatccacataagtaacaccaagcaagaccatcagaataactatccagctaatcacagagcaaacttcagacacacagaattatgagcaataaatcactcgttttgaactgttaagttttggggtgcttctatgcaacaatagaaactgatatggacaggtgtctaagcaacaacaattgcaagttttgctttttttttccagtatgttgatttgtcctgataattaaaacaatttatacagctcaggcaaggccaccccattataatttataatttaagtaagcagccacaaggtagtttggtttagtgttcataaaacaaaacaagcaactttaggcctcagcttctacatctataaaagaagaatactcaactagataataattgcaataattattccaagtttggatttctatggttctaagaaattcaaatagagtgaaccaattttttctacttcttaagtagaaaaaacacagaaacaggccagtcaaggtggctcatgcctgtaatcccagcactttgagaggctgaggcaggcggatcacttgaggtcaggagtttaagaccagcctgatcaacatggagcaaccccgtctttactaaaactacaaaaattagctgggcatggtggtgcgcacctgtatcccagctacttgggaggctgaggcaggagaatcgcttgaacctgaaaggcagaggttgtagtaaaccgagatcgcaccactgcactccagcctgggcaacagagcaagattctgtcacacacacacacacacacacacacacaaagaaaaaagaaagaaagaaaagaaaaaacacggaaacttgtatcacttttactccagataaatttaagattgagttaaattatattaactgctggccagctgcatctgtatctgtaattttccattaggttcttggacagagagatagtgtaaagcacagccacaaaacaaaacacaggctgtggagcttgacatgtggactgaaacccttgcttgcttgctttctagctgtgtggccttaatctagctatctcccctctaaacctcaggctccttaatctttaaaaattatctatatgttctttgcagttattttgaggataaagacatatatgttaaagctacaagtatatgtgtagcttctacatatttaatagtaggaatgcaatggaaacaatctgctataatgaattataaattctattacattgtaatacagtacatgaaataataaacatatacaagaagcataatacaaattagattttctttttttatattgcatttatttctgattaacttcctgcaagtcaggaagtcgggaatagaaacaattctttattctgatatttgaactaccacagtaaagaaaaaagaaaatcttattttaataaaagcagctctgaatttaaatgactaccttttgttttttttttcattcaacatttgtgtatttaacatcttgacttaatgctcagatctgtttcggtttgctaaagaggatgaaaagcacctgcttttgagaaaattcctctttcccttaattcttttttagctactaccacaactctgccagctatcaccaaacagctttgagctgagggcattcccagactctccatactggcagcaatgtggaggacataggagaagacaagagtggtggggggtgatgagaccctcatgttggggagaaggaagtagggcagtgctatgaaagatgagtatctctcatggcttccatcacacttcccctgacccactcctctagtctcactgatctccttaatattccgtcatcttgttcctacttcagtatcgttgctcagtcttttctctccctgcctggaataattttcccagaaatacaccaggctcacttcctcacttacatcagttttctgatgttctcttaacagacaagcttccctgaccacactatagacaataataccctcatcccatctccctgcttagttgttctctgtaatggtgtttctcaaatgtcagtgtgcacaggattcacctggggattctattaaaatgcagattgtgattcagtgggtctaggataggggcctcagattctgtgtgtctaacaaatacccattgacatcaatctgtagactacactctacagcacttataattattgagacagtatatattttcttcattagtttattgtctttctctttcaattacaatatatgttttatgaaaggagagacttttattctatgctgtactcgcagcaccagtatgatgctcaacacatggaagttaataaataaagtggatgaattatatatgttgctggaagtcaaaactggaacttccaatgtatttttcttataaacattgttacatttaggtaagttacacgttaaatggatttcggcgccctggttttggagccttcctaccatgtgtaacgtggcttatatgggacataaactcatgagttcagagtttaacaaacttataaaacatcattggaacataatctcttcatggagttacagagtctgaggctgaacctaccagagacagccagaaaacagacaccaataaatgataacataggaacaaactatgcatatgcgctgagggaaccaaaaattacagctcataaaaacaaataaacctgacacagttgagtataaccctgatacagcaatttcagtgtcccagattgacaaaaaaaaaaaaccataatgcttaagtctccaaagtcgttaaatctaactctgatgactgccgagtaatcccagagggcacatgagatgcactgtccccagattgtagggcttcttttaatccaagcactatttatgccttctaatgaattatgattgtgctaccccagctgtgattcttccagttcagtatttttctacttgacataaaataaaaatcaactttacctgaagaaccagtcaccatgctttaatgcttcaatcatttgatctttgaaaagcagacaaggcaaaaaaaaaaacaaaaacaaaaaacaacacccaaagatgtttttagttctgcctaattatggaatggtacagcaaagaagttttctggcctctttcccctgagagtcaaagccagcattaacattgccatgagaatttatgaataccttctatcaacaactgaagaggaaagaaaataaaatagactgaaaatatgcagtgaaaacaaaagttaaaactacagctaaatgaggaaatattcctcccccaagtcagcttgtggtcctcccaatccatttttctttttcttgaactaaaaatgggagagctcttaaattgtttgcaaatgggacagggagaggtgctagtaggactgtgtgtgtttctgtggtttctgtgatttttgtagacatacttgtccctcttcaggaacaatgcacacatccctggatgctaggaatattggttgttaatggtgttccttactaagaattgccttcggcctcagaaaacttgtccaagttgtccttccactctcaggcagcagccagcccctggccaatggctggctggatcaggaatacaagggccaggcccactgcctgcaattcaggacagctctgcacagccagcccagatgtagggctcctgcgagactggcttaggcctctgctgcagacaaatcacatttcagactctcccacaatctcccttgtgctcttctcttccttgtgggtgtatctccagagaacactccccatatcccgttgtcatgcaacactttgaatcagagtcaatttccaaggaatgtactctaagactttttgcacagtcaataacacaaaggtttatctctatctttagaattgaaacaaattttctctctcacccagtcatcacttcatagttgcacttttgaacaaatagctagagccaaagagaatgggatccagtatacttacaggctccaatagtggtcagtccaggagctaggtcaggctgctttgccctcagctcttgaagtaaacggtttaccgccttccactcagagctcagatcttctaacttcctctttaacagaaaagcatacacattacttattcgattaacactttgaagataattcatgaacatcttaatccatttggtgaatatattattggatttctattatattttacttctaaattaactttagtgggtagaatttcttttaaaggaattataattattttagccaaccaccctacaaatatttatcaattgctccatacaaaaaccctttctccaggcataattttatttaaaggaagtagagtgcaaacattagtgaaaacaaaccaacaaaaaacagttccctctcagcaactagcttaattcttgaagagtatctattgtggttgcatactaaaattatccagataactttaggaaaatcctaatgtactggctcacccccagtcaattatatcagagtctcttaaagggaggggctgcagtggacacgggaatatgctactcagagcccccttcaaagaaagactcttgttctagatgatggaaatgatgtcagtagacattcttcaactgtcagtcccttcagggactgcctgagctgcagagagctgccttgtccaagttcatgcctttccccaggcagccctcattcagtgactgatgaaggtgaaagtatagaggcctaatttggctcaaagcaggacaagtttgaagggctacttcagctgcagagctccccgtggcataaggcaagcctgtatatggccagtggtgtgctggtagatgtatatcaactggatctctgatctcagggtgtttaaaaacaccttgtttttagtgtttgccaatttctgtggtgtaaatattcctaccacggttaaatttaaattaccaagaagataacatcaagtggctcaaaaaatgcctggcaatataacagtaggccgtcctgagctggttccacttcactgggcagctagctatacgataatttatagccagcagaatgtgagcagaagtgttgtttgtcagtttggggctgaggctttgaaaaatttagtgaggtttccacattttttttcctttctattgctggaagcagaagactcttaggtcctacggcaaatctttacaacttactgaggagagaattaagtcctaacgccctagggcagttgttctcatactttaggatcaacagaatcacctggagaccttgctaattgctgcatggtagccccggagttctggatttagtagatactgggtggagcccaataatttgcatttttaacaattttccaggtggtgttgatgctgattgttcatgacaaaatcctaagatatctattacacctaatcagttacctgagcatttatcatagactagatatgtaccattcttgagaacataatagaccctcagatcattttcaataggatttcatcctcttgcgaaacccgagcagagaaaagctaccaagggaatggcaggcagaggaagaagatgaacaggacctaggtttctgcaataacatatgtaagaaagctgcttgactaggaaaacatacgctgggttgtcatgtgagcaagaaaagaactcctattgtgttaagccactgaaatatttagttcattacaagcagcaataccttaccagtatagtagcactagtcacaaaagctttaccagtgcctataagagataatagctgcgtttttgtatcactgtaaattcctatgcttaccttatgaggaatacaaataacttgattgatgtcgggtttggttaaaataaatacattagcagaaattgcatttctagtctgaagaatcagagttggaaaagagccagaaactacaaactctttaaataggaatggaatgaacccaacctaactggaatgtttcatatacacgttgtagtttaatgctaatcattaatttaatgcgaatcatttcaatgaaaccattactttatttattccagaaaaataattgttcaggtgctactctgtgccagactttgtgccagttactaagcttacaaaactgaagttcgtaacctctaagcattcacagacatgtaagtaaattagaacagagattttaggaaaaaataatgatttcaacaagacacctcgggggaacagcttaactcagcctggagaggtcaataggttacccacaaaagctaacatttgaatttattttgaaagacgactaggaagttttcagaaggggccattcaagcgccaggtggaaaaagggcatttcagacagaaggaaaactacgtgcaaaatggcaagaggtatcgagccttaaaaaagaaatgcagtgtgtcctggctatctagactacagtgtttacaagtaatgatacagagctgcaagaatgcaatttattaagaccttgtaatgtgggactattacattctcttctaaaaccacagagtagatggaagtgtttagagaagaagagccatatgatacgattcgtgttttgcattgtggaggctttatcagaagggtgcagagatacaagttgggaggctaacatggtaactggagtgggaagtggtcagctggactgaaggctttggccatacagaaaaaggcagaggggtgtgtgtgtgtgtgtgtgtgtgtgtgtgtgtgtgtgtgtgtgtgtgtatttttcttgcctttgatagttgagattttgagctggtaaacgacgaagagaaacttgccatcaaattgtttcttccagttgtgggatatgatgaggtttctcttcaaataatctgatcaatcttttattctttaattcatagtaccccctgatttttctcctttttcctttttacctttgttagatgcccaggcacacctcagtaccagctcacattcatttccttatttggaaagaggactaactttctagctcattacagacgccccttccccttcctctccacttgattttacgtgcccaccctatctaaaaaaatcaaatgtttagccaactgggattagtttagattgtacgacccaaccccagccaatggggggaaagggtacaggggcaggacttgcgtcaggaataaaggctctcatgcccctttgttcaggtgtgctctcatggcaactggccaaggaggcacccctctgtgcagaagtaaaattgctttgctaagaatcctttgttcgagtgttcaatgtcctcaggattttgagcattattcctaacacagtctaccctgtcagcatgtgtctttccagtcagactatgtgcccttcgcaaggcaggactgagtcctctatgccttgtacgatgttttctttatatccagtctagtgcttcctaataagaggagttcagtaaatatttctgaattgaataaaattaaatgaaaattgctacttgaataaaggaaaagagaaagagataaataagtttcttttcccccaacttgacttcaatgtgaactacataccatggatgactttatatatatatgggacttgaaggagcctatgtaggttttccaggcgtgcaatcattttattaggcttattttttcttttgagacagggtctcactctgtcacccaggcgggagagcagtggcaagatctcggctcactgcagcctcgacttcctaggcaatcctcccacctcagcctcctgagtagctactcagtactactactgagtagtactactgagtacatacatttttatgtagagacggggttttgccatgttgcccaggctggtctcaaactcctggactccagtgatctgcccatcccagcctcccaaagcgctggaattacaggtgtgagccaccacacccagccttattaggcttttataaatcctgaaccaaactgtatttaaaaagtaatctcatagactagggtcacaaattcaggtccctatagggactaggttgtaacaaagggaagaataagccttgtctaaatcagagagctataacttcagatgtggctgctgactgccaacagaaaggtgggcataagttaaaaagcaaaacacagaaaaacaaacaaaaaaccctgctgatcatattccctcaccagtgtataccggagaagtttctctcacattcttaaggtcataaggaagtacaagaaagtttgttgctgcattgtggggaattgaggccaacatgggtatgtatgtgaaagaaatggataagggtatatgtagagcaatgtggatggatttttttcttttttttttttagatggagtttcactgttgttgccctggctggaatgcagtggtgagatcttggctcactgcaacctttgcctcctgggttcaagtgattctcctgcctcagcctcccggtagctgggattacaggctcgcaccaccacacccgggtaatttttgtattttgtatttcaccatgttggccaggctgccttgaactcctgacctcagatgatctgcccatcttggcctcccaatgtgctgggattgcaggcatgagccactgcgcccggccatgggtggatctttaaaacacaattatgaatgttagaaaagctaagaaacaagatttatagcacaatgtagcttttataaatttaaaatatacttataaataatatattttaaaaggataaagcaggaaagaaacaggaatagagatattattgtcacatttcagtaattttgctaatcggttattaaacataaccattaatataaattaaattttataaatataaaataaactgtgctaagaacaaaagataatatatagtaagaattcatcacttcctaatttaactatcatcagtgctcttgagactatgtctattgtgtctgacatcaagtcaaatcaaggctttcaatgtttttatccagaatgcatgatgtaaatatttactagcatatcaataaatgtaacttttttatttattaaaaatcagtcttgaacccaaaagcaaacaaaaaataatgcctctgattagtcaggaaaaccacccttggaagtcatcactcacggaagatattttcctgtcctgacatcagaacctaaacactaaaaattaaatattctaagagactagtgagtaatatatttgatcttctggtttccctgtgaagtttctgtaaccctacaaagacagaatactaaaagcaatgagaagtaatcattctgataacagaaagtagcaataggagacaatgaacatgaaaaacttaaaactgagaaatgtggtaatcttagtcatttatcaatgaaatgacctttcaacatgggatgaaatctcatcctacaccatttaatttataggaaatcacctatatgtgctgagatagagagaaaaggagagatagtgatagattagggattgatttaaatactgctgggggtatgcccatctttccactcagtaagcatattgcccctcagaatgaggataaagagagatcaaagtttgctgtttctatgtttctaccagttgacttaggttccactctcttctcatggtgtaagtatctcagtgatttgagttagctttaatacttaaaggtatgtatttatcttacagtctagcttctaaaagcaaattaaccacttcaactgggtctcaactgaagaaagggtgctttgaatttcatgttcctcatataacactgtatcactaaacagagcaaaaattgatgtgataacgacacccctgaaaattaagaaaagttaatttacattgtgatttagaatcagaagtcttaggtttcgttcctaattcactactactggttgtgtgatccttggaaaatgagatgggtcactaagatttatcatccttgaaacatggatataataataccacctaactcatagctttgttggagaaactaaacgagatattttatatggtaaaaatgctgtgaactacaaagcactataaatttgttggttagatattatgcgctgctcaatgaagcaaaacagaagatattcaagaaaagttctcattaaaatagttacgataaaatttttttcagtgctttattaaaggactaggttttagttacctagaaaataacatgtttgtacatgcaatttctcttttattaatacataaactctaaatagtctgtccatttactctaatattatctttcccactcttatttccagataggtaaatgaggggttactataatctctaatgtagaggtggatttttaaaattaaatggcactaccaatgtatcacaaatgtctgaggacactgcaatgggtcaaaggttcaataagctcagaactgtataatttccaatcttttataattattagcaaatacttatgaaatgactacagtttttgatttggctgttcacaaaaacaatcttgctactttttcaagagtttggtgtactgtagagttgaaatggattatttatatattatacaagttcttttttgttttgcttcattttgcttttcacttctctggcatttgcccatattttcaattctctcatcattccaattaagctgtaaaattcatttgcataacaaaaaatgtttggctgtagcaactagtcaggtgttcatcatataataaaatttaagcagtgctcaatagaaatctgtaaaaggtaacaatttgcaatacatgttaatcatctataagcaaatttaaggaaatcaaataagtacttaaatcccaacttatttaaatagcgtatcagtgggataatagttatcaagtcctattcttgactacatctccataattttaaaactttgaatatgctaactaaattgcaggtccaaggttttccgcacaagagctccaaactcaacagagtgaattcgtgttctaccaaaatggataaactttgggaattcttttgtttgtaaatggaaaaatcagatttattataggtgacttttgcagctgagcattattctccattgtatatactttgcttgaaaatattcattaaatgttaagacaactatatcaaactatgaaatttctgctttatgaagaacaggaattagttacaagaaaaagtgatttctgaatatagctttccttttaaaatttaaaatggataaatatttaaggtgatagatactgcaatcactctgatttgatcattatatattatatgcttgtatcaaaatatcacttgtggtaaaaggacggaaaaagatactccatgcaaatgggaaccaaaagcaagcaggagtagctattcttatatcagacaaaatgggctttaaagcaataaccgtaaataaaagataaagaaagacattgtataatgataaaaggattagtccaacaagaagatatttactacagtactcaatttatatgcacctaacactggtgctcctagctttataaaacaatagtactagacctaagaaatgagatagacagcaatgcaataatagtgggggacttcaatactccatttacagcactagacaggtcactgaaacaaaaacttaacaaagaaacaatggacttaaattacaccctagaacaaatggacttaacagatatttacagaacattcttcctaacaattatagaatatacattcttatcagcagatggaccattctccaagacaggtcatacaagagaccacaaagtcttaataaatttaggaaaatcaaaatcatatcaagtatcttctcagaccacagtggaataaaactaaaaatcaactccaaaaggaaccctcaaaactatacaaacacatggaaattaagaaatctgctcttgaatgattttggggttaacaatgaaattgagatggaaattaaaatattttttgaaatgattaatagtgacacaatttatcaaaacctctgagatacagcaaaaacagtgctaagaggaaagttcatagtgttaaatactacatcaaaaattctgaaagagcacaaattgacaacctaatgtcacatttcaaggaactagagaaacaagaacaaactaaactcaaatccagcagaagaaaagaaataacaaagatcaaagcagaactaaatgaagttgaaacaaaaaaatacaaaatataaatgaaacaaatagttctttgaaaagataaacaaaattgatagaccattagcaagattaaccaaggaaagaagagagaagattcaaataagctcaagtagaaatgaaactggaaacactacaacctacatcacaaaaatacaaaagatcattcactactactatgaacacctttatgcacacaaactagaaaatctagaggaaatggatacattcctggaaacacacaaccctcctagtttaaatcaagaagaaatagaaaccctgaacgctttggctgggcgcggtggctcacgtctgtgattttagcactttgggaggctgaggcaggtggatcactaggtcaggagttcgagacctgcctggccaacacagtgaaactccgactctactaaaaatacaaaaattagctgggcgtggtggtgggcacctgtaatctcagctacttgggaggctgaggcaggagaattacttgaaactggaaggtggaggttgcagtgagccaagatcatgccacagcactaaagcctaggtgaaagagcaaaactccatctcaaaaaaaaaaaaaaaaaagaaagaaaccctgaacataccagtaacgagcagcaaggttgaatatcagtaatttaaaaattgccaaaaaaaagtccaggaccagatggattcacagctgaattctaccagacattcaaagaagaattggtaccaattataatgaaactatttcaaaagataaagagggaatcctccctaaatcattctatgaagtcagtatcaccctaataccaaaaccagaaaaggaaataacaaaaaagaaagcagcagcacaaaaatagcagcacaatttgcaattgcaagatatggaaccaacccaagtgtccatcgaccaatgaatggataaagaaaatgtggtatctatataccatggaatattactcagccataaaaaagaatctcttttgcagcaacttgaatggagctggcagccactattccaagtaaagtaactcaggaacggaaaactaaataccatatgttctcactcgtaagtgggagctaagctatgaggatacaaagacatacggagtgatacaatggactttggggactctaagtggggagcttgggagtgaggtaagggataaaagactatttattgggtacagtatatagtactcaggaaatggatacataaaaaatttcagaattcgccactatagaactcatccatgtaaccaaaaaccacctatacccccaaaactactgaaattataaaaaataagcaaaatataacttgtaccgcacaaataaatatgtacaattatacacatataaaattaaaaataaaaaaaaattttttaattaagtttcctaaggtagctacaattgtggctgctttcttgcctcatattttttggatatttaaaaaatattaaatgatttttatgttttctatcattaagacaaggaaaaaagccttctagaaatagatattatttgatgtagaataagtaaggaaaaataatgtatttgtttaatacaatcataaaaaatcatttgtttaaaaaagtaaactagaatatagttttaaactctatttgagtttgagattttcaaaatttaaaaatatatcttgtgtcaatggttggcatgcaattaatatctactgaataaataaaggactctacctacggctgtatatatacaggcatacattcgaatattgtaactgaaacatctatgtctctttgtctctctctttaagtgtaactaatacaactgaggacaagaggtgaaattcaaatctctaaaatgcttccctaatttcagcatgagctactgagtacatgagacttttcactcaaatattctctcagaaaagaaagttggctcatattcaagactttatactatctcttatgtctcaattattttattcggaaccacaatgttgtatattagcctgaaataacctcaagagatgtgatgcttacataagtattctgacagaatttgcttaattaaaaagggaggcaaagaaagttgataaatctttagcaatcattcctaatgtatagcttcacaatcactcgtggcagagatcattgtaaacgagtctttcaaagaatttgttaaaaagccaaacaacttaaaaagcagaaagaatatgttagtctattgggaatttttaaaagatcacatctggctgggtgcagtggctcacgcctgtaatcccaggactttgggaggccgaggcagcctgatcacctgaggtcgggagttcgagaccagcttgaccaacgtggagaaaccccatctctactaaaaatacaaaattagctgggcatggtggtgggcgcctgtaatcccagctacttggaaggctgaggcaggagaatcgcttgaacctgggaggtgtaggttgcggtgagccgagatcgcgccaccgcactccagcctgggcaacaagagcgaaactccgtctcaaaaacaaacaaacaaccaaaatcatatctaagaaaaatgaaaaaaacagttttcctaatattttgtgaatgggtattgaagtttgggataaaaatttcagcgacagcattgagaacgtgaaaaatagctctgctgatagctggcagctggcagctagctaggccatgatggtcccagctggatgttaaaaaacactcatagaaataaactaggcagacacaaggccaccccatggccgtgtttgaaacaagacagagacaaggcctttctgctatcacagaaatgactaatatgaggcattgctgctcctttaccaacgacgtgtctagccctactttaatctcatcttctagataaacactaagatacctaatcactacattgactctgtttcttgaaagcatctaatccagaaatggcttctactttctgaattcctccttagaatcatgcagccagctgaactctgtaagaagctttttccaatgccctcttactgagatgcccacactctgaagtgttttacgctcttgctgcaataaggtaaatattcttaattttttgattacagatatgttgcttgtaatcttggccagagggctttcagagtattatgtagggattcaaacaatgccatattacaaataacttagcaaggtgatgagctctacaattctagaatatacatacgaagggtttgaatgaaattgtttcataaaatataaatgtgccaggtatttctaaatgagtgtgttattttataaaatgtaagactgcaaatatggaaatgctactcaattaagaaattgaatataattagacatttgacaatctcatccatatttctaaatgtttatgtttacaagttgcccaaaaatctattataaattttttctcttctcattgggaaagtgaagctctcctcaagtttatgcattgggattagcatttattcaacctcttatactccaagacttttttttcagttgtaaagcaaacttgtatttatttatttatttatgagatggagtctcactctgtcacccaggctggagtgcagtggcgtgatctcagctcactgcaagctctgcctcccgggttcatgccattctcctgcctcagcctcccgagtagctgggactacagatgcctgccaccaagcccggctaattttgtttttgtatttttagtagagatggggtttcaccatgttagccaggatggtctcgatctcctgactttgtgatccgcccaccttggcctcccaaagtgctggtattacaggcgcgagccaccgcgcccagtcgcaaacttgtaatttaaaaaaataaaatgttgctatgcatttacttataaattattaaatgcctctaatattgttatcttctttctagaagtcctctcccaacttattctggtgttattggcatggaaattgtgctcaataaatgagtcagtcaaaatagacttgttcatttcaggggacaatttttgtctgttatctctctattgatttctgttgctacaagtgaagttacaccaggtaaatgagattgtacgcatggcagatgatttatgaaatccaagtattgttttaagtgtaattatatttatttcggcaacatttcgaccaatgaaataccatttgacctgctataccgtggataaatcttgagatgcacatcttttgtgagtaatatattaaagattgttaggcaaaaaataaaccctaaggaagtttttaaaaatgttaagatgttgatgttggcagtagaacaaactcattgggagaaaaaaaaacagcttcatctagttaattaacaacaaaacagctgggaaaatgaatcatccctggttgtgactgactgtaattgaaaatgactaatgatgctgtcattttgcagttcatatctgaggaaatgatgcctggaagattataattgccctcttgaccatttgtctacagcaattattttgtgttaaaggttgggatggaacgctttggccaaatacagaaagttcctcacacctttttctgttacattgaaaaataattcaagagcagtaagtaaaacatattactaggtttgtgtaagtaacattttttgataatataaaaagttagcaaagcaaaccagctggcttcattttatcactttagaaagtaaccaagacatttaaaattccattaatgctctcagttctaatacatggcaggtgatgtaagcattgaaagtacataaacatatttttaaaagttaactgaaagtgtagttttccaacttaagttaaaaatgagtatgaatacaagaaaatggcacctaaatgcttaagctcaagacagttaaaaatacaattttataataaaaatcaaataacaaatggcttcttttgtagtttatattgttgttactgatagcagttgtttttgctgcttttaaactgctaaatggggtgctattgaggacctagttattactgtgtggaaaaatggaacacattaaagactatttcatctatggcattaatgtaatatattataccaaaactataactttagcaaaattttaaacaatttatataactcatatagtcagtcttcagtaatttctgaagttaagatgaagaaataacatacaaataaataaaagtatgtgtgtagatgggggaggaagggggagagagagagagagagagggagagagggagagagggagagagggagagagggagagagggagagagtggagagggagggagggaaagagagagagagagagagagagacagagagagagaaagagagttgaagtgctaaacaaagatggagaggtatttgatcatacgatcctaagatttttccagttattttgcagcagagattagtactacctatacgtcattagtattatcatttcataatatgtatttgaccttttacaggaagtcctcaaagaaaataaagaagttggttagtcagagattttaaaaaagaaaccagaaatataccatctttgaaaataaaagaaatcttaaagaagttgacgaagtgaaggaaagaagaaagaggaaagaaactgagcagggatgaacccagcttccaatcagaactcagcttgggaggtgagcgtaggagctggacagacaggctgtctgatgcagaatgcggaggtgccaatagacaagtcaatttcctaagaaacagaattgctccctgatgtgtctttaattagaatgtttgtaagcggtggacacactaattatgcatttaaatactagatcttgcatatacatcgtgagagattttcattttctttttaaagaatatcattttcttcataattattacagtttccaaatgcacctcccccaaaaaacaaaaacagaaacacaattctctcatgaaaatgtgctgcaggctactcagactcatttcctcttctattaagaggtaacaagacccagagtgaagaagaggcattataaataggacaaattttaaattttgatatatggactcaaagtttaaaaaggctttgttcacgttctatcagagcaatggagtgtccttcagaaaaatcatctctaacctttaaaaataaatttttgatccatgcagagatttaaacagccctcacagctttctgccttgtattgctgggtgtcatgttcaaaactgtgaggtcattttttgagcctctaggtgtttcaggctaccgcaaaccccagctaatcttcagatgtttccaaggtcatggtccacagcaaaagttgtgcgtgagtcaactatttttttaaaccccataattctcaaatcattcttgcatttttgcccctatcaacttgatatatatatattttgagacggagtttcgctcgtgtcgcccaggctggagtgcaacagcgcgatctcggctcactgcaacttctgcctctcgggttcaagtgattctcctgcctcagcctcccaagtagctgggattacaggcgcctgccaccacagctggctcattttcatatttttagtagagacagggtttcaccatgttggccaggcaggtctcgaactcctgacctcaggtgatccgcctgcctcggcctcgcaaagtgctgggattataggcatgagccaccatgcccagccaacttgatatgttgatttttctccaaatccaagggagaaatgggaagacaggaataaattttcccttaagttcagcttctcccaatgtgtcaaattgagagaaaatagggaaacagggaaggagaaaaaaaaaaaggaaggaaaaaaacagtgctgtctgctacaaaaatggttttaagggttgtgaaagagaaggaaagcaacagctcctggttctttctttttatttcagaaaagtaattctccttttacatcactaatgcatcagcaggaagcagatatgctcaggcatggcagatcccagttctgatctccaagtggcccagtagttgagtgtgtgggtggaggtgcgataagttagcatcaagcatttggattgttttatacataatgaaagcaaaaattttctcagtggcttttaattaagatctctctctctctcttttacaaaggcacaaaagtaaaagccaaattacatgtacctttgtgatctctaacaattagtgacaaaccttaattcatagtcatacaccataaggcataaagtctttgaggatcaacaaagagtagatagaaacgtatgcaattgtccatttgtgcactgcatggcttgctacaatgaaagtcaccatattaactgctctgagggctggctttcttcagaacatcaacggaaactctgaaatttgctgctttcaggactttgcctagctcttccaactaaatactgagcacattgttagcttatgaaaaatgattatactgggcttgaactggatacaaactacttttctagatttttggagtggttgcaatatatttctgaataaaagtatgttgatatctacagagaaacctgtgattttcagtgtctggtgtttggacattaagctcaggtgcaaacttcaactctacctaaggaaaagtctcttgtaagctgtaaggaaaacaaacaatcttctagaaatgaagcttgggccaagcgcaagggaaactaagcagcgaccttagagacagaatctaagtcatggtaatgttgtttgcaaggacaaactggttctgtataatgaggttattgacctgaactgttttcaagcagttttaaacatgaggacgaggttcattgtatccaagcctgcaacattaactgagaaaccaagactgatcaataaacagccatgattacaggatctcaggaaccttcatcataatgggagccattataattctggtcaggtacagagaatcaggtaacctactgctaacgtatatttagcactggactctcatttgcaaatggaagccattgattagctattttttgaaaactgacctggctttccatctccctccttatgtaatagcctgtgaataaatgtgacctagacttcaacatggatatggagaagaaaaaaaagtagaaaggtttatcccaggccagctttttgccaaagaaataagcaattacatgacatttcactaaaaattcttgacccaataaaatactgaagcctcaatgccgattttactcttttataagaaagagcaacaaagaaaagaaaggtcacggaccatattgtgattctttacagctgttggagacagacactatgatgcagtagcttgatttgaattaaaccaaacaatatgaaaagcatcaaggctggcaagcaaagcaataaagccccaaagaatttaatctaccttgaaggtgggactacttttgtattgatggcagcacaccaggacagaaatgagtcctttaaagcaatgactcgttaatagccttaagatcacaatatataaataggatatgctgatcaaaaagacagctttgcctctgctattacagtatggccagtatttccttacaagttatttcactgattataaatagtccacgtcaatggcaaatgtacaacaggggaagcataacccattatgaggtaatggatattgctagaggttgcttcattaccttcactggctgagtggctggtttttccttgtacaaatgctgccctttagacaaaatctcttccacatccggttgtttagcttgaactgctatttcagtttcctggggaaaagaacccatatagtgcagattaacttcacagttagcaataaaattactaaatttaaatatacccttggagactccacatgtattgcagatcaatttctgcctggtacataagggcacaaaaatgtagcttttggtgcagagaaaagaaacagagatgtgaaacacattaaacttaaaaaaaattcatccaatatcttcttgaattatataatactcatatagaaacacaggcattaactacttttcaaaaaagtaaaatgcaataatgacaatacaatttattaacataatttatatgaataaacactagttttagctacaataatctcaataatcctaatgttcattttactttatacacttattgttttacaaaattctgtgtttagtattggatataaattttgttttgaaataaatatcaaataattatttctacatcactgtcaaaattattttctttccaaagggtaaacacttaaagcacagtatcaaagcttattatttattaatgagtcaaacaggccttctgaagaacgattaattttgtttattatttgcttttcttcagtctggagaaggctgaagcatgacaaaaaaaaatccttcaggtatatgaatataagcattttgttactgtctgctgactagctctcttgatgagacgacaaaagaattgtgcagaaattgaagctgaaggaagtgaagttaaatattacagaagactttttggatggaacacttgttaaacactaggatagagtatcaattaatcaatgtcaggcatcagtcagggcctgggcaatcttccccagagagcagctcctgattaacccgtatctctcttcctccctcccctaccccggagcctcccagcactgctgtgtttaagtgtctccgtgccactgtttccttcgtatactgtgtttgtacctgttccctctcagttcattagtaggaaatcccaaattactataatctcatactgcccagtacagtctcttgcaatttacgggtgctcagcacatgctcttgagatagactatttttttccagttcttattataataaataccagcagcaaacaggcactttggtcaaaattgtacataactaacctcatgtgttaatggttatgtatgcaaatttcacttcctttataacagtagtttagctactttacatgaagaactattaattgatggtcttactgccccttgccaagaaaacacattgttccctgaaaatgcagcacccggaatgactgtatgtctttgctagaggtagaaatagctctgatctcagatgaggaataaggaaaatctagttttacttactgaattccaaataggtccccagccactataaattcacccttgaataccgcatttgcaaaaaaacattttggtgtagtaaatggtgatatggtctcaaaatactttaagagaaaataaaatatattattctaaggaagtagagaaaagagcatatcttcagcaaggtaaaaatgatttaagaaaaggaaaaaaagtaactgaattttcaacctatacatttatcatttatgtataccataaattaccaggccaaatatacatgtacaatgtctaaattatacatttgaaattatatatgcattacacatataaactgacaagttaacttaaagcactgtcaccaccattcattttgtatgtgtttctctaagacaaagcactattttctatttattcactgacagctgggacttttcttgtgatagttattgatatagctaattactggtaatagacaatgttttctgattagcttcatcatagctgtagactatattattgatgatagcatagttaccattcgtataatgactactatttgccttccccaaccctgattccaacagattgccactttacagataagaaaatgaagcaagggtgggtgggatagtagtgacggtagtgacaatgatgtgaatagcttgcccacaacctcgtgggatgtgggagagttaatattcaaacacagctaggtctgaatccaaagtttatactattggcagtagtaacagctacgtcttcatatcttacaacaacttaataacatatccaaatgatttgatcaaattatgttatttctaagcattaagaaattttactttcaccatctgaatctgtttgatattatcacatatgctgaaaaacatgccctacctctctgataatagagaatcactatgggtcagagggagacaggcaacttaatgcaacagtcgtcattcccattcattggaatttttgaaaaatgatagcaaagaccattgttcccactgccaacctacagtcttatttaaactgttccaactcctttgcttcctccttcaaaacacatcacaattaatcacattatgtgtatatgtatagttttgaccattcctaaagaattatcctctatgagagtaagacccataactaccttgttcactcatatccctggaagtgcctaacacatagtaagtgctaaacaaaaaaccgttgaacgggcaaataaatactgttgcaactttgagcctatgggaattgagttaagagtgtgtattactagagacatttgttcacgcagacagtcgaaaggttcatggcatagactattttctttctaaataatctgctagagttaaatacagagtctactcttctgcttttggatttcccgtaatgattttttttgcaaaattttacatcttcacgttattgattacaacaatgtctcagaaaactcatttctatgacaaattaaaatgggattattttatacttaattaatcctttcattgacttcctttaaactaaaattccatttatcccacatttttcttcttagctgaatttgtataatttaatctccatctagcaatccaagagaacatcacaaatacaaatgttttagcatttatatgatttagcatgaatattttatataaccaacatctgaatgtgggacctctaatcaggtactttataactattgcacttgaagcatagtaaacatttattagttttgatttgtaattccagtagaagagtaaacttggaaaggctggaggatcatatttcctatacaaatctaaaaacttctatgagtattaaaacctgtgatgtactagcatggaaaagctcatctttcctttcaaacactcccacttcacttttctttttcactcatcgagcataggaagtcaatattctcctcatattcccttaaatttaatgtgtccctctgtcccccaatacagatcatttgtatttgatacatttgatctaacttttgttttcatagtatttatacattaaaaccttttgcactgaacaccaaactacttatattattccaacctttaaaaaagatttatatttctaaaattggagtgcgtattcaaaagatacctgctgcatcatctattcaatatatttataagctagagattgggatacagcactagaaaattttcaatttacaatatgaatatatgtgtgtgatatacatgtatatacatatatgtgtattagatatgataaatacacatatcaacatatatgtataatatgcacatataatacacatacacatatgtgtgagtggatatatagacacatgtatgtatatgtacaggtatacctcattttactgagttttgccttattggctctgcagatactgctttttttttttttttttttttacaaactgaaggtttgtagcaaccctgcatcaagcaagtctatcagcaacatttccaacaccatgtgcttacttcatgtctctgtgtcacaatttgataattctcacaatatttcaagctttttcaatatttttataactgttatggtgatgggtaatcagtaatctttgatgttactattttaatagtttcagggtgccacaaacagtgcccatataggatggcaaacttaatccattaatgtatgtattctgaacgctccactgaccagtcatccccctacctctcttcctctccttgggcctccctattctgagacacaacaatattgaaattatgccagttaataaccgtactatggcctctaaatgttcaagggaaaacaagagttgcatgtctctcactttaaatcaaaagctagaaatgattaagcttggttaggaaggcatgtcgaaagccaagagaggctggaagctaggcctcttgtgcccgttagctaagttgtgaatgcaaaggaaaaattcttgaagaaaattaaaagtgccagtctagtgaacatgcaaatgataacaaagcagaacagccttattgttaatatggagaatgtcttagtggtctggacagaagatcaaaacagccacaacattctcctaagccaaagcctaatccagagcaaggcccaattctgttcagttgtatgaatgctgagagaggtgaggaaattgtagaagaaaagttggaagccagcagaggtttgttcatgaggctttaggacgaagccctctccgtaacataaaagtgaaaggtggagcaacaagtgctgatggagaagctgcagcaaactatccagaagatcaagctaatatctaagatgatgaaggtagctacactaaacaacagattttcagtgtagatgaagcagtcttctattggaaaaagatgccatctaggactttcatagctagagagaagtcaatgcctggcttcgaaagttcaaaggacaggctgactctcttttgaggggctaatgcaattgatgactttcaattgaagacaatgctcatttactattccaaaaatcctagggcccttaagattatgctaatagactctgcctatgctctataaagggaacaacaaagcctggatgatagcacatctctttacagcatggtttacttactgaatattttaggcccactggccatacctattgcacagaagaaaaaatctctttcaatatattactgcttgttgataatgcacctggtcagccaagaggtctgatgaagatgtaccaagagattttgtttttatgcctgctaacacaacatccattctgcagtccttggacaaaggagtcatttcagctctcaagtcttattctttaaaaagtacattttgtaaggctatagctgccctaggtagcgattcctctgatggatctgggtaaactgaaaatcttctggaaaggactcaccattccagatgccattaagaaaatttgtgattcatagaaagaggtaaatatcaacattacaaggtgtttggaagaagtttattccaaccctcatgaatgcctatgagggtccaagactttagtaggggaagtcactggatgtggagaaaattgcaagagaactagaataaagtggagcctgaaggtgtaactgaatggccgtcatctcataatgaaacttcaatggatgaagagttgctacttatagatgagcaaaacaaagtgttttcatgagacagaatctactcctggtgaagacgctgtaaacaatgttgaaatgacaacaaagggtttagaatattctgtaaacttagttggtaaagcagcagcagggtatgagagccttgacctcatttttgaaagatctactgtgggtaaaatgttatcaaataacatcacacactacataaaaatcttttgtgaaaaaaatcaaccaacatagcaaacctcatggttgttttattctaagaaattggcatagtcactccaacctttcaacagttactactctgatcggtcagcagctatctccgtcaaggcaagaccctccatcagcaaaaagattaagactcattgaaggctcagatgactgctagcaagctttagcaacaaagtatttttttaaataatttcaactattgttttagatttaaggggtacatgtgcaggtttgttacatttatatatttattgggtgatactgaggtttggagtatgatggatcctgtcactgagatagtgcgcaccgtatctaatagttagtttttcaactcttgccccttccttatctcttcccctactagtttccagtatgtactgttgccatctttatgtccatgagtgcccaatgtttaggcccacttataagtgagaacaaagtggtatttggttttctgttcctactaattcatttacgataatggcctccagttgcatgcatgttgctacaaaggacataatttcattctttttaatggttgtgtagtatttcatattgtatgtgtaccacattttcttcatccagtccaccattgatggtcatctaggttgattccttggcttttctattgtgaatagtgctgcagtgaacatacaagtgcatgtgtctttttggtagaatgatttatttacttttggatatatactcagtaatgggattgctgggttgaatgacagtgcattttaagttgagaaatccccaaactgctttccacagtgggtgaactaatgtacactcccaccaacagcgtataatgttcccttttctctgcagcctcaccaacatctattgtgttttgagtttttgataataggcattctgactggtgtgagatggtatctcattgtggttttgatttgcatttctctaatgatgagtgatgtggagcattttttcatatctgttagccacccgtttgtcttcttttgagaagtatctatatattcatgtcttttgcccactttttacatggggttatctgcgttttgcttgttaagttccctatagattatggatattagatctttgtctgatggatagtttgtgtatattttctctcatcttgtgggttgtctgtttactctgttgatagtttcttttgctgtgtagaagctctttagtttaattagatcccacttgttaatttttggttttgttacatttgcttttaaggacttagtcatgaattctttctgaaggctgatgtccagaatagtatttcctaggttttcttctgcgattcttctagtttgagattttattgtattgtattgtatttatttagggacggagtctcgctctgttgtcaggctgaagtgcagtggcgcagtgcaatctgggctcactgcaacctccgactccctggctcaagcggttctcctgcctcagcctcccaagtagctgggattacagggatgcgccagcatgcccagctaatttttttgtatttttagtagagacggggtttcaccatgttggccaggatggtgtcaatctcctgacctcgtgatccacctgcttcagcctcccaaagtgctgggattacaggcgtgagccaccgcacctggctgagattttatttttttaaatctttaatccatcttgagttaatttttgtatatagtgaaaggtaggagtccagtttcattcctctggatacggttagccagctatcccagcaccgtttattgagtagggagtcctttccccattttttttttttttgtttactttgttaaagatcagatggctgtaggtatgcggctttatttctgagttctctattctgttctactggtccaagtttctgtttttgtagaagtcccattctctttgggtaactgtagccttatagtatagtttgaagttggttaatatcatgctttattcttttcacttagcattgtttttactcttcagactgttttttagattcatatgaattttaggatagttttttataattctgtgaaaaatgacattgctagtttgataggaatagcattgaatctgtagattgctttaagcagtatgtccattttaatgatattgattcttcctttccattaacatggaatgtttctccatttgtttgtgttatctatggtttctttcagcagtgttttgtagttagccctgtagagatctttcacttctttggttagatgtattcctagatattttattttttgtggttattgtaaatagtttgcattcttgatttggctctcagcttgaacactgcaataacatatttttaaattaaggcatgtacattagtttttaggcatacactattgtatacttaatagattacagtgtagtgtacacctgacttctatatgtaccaggaaaccaaaaagttcatgtgactcactttattatggtggtctggaactgaaccttcagtgtctcagaggtatgcctgtatatgtgtatacatatatatatatatatgtatatgtgtgtatatatatgtatatgtgtgtatatatatgtatatgtatgctatgaagaaagattaaaaagagtaagtagagagtgacagtgggctctattttaggcaatgtgagcacagaagactgctcctctcttcaggaaatggaatgaagtgaagaaatgagtcatgtcaacatactgaagactatttcaggcagagggaaaagcaagttccattgccaaaaggcggtgaggagttttgcttgtataaggatttgaagtagtacaatgctctgttaacataaatatgtacagaatcattcaggtgttatagaggacagaataaagtctctctctctctctctctctctctctctctctctctctctctctctctccctctcctcccgtccctctctttctctcaagttgattgtatataccaagagcttagtactttgtaatatttcttggataccaaccctgatttgactcttttaagatgataactctagcggcagattggaggcaagattttaaggataaggggctggtggaagaaacataggaaatgcctttagaggtccgagtacttattgaacaaacaggagcagcacggatgttcaggaagtattattcctatgttgtggataaaggactggcaggacttgatggggaaaaagaaaattttcagaatcaccaagattttataacttgggagaaactgtctaggggtacagggaagacagaggagcctgtccctatatggaaggaataatgttttcaggttggagacatgagtcaagatgcctgtgattaacactgatgcaaatgtacagaaagtaattgcaaaaagaagcgtagtgtgcagattaggggtaaggctaagaatacaggtttggaggtaaaaatagtagttggacaatattgtcccagtgatacttgtagagtgactgaagaggatagagccagaattaggtattcgcctccacaggataagagaagaaagttgaaccaagaaaagatagaaagagcagaagagactgaaacaagaacatgtaaaaacccaaaatagaagtgaggagagaattatatgaaaaggggtgccaccatgttacatattacagataagcaaggaagctcaagaaataatacaaataataatactgaatatatccttcattggaggttaaatgaaataaggttttatatccaatgttctcggtttactttgtaaatactagctcgtggtcccccaaatttactacatgttcccatttttaaaattcagcaaacagatttaggtaacaacagtaaacttactagatatatcttacaatgggagcaactataacaaggtgagtaaaacaaatgaatgggaacgtttgctctggaaaatcaagaaatacacacacacacacacacacacacacacacacacacaatctttaaggatagttattaattatggaagaaacaaacctaaaattatgagagtattaattcatcctatatgataaaaattcttaacattttaaaaaagtcttgcaacactgtaacaaattcaaaaggctggatatttcttcctttaaaattgcttacaagtacaatccagtgaaaattctgtacctttagaaaatgaacagaaatagtcaaaaatttcatctgtgtttcttgtgtgcagccaaatgactagcatccttctctatccactccatattcttcaatcacccataaatagttccaaaaatcatgaagaatagataccactactcagaaggcactggcagatagataggatcaggagtctgctttgacaactacaaggaatttccttaagacatccacatacaaattttaattaataaaattgttattggcgaataaacagaaatggcaacaaggctggcatttgagtagtccaagtattacttagagctccaaagtactaagtgggtgcttgctacatgatggactgaagagcaggtggcatgccaaatgaaatgtccatatttttcacttgcaggaagtagaatattccctgttcaagtcaccaaaatagccctagatttagtcctctggtgaatgaacattgcatactcacatcatttccctctattgaaatgtttcctattaccgtgtccttctatcatcactattgtcatcttttcatccttcaatgacatagtacagattttaagtacccatatgagatttattctcagttctatagaaacagagcaatgggtgaaagaattcatttcagctctaaattctttgtggctacttttccttggcacatttttggagaactggacctctaattaaatgcacctttgatagatcactttagaaagaccattttgaagataaatttctacaatttacctcactacatttatttgcaggttgaatttattagttcaaagataggtcagttattaagggcaagatactattgcttgaagggtcaactgtagtaaatccaattaacttcactgaaaatattctttcgtacatattttcttcagtgagtataaggaaaataaactgtaagaaactgacaattatcctaaaaattaaagaatatgtgaaataaattgtaaaatttgttatttctccatgcaaataaaatgtgacatagaaaagctaaaaaacaaagcaagaaacaactccaaagaaaccacatgagatggaaagatcagaaaatgctactaaaattattagctgtgctgaaaatggcaactaactgctatagtgatattaactgctgtgataatattaacaagctacagttgctaaaacatttattatatgtcaaacactgtgcttttcatacacacatacactcctacaaagaaagttttatctaatttcacagatgctgcaattgagagagattaggtcaattatccaagaccatgtggcttgcaaatggcagagttgagattatatccaggaagtatgtgtcaccaaatctctatttccttctttctgaatctgttgtgtatactgtgtgtgtgtgtgcatacacgcacatgtgcatatatgcttattatttctttccaaaattgacgtttcttaatattatgttaattatttctcctcctcttgaactcaaatacattctacaatattcttccagaatataaatgagagaaaatcctgtcccttctcacaaaaaatgaaataaagttttacatagccttgtaatagctctgagggtttctcttagtgggtttatgattgccaaacctctgatatccaggtcagagaactggtttgagcaaaccttttatctcgcaaatggcctcacatctttatatgatttcagataaggtgaagaaggccaccactaaaatggaaacatagctaattatagtggccggcttgtgtaaggagaaagtgttcaacttcaaagaacattcagacaagaaagtcgtcatgggatttccaccaaaaagtctcatttctaataacagaacatttccattaaggtttttttttcctccatgccttattcttaatgtcccctccaatgcaagattgtgtaccaggtgttaagatccttatgatacgaggagagtttgattttcttcatagtattgatagttcactacaatgtcaggtataattttaagaaaataacttgtattaattaggtaatagggagtaatggttcaataacagtaggagaatttcatggtctcttctgaaatccagccctgataggtttttgaaatggagtaactctaagcacctttacttttatttatctcttattaaatggcattactaataatgggcagttgctgatctgacaagcagtgaagcaaagattagtgatgaaaagaggtagaaaaaaaaaacccttgagggtaaaagtagcaagtcagaggcaaattaatatatatttacattttctaataattgatttattcaacatatttctaattctacatcatgccgattgtgtgtgcgtgtgtttaactagaaatttggtgttcttagaaatagtacaaaaaggaaaaaattcttccttgttttcctttcttgtactcaatttctttaaattttcattttacctactaataaccttagaatatatgattatatatatattaagaatatatatctcaaagcacattataaggaggacataaacaacctttccatgtatgttcaaacatttatttatttatttatttatttatttgctcattcgacaaacatttattcagtgcttactatgtttcactggggtaggaatggggagtgcagacacacaaatatatactacatttagagcaggtcaggtataacaactagtaaagtgcaatgtataatggagcacagagcaggaactgatcacttttgtgtttgatagacaagaaggtcaggacagaaaggctgggagcagaaacagctcatgcacctcattataaggggatggacggcagagagaatgtattccaagagggaacatggaacatgcaaagacaggaagcagaagaagtacggagctatcacgtaggggaatgggaagtaatggagtagaaatagaaagcaaaagccagagaaaagaaggatcttgtataccaccctcagaactgtagtggagaagctacaagagttttaaataagggaatggcacttatgttttccaattgatcttctaaatatatatgaatatatatttataaatgaaggtatatgaatatgtgaataaatagacataagatctactattaatgcttggttttctaatcaaataagctgatctgaatgagatataaatattgctacagaaaaaagaaattcaagataaaaatgacaacttttttgtaaacattaagtgtccattcacttaattttttttaacttttattttaagtacacgtgcaagtttgttacataggtaaacttgtgtcatgagggcctgttgtacagattatgttgtcacccagatattaagcctagtacccattagttattttttctggttctctccctccgcccaacctccaccctctgataggccccattgtgtgttgttcccctgtatgtgtccatgtgttctcatcacttagctcccactcataacttacttacttataaggagtgccttctaccatttggctattttgtcaaccccacaattaacagtttttctatctaatctatcattgatgataagggccactattgttatgtaaactaagaaagccaaaaaacaaaaaaacctacactttgtaaacattatctattgtacgatatatctcaagttcagaggtgttgaaatactaaaaaatgcatttgggaatcaatgaaatcctaagacatttgtggatactatggttgatttgtcagttcattattattcatttcctctcttaatatggctgccctgcagtgaatatacttcccttcccattgactttgggcttgactgtgtacctttgaccaatagaccatggacagacagaagggactgtgtggcagctcttagctggaactttaaaggcagttcaagatttgctggttccccttgttcttatcttccatcatgagagaataatatgccatataaaagctgctctttccgctagggtcctgggatgagaagacatttagagcagatccatattctagaatgaaaagaccttaacttgattcatagtgtggagtaaagctgcagctgatctgcagacacatgagtgagtaataaatgtttgttgttatatgtcactggaattttgtcattgtttgttactgcagcaagagctgacaattacaatattatagtaaaacaaacaaacaatatgtgatttctgggacaaaaaaaccaaagtaagcctttaatataaatgtgccctggtcgcatatattgactgcactatctctcattccatacagaaactgtttgctaaaaagtgtagcaagaaacaaaatatgaaatggaatcaatattgtgttagagcctgatttctgcagtccagattgtcagtcagactctgacaaatgaaggctgatggatggaaaaacacaacattgttcagttgagtttctttgtctttcctctcatgttgggtgactgttcttttacttaactacaattaggtttgctagaccactgcaacacagctctctttcactataactgcatgctgtcaagtacgtgccaacctgattgacaaagaatgacaggttctctcttcccattttgaactaatcaagggcagctcaccaaagggagacttaaaaaaaaaaaacttagagatttatggatttcaaaaataatctgtccaaatatacaaagcataatgcagcattgatttttaaactggaaagtgttgtgaaactgtgaagatataatctactaagctgcatacttgaaatgttcaaggccagtgaaagagtgggcataggtgtgaccatcaagtaacatccagaagcctctatggaagctctccaccttaaagtgggggtttcaaagtctttttggcagaattcttttggcaaatgaaatattaccaaaactcttccaaaaaatcacttgagtcattccataaatattgacagattacttattgtctgctaaacattgtttgaggtactagatatgtaacagcgaataaaacagacaaactttttgtgtcctcataaaacttacattctaatggtgataatgtgtagtaaaagagaaattaaggtgctttggagagtgaaaagtgctaaagaacaaaatgtaaagcactggataggaataagagacttaggtatggggcaaagggaggtggcatgtggagagtttagaaagtgcctgcagggaaagcctcactgagtaggtggtatttaaataaagatctgaaggaagtgagggaacgattcaagtagctatctcaggaaagaacaatctgtgcagagacagcaagtgcaaaggccctggggcaggagtgtatgtgtatgttcaattaaaaaaaaaaggacaccagggtgagtggaatctagtgagcaaggggagagtagtaggaatgatagtcatagagttggggatggaggaggataggtcctgcatctttggaaggatcttggctgttatcctgagtgagattaggaagcataggagagttttcagcagaggagtgatgtgatctgacttatttttaaacagatcattctggctgctgtattaagattagactttaagaatgcagagaacagatggcagttaagaacagattcttaagggggtacaatctgcattgtttggatggaaggactttgtgaaaacctgaagccattattttggaaaactttatacatacagttcttaactaagggccaaagctctggtctggtttaatagcagcacaggacactgcttagaagaacattcatttaaactggtactcccaggtcttgctgccttcctaagtccttactggtgaagagtatgggctcttgagtctggttatctaggttccaatcctagcatgaattgactatttccaacagagaccaaatggcccatgaagcctcaaaaactgactgaaatttttctatttggccttttaaagaaaaaagttggccaacactgatgtagagaaacggttaggttcaggctctgtggctctaaaatccttcaagtatgcataattattccacaatgtaaacatatatcaaaacatcacattgtacctcataaatatatgtacttattatttgtcaattaaaataaaataaaaaatacaggggtatttttaataatcaaacattagaaacaaatgcttttctataaactccttatatagactcatagaaagagttaaacaatttataattagaatttatttgtttatttatttactattttgacacagtctcgctctgtcgcccaggctggagtgcagtggcatgatctcggctcactgcaacctctgcctccccagctcaagcggttcttgtgcctcagcctccagagtagctgagattacaggcatgcaccaccaagcctggctaatttttgtgtttttagtacagacggggttttgccatgttggccaggctcgtctcgaactcctggcctcaagtgatccacccatttcggcctctcaaagtgctgggattacaggtgtgagccactgcacctggccaatttgtaattatactttagagcagaggttagcaaacattttctataaaacaccatatagtaaatattttagactttgtgggccaaactcaaattctgccaatgtggcatgaaagtagtcaggtctaatacatgaacaaataaatgtggctgtgttccaataactctttatttctgaaaataggtggaggactaaatgtggcccttggaccatagtttgctgactcttgctttaggatattacagtgttgttggaaataatcagtctagaaataagaacatctgggttctaggcttattagcccatgagttggggcaagtcatttaactgctctaagtttcaggtttcagtatctttaaatataaaataaatgaaactaacagatattactgtgagtaaagggttaaaaacaccctttgtccatctgtatgagaatttgtactttgatcaactttctagctcccttctccctagaaaactgataaagttggaatgtcaaatgtgtgagcaggcaacattgcttcagattaaaaaaaaaaatgatggggactggtaaattacaccttggttaggtgttctacatatgaactataaatacctaatggaaaaccataattgtggggcgtccccaagtacaacaattcttgtaactaagcatgtcctttttgaggaccttggaaactatgttacaaggcattggcctctgggatgcataaggcttctaggccagggttgacccagcatctcgatttgtttccttcctgtgcacctgagatgtcatgagagagtggacaggtgctgcaaagtgaatagctcttggatggctccctgggtgcttcagagattgctacgcatactcatcctactaaagagagatacccgatgctaccttcctgctaagctatattcctatatccttctaagtgcctttgctactgaatgtggtcatagtattgttcagttgcacctaatcaaagaagacttactgttgtgttttacaataatcaattataagactcacattttatttcaacaggttagctgctctgaaattgggacacgttttataaatgatagcgtgtcatagtctaaaacggcagcacatttttcttggtgaaaaataaaataacaatgcatactctaatcaatggtatcttaaaaacagtaaaatatggaaagtgatcaggcttttcatagtaggtcaggatgaaatgatttagtacatgtaaaggtaatactgctaccatttgttggaaactgactaagtgcaaacactctgctatgcacttaacataaatcatcttaattaatctcaatctccattgcagagcctctcagcaatactattaccattttttcagattaaaaaactagagtcacgaaaggtcagaaacttgcctagggcacaacctaacatatggtgaatctgagatttgaaccctagtctttctgaggcaaatcctgcatacataattactatgctacagggtctctggatttaaatattgtaccaataaaaagtaggttttatttgatgaatcctacggctcagaacggaacaaagtagtttcgattaggatgtaatgtgagtttcaatcagggtttctcagcttcagccctattgccatttgggactggataattatttcttgtcgggagctaccctgtgtactgcagggtgttttgcagcatgcctggtcactatgcacaagatgccagtagcactttctcctcccccatgtgtgacaaccacaaatatctccagcaattgccaaattcccctggaatcatctgtggtagagaagcattctattattgaatacatgaaggaacaaatgaaagaatgtctgttcacggtctgtattttcagtgtacatgaattaatatgacatgatatgaatgtctttccttcctttctcttatatacaacattgtatgtaatgtcatctgttcatatactctttcagatgcacttttatcacgctatgtctcttaacattcatttgagtgtggttctgatgaattctaaccatcatggcatgtttcagtttctggctgaatgggtcctaatatctctggattatataccccaaaaggattagggaatacagtagatctaaggactagaaaggcacatattaaacaaaagtgattttgacatatctctgaatagtggccagtgatatttgcattattttaaaccaatatagagcatctctaagttattatccatatagtaattggacatggttctttaagtcttaacagaatatttacttaaatctgttattattaaacactagaagttgctttttaaagataaaacagccattaggctaattttcattaaaagcaaagaaaagagcaattcaattctgacttcatgactgacatgcactttaaataaaattaaagatgttttgtttttactattaggttctgtaccaaaatcatagtcattatctaaaacaactctttctaagtgctaccataactaataaactcaagcaatcaaatgggtaattgaattaaactcgtatttttttaaaaaaaaacagcaacaatatatctgcattctctcttctgaatactcttcctaaacatgtacaggaaacagcaaatatatgggtttctgaaatcaagaaaaaggacacattatgtaataaagccaattcctggtttactcaatatgtcagtcttcatctgtgataccaggtctttagactgttgcacttagcctttatacacttataactcatgatttccatatgttccactaagtagccattttcactagtctcctgaaaagtcaacgataagattttggataaggaattgtagacttatatattaggtgcatataatccagaactctactagaatctagaatatacagacaactcatattaatcggtaagagaaagtaaacaatccaacggaaaattggggtaaatatatgaagagtcaactcacagaaggaaaaatctgtccaacaaacttgaaaacttgttcaaccagggatatgcaaattaaaataataaattcctgccacttcttgctgctggtggaaaagcaatttgcaatatatgataaaattaaaaatgtgaatactctaatgaggtaacaattccacttctaggtgttctcatatgtctatctgaggagacctacagagaatgttgtttcagcattgttcattagtgaagagctggaacaatctgattattcactgttaatctaacgggcacattgattgtttggtttctattaaaatcaagaatacttttaccagattacttctgtattctaaagccattaaaaatctttgttcgtatttttatggagtccaaagttctatttaagctagtcataagcaaagttaatgctactattcataatggactcattgaagatactaaagataataaaataacaatactatctctaacaaattggactttagttacaatggcatacacagtacaatgtccaaataacatctgttcagttttgagtgaagcacaggaacgtgtatgtatgtatgtgtgtgtgcataatttgtatttgtgttatctctccaattatgtaaatcactaatacttattactatgctaataccagaagacgtattgtaataaaggtcacatgaattattaatttttgtgtttcttatcacctatttcatcaaataattttaaagacagagatgctatctatccacactttctctacttgtcattcacaaaagttccttcaaacaaatcttaaaaattaaaagtatgcgcacatggctttgtagtttcatgtttcagtaaggagaattttacttggatcctatacattattgtgagtgcttccatgttttgccttcttaatgcttaccaaaattattaatgtcaagaataccaatcttggccaggcatggtggctcacgcctgtaatcccagcactttcggatgctgaggctgacggatcacttgaggtcaggagtttgagaccagcctggtcaacatggtgaaaccctgtctctactaaaaatacaaaaattagccgggtgtggtggtgggcaccagtaatcctagctacttggcagtctgaggcaggagaatcccttgaacccaggaggcggaggctgcagtgagctgagatcgcagcactgcactccagcctgggtgatggagcaagactccacctcggaaaaaaaaaaaaaaaaaaaaaaaaaaaaagagaataccaatctcattttaatgaccagcatgttacataatcaattattataaatgattttaagctgtttaatgttcaaattaaaacttttcttaaaatagcctaatttaaataattatggatgttttcattaactatattatttgtgccctgttatgttcggtaactgccaaatattcattgtgtcaagggggtcaccaaagtgttcagaatttggaaactgtagcttcagatgtattaaacatgcaaactctacttttttatatgtatcattttgaaattacagaacaaactgaatgcatttacactaagtaataattgaagcagttaacttggccctacggtgtttccttttcaaaatatatgtcagatatatacagagaagtgtttaatatcccctatatgcacagatacatatatcatatatatgatatatgaaatatataaggaatttaaattttctatatcatgaatcacatactgattcattcattcagtatgtgaatgcatgagtctaatcccactgacactattgctcaaaggagggtcaggaagaataggggggaaaatgatgtgaataggaaaacagtaagcatatggcaattttgaagtatttggaatacaaagttattataagttgagtacagctgacaaaaaaatgcatagtaacatcagctaactttgcctagtagatgataggggtacttatataaaatagaattgtatttgttaattagaatcataatatactcttcagtgatacagaacttaatatactaagtgaaatctcagtatatagaattgtatattcaagaggacatattgctatggcatttctaagccgtaaattcaacgcataaagtttggatgattacatcttcattggagagaatcatgttactttatgatatattttcatactgataacatctaagtttattctgaattaggatatatgaagtattacttaaaacccttcagaatgttacatagttttgttagagacatgcatctttaaattattttttagataatatattattatcatttggtaatttttctcaactctcaaatatgagtggaagtttaaattggtatgagttcttgagatggaaactgaagagtgaaatagctttatttaaaatagatacttctcctaatgctaaaacttaaagtataataaaaaaaataaaatagataattcttaaagtgttctttttagtgttcaataatttatatatatgtattatatacattatagttataatggcatatacagtataatgttcaaataacatctgttcagttttgacaaatatatatatttgtctttttctccccattgggaaataaagtaacaaagattatggccacagtttatcttgcttttgtttttcctcacagcacctgatagagagttctacctgtaaacaccaagttcactccctcctccactaaatgacaatgtaacaagtggcttcaagttgctccaactttttggaaggcatccttatacataatggataatcacgcttgtttttagaggtatcataattacaaatttagaattctaagtgttcttcagcagtaactcagagatttaagaatccctttagtaactgatatagtcagcagagaaccgtatttcctgatgaaaatacaagctcagagccacaaggtcagcagggtagagacttatcaggcagacaagaggcactgttccagagagcagagggtcagaggagactgcaagtacctgcatagagatctcaggtcatgtataatgcttcctcatctgtcaacccagctgccattttggagaggagcaggaggagagcaaggaaatctaaaagactggtcattatccatgaggtcccaacccataaaaagagactggtgaaatcactatttcagagtgagatgataattttttctcactgcccagtatgggaaagggttatgaagatcactgagaaataaatgaagaagttttcattctgagaatcaatatttgactcccggacatacccatttaacttctcctgcatatttattgtatgcatgaaaatgtatctacttaagaatctatgacagtgcttttcaaactgtggttccacagaccagaaataacagtttcacattaaattttaagaagcatggctctagataggatatagtagaataaggaatggataagtgttagcctcccagattttaattcatttacatacttatggatataacacttatctttaaatgatacgactttgtgaataaacagcttcatgaatatagctttatgagacaatggagaaaggtggccaaattttttaaaaagttatgattagaagaattgtgttgttttaagtattgcaaattgcaagtgcagagcatgtctgaatgtatctgaaatcccaacgtgttattttctaccaacagtcaatgccaccaagggaggtaacttgcaagtttaaaaccttcctcatttaacttccattgtttctgcaccgcgttctgtctgccaatcaaagccatcccctgggcattatagttagtaaaccaggtggtccattcatccacttaagcagaaattgtttgaaaatgattggaagtgttcccatttttctcctccacacagaatcagaaagagatgacacccatgggcagagcagagttttctttagagtacataaaaaaaaaaaactgatagcatggcttctgacgttctctcataacttccttcaaagtattatctaaatttccttctaaaggagtagtgaaggactgctaagtaaaaactaaaattctaatatgcagtaaaagcattatttcaagaaagtataaacatatttagggtgacaaaatgactttttaaggtttatttcaaaagcaagagaatgatctaggagagagtagaactgctttaggagaaaatggtataatattggtgaatggaaaatagaaattggaaccttttaatttctattgggtttgtttcttgtatgtcaagaggaatggtattctaactgcaaagaataaaacaaatagcagtgagagggaactggtgtccaagatgggtaaagagattagaaagcccccagctgctcagaattaactctcttgatgcagataaattacatctcagtatgctaatacaactggcaagtcaaatggcaaaccattgtggttactcatgaagactgggaaagtgcagttttgattttcacaaggaaaaataagtgtgggaataaaatgttaagcttccagatagttatttcagatttggctagaaaatgcaatgcaaagagaagccacaaaccttctttaggtaatgtattttgaaagaatgggagtcagttgacacaggctctttgcaaagacaaaccctgttctagccatcaatgtattgttagataaataagaaaatgaaagcaaatatttacatattagttaaaaattttttaaatctctacttgtgctacaatttgtcatcatgttgaacttctgtccaggattgatggctaagaagagcaaagaccattcctatgcaattcaaaggttagttttgatgttttcaggttataaccttaagactagaatctgtctgttgtagaaaacattcattaaaacctttatcatagaaaaccatgtttttacttcaagttgtaaactatatttgccttagtaagaaagagaccaataacccaaaagagaacattggcaaaaaacaaaaaagtagcaaacagtgcatagaaaaggaaataaaaatgattctgcaacacatgaaaaaattcaaattcactcacaaaatgaataaagaattcaaattaaaatgacagatatcaccatttttcttgtttagaagatcaaaaaggttgataacacactgagtgggcacgggtatggggaaaagaaacctttcctaatactgacgagatgttctatgaagagcaatttggcaaaatgtactaacaagacaaatgccagtttgacgcagccattcgacggctaggaatttatcacatagatatatttgcaacgtgtaaaatgatgtgcacaaagttatacattttcttatcttagccaaaagtcgaaacaaactaaaggctcactaattggagtgctgcttaagtgaattatggtatatccttagaacagaatagtatgcaactgtaaaaaaaaaaaaaaagagacagttctttaactactaatacagaaaataatcacctgtgtgtgtgtgtgtgtgtgtgtgtgtgtatatatatacacacacacacacagcattttactcttccctttcttataagggagggagaagagtgctatacacacacacacacacacacacacacacacacacaggcattttagtctttcctttcttatgaaggaggaagaagagtgcttttccttctgccctcgccaagccaaggaaaagggcttcaaaagaaccatcttttgaaggatgcagaaacagtatttatagtattctaacagctggctttattttaagaggacaagagtagaaaataatatacacacacacacacacacacacacacacacctacatcctattcttggaaggctacccaggaaactgaaaaccttggcagcacatggggagagaaactgtgtggctgaaagacaacaatgcaacagaggatttcaatgcttttgaattttgtactggaagaaagtatctattcaataaataaacaaaattattattattattattaaagatggagtcttgctctgtcacccaggctagagtgcagtggtgcaatctcggctcactgcaacctccgcctccaggttcaagggattctcctgcctcagcctcccgagtagctgggattagaggcactcaccaccatgcccagctaatttttgtatttttagtggagacggggtttcatcaccttggccaggctggtctggaactcctgacctcgtgatccacctgcctcagcctcccaaagtgctgggagtacaggtgtgagccattgcgcctggcctatttatattatctttaaagtctgttatacagggataaatttacccccaactttgtaataattaacccagtatgacatcactgatacagtactaattaactcattttctataaaactgtgcagattatcttaaaattcgaaacaaaaatgaagtacaatacaaatgataacaacagttccagaaaacaacacttaagcataccacacgtaacacaatgtaataacctgcgttatattctttggtaccctatgctatcttattctattttattttacccattaaatggatttcataactcatcagtgggttgtaagattctctcccgggcctgaaagcttaaggagatgagtaactcctcctttctcaggcccattcctaaggcacaaggctacttgcctgagcagcatgcaccggcgaaatagcagaagcaggaagagagccggccagaagacaagtacctctgaagatcgagaaagaggccatccgggtacaatgcagcagttacgtcaggccaggagacttcctgtttacaggagactataaaacctttgtccagtcctcacttggggctaacgccattttaggcctgaggctgcccgcacccaggcgctcattaaaacagcatgttgcggccgggtgaggtggctcacgcctgtaatcccagcactctgggaggccgaggcgggcagatcatgaggtcaggagatcgagaccatcctggctaacatggtgaaaccccgcctctactaaaaatacacaaaattagccgggcgtggtggcgggcgcctgtagtcccagctgctcgggaggatgacgcaggagaatggcgtgaacccaggaggcggagcttgcagtgagctgagatcacgccactgcactccagcctgggcgactgagcaagactccgtctcaaacaaacaaacaaaaaaaagatttgactggatttgttcctgtggtaggcacttcattccaattttcttgcccactttttggttaatgacagactttcttccgctttacaaaataaaagcacacctctctgacctatcccactggtgcattgtagtcaagatacatttatgccaaataaaagtacaattcaaaatattagcgactgaaatccttctttactcaaggtaccatcaaatacccatccatctcataatagattcattttcaataactatccactgagtatgtttaataattatttatcaaaaggtacatatatttaggttatttggttattactaagtgtatttattattaatactttaaatactactcaatctagagaattttaaaaatacttagagccttgtagtcacaggaaattgtttttaaaaattgaatttaagtccacataaatataattttataaagaattatgatagagtggctaataaaactttatagcataaatatgtatcacatatttatcacattagaatacaattcattggggaagttgaaaaatatgatttaaataaaaaggaataatataaaacttctatttattaaatatgagctttttcatgtatttttaagtatatgatggtagacattatattgcaatggtatttggattccacgggatacattctaaactgtactataaacccttttaaaatgtcaatatttactgtatcccaagggcagaaaatagatgtcatctttaaaatgtgcaagcagatattcaattttctaaaatatttttattttttataaatacaatggtctgaatgccactataatagaggttctttgaagccctcttccttggcttggcaaagaggaaaagcactcttctcccctccctcataagaaagggaacagtaaaagtcatagaagttttctcatgtccaacaaattgttagtcctatttgaatgatctgttccaggaattctcattcaagaaactgttctcaagtttatccttttccttatatgggcaagttaggttggtgaacgatgaaaatctcatgaccatctactcccttttttggagtgtttttctggtaccaacttgctgctgtaggggtattttgaaggccttttttttttttttttttttttttaaagaagtcttgctctattccccatgccggagtgcagtggtgtgatcttggctcactgcaacctccgcctcctgggttcaagcaattctcatgcctcagcctcccaggtagctgggactacaggtgcgtgccaccatgcctggctaattttttctatttttagtagagatggggttttgctatattgcccaggctgatctcaaactcccaagctcaggcaatccacctgctttggcctcccaaagtcctagggttacagacgtgagctaccatgcctggctgaaagcctaatttttattgttagtacctcttaccataactcctgatacaacaagaaaggtcccattcactgtctttttctacgccttaggaaatgtgttcccatcttagttttgccttatctaacagagtcccagggaaattcactcaatttttcatttttagtgaagaagaaggtcaggttaaaaagggtaagtgagttaaacaatatcgtaaagccagtaagtgtcagcactgggattcaaacttagtcttttgtttctttccccttattattctacttcaactcagcaatggtttttggagttgagtagaaaaaacaaaaagtaagaggaagattatggtacccagtgttcataaagagaagcagatgcctaattccactaatagatgaaactatccacaaacttaaacaaacacgcttcaaggtgttatcaagccagaattatactcttgcccagaggcaacctaaactcaggagaaaaacattcaataaatctgtgttcagttgcatggtaaaagggaataatttgtctttttgtccagtaactgtcatccagtgtttttcaggacacattccactgatattttcatatccaatataaaacactgaaacttttttctaaaggtctcttccttgttccttacctcccgaacaccacttttaaaaaattttttttaaaaatgaaatcagataacaggtgaacttgagctagtacacatctatctaagggagttactatttgaatttgaattatccattctaaagtgaatttaatgacattaacctctgcaaagctaattttgtgaatgttgagtacactcctgactgattaattgggaatccattggtaagtctgactccttacccacgaaagcgtggaagcatggtaacatcagattttgattctcagtaatctgagtatattcttgagtctagagtcccaggcttctttgtttgaaaagcatcattggtttagaacatggaaaattcttattgaaatctcatttggttcaacttcagattttcagtatttagagaaatcattttctgtacagatcacgtttgtagagacctcattcatgtttcctttttttgttgttgctgttccttcggtgcctctttcctccaggagacattctcactattctgtttctcctcctctgaagactactgctgattagatgcttcacctctatggcacaaactaggcttctcttcttgttagtttgatttttactaaagatgaacttcaatggcctcttccgaaaacataagcactccctaagctggctcatctaagacctctcccttcccatcaccaccattcctccttcttcctttgactacttttgatcttccctttagctcccttaaatccttcagcatattcctcttcaaacccgtacctgctccatctctttgtccatccatgacagacctttctcttcctactccagtctctcaactctctatggtctctaaagcgttatgctccctgccactactgggggctctggaaaactcaaaccccagaagcaaccacctgaggttgaaaaagctaattggaaacagactggataccgtgtacgttcagatgggatttggagatacccagatggccactaggtatctcctcagtcatttactcaaattttagaacacagcctccataaattacatatcagggcaaaagaaaatcttaaaaggctcctccacaaatattgatgtaaacttttagccctcatattgagtaggtgaatttaacttgtattcataagctttgctagttggctatgaaatactggtatatgacaaacagttcacacttagctaattcctagttttctctataaaataagacttactaatggttaaaaatataatcaatatatgtaaataaaacttccagaaacattaggggtaaagggaaacaactttgtatgcaaaatatacaaggtatgttggatgtgtttttgttaaggaaaaagagaataactttgtcctaaattaaaatgactgtgaaaatgaggaagaggaaggtataggacaaaatctgaatgaacattggaaatggcagaagatttgtggaaggagagtcttatgttaatagccaatgctggctaaaacggaatggatttatgtgtatgtaaactcttacaaatgacccttagtatcaacagtgtattgatcaaaaatgagttgtagtttctttttgttaaaaaatgataaaatattcttggattattggtctgctcttttgaaataaaattgaatatacttaagtatgcaacatattttgatatatatatatatatatacgcacacacaaaattgcaaaacaattatttcggtcaaactaattaacattttcatcttttctattggtcttctcttaataagagattgcaaaatttgtttttttttttatattttgggtaatctgtataggaaacaaatattgtttcttatcagaataagtacctgtgttgattttgtatgtccttgaatttttttagaaagtagtgttttctctttggaaagaactaaaaacttttaccgtcatgtggccttctacatttatttttgaaatcttttattgtcatcttggttacataggtagccatgcattctttcatagtgagcaatgatcctattcagccaagtattcaaaccttttgtcattttacaacctttgatattttgcttttcccaggtcaattcttaaataaaattttttttaatctcagattggtttgaaaaatttcaaaggatttgttcctgcacccttgtaaaatgaaggatgttaaaaataactaggttcatttggtatgttgagttgcataaaaagctttgacaagaagagatgctgaaccttgactaggttatagttgtatgggtcaactattattagtataaatacttgaaaaattataataaatccttagaactttgttagtgctctaggtgctctaggtgtccatgacacatcctggtgctactttatccgataataatattatgtcatcagtcctaactccagttgttattttaaaatgtggcatggcaccagggaaaaaaaaaatttcttgtcgaatgaatcagatctttaattatggccattttaagtcttttgtcgttcacagatagtttttggtttatgctgatgcttccctgagtgctcttacaatcagttagaggtcagaatgcatcatcttcagtaaaacaggaccatctttgagacccataggaagtactacgacaggtactctgggacacagacttctgatgccattgcttaaataacttcgagattataccattggacaaagtcaggatttatgaaactctgtgaagaagctgatgagttcatgaaactactaactcaagatcaagcaagacaagaattaactacatgggcctgaatgaactgataaaagatttgattatggcttttgtttaaaatattcctcatgttttaatgttctgtttgctaaatacaagaaacgcctttcctttttctcttaagttatctataactcatgagaatttagagtatgcttttgtaaacagaatgaaacattaatctttttatccctgcctgatccctgtaaaattcagaaattcttaccgagtattcttattttcatggcaatataattatttgcataggctcaataaatatatttaggtaacaagacataattgaaaaaaatatataaccaaggctttgactggaatgtcatatttgagaattaagtgcatagagtcagatgtgaccagttttaaggagctactcttgactatatggagctaatataagccccttttgggaaaactgtcccggtacctggcttacagaattcccaatcttacaactgagtaaggaaggtctattcttaggagacccaggaaaccaagggtattttaggaacctggaaaacagaacacttcagctgaatctataggtattttacttcaggtaaaatctgatgtcaagttcttgacttgccttcctaaactttggagacttttaaaaaatcaaatctgaggtttcatattttttaaactactttattgaggtatgattgacaaacagaaagctgtacatatttaatgcatagaacttgatgagtttggagataaagtatatatacaaaaccaataccacaatctatgccataaacctatgcgttacctccaaaagtttcctctcaccttatgtaccactgctcctaaaagagagtagtagtattttgtggtaagaacacttaaactctgccctcagcaaatttctaattgtacagtacagtatcgttaactataggcactatgctgtacagtatatctctgaaacttattcagcttgtgattcttcatgaaaacttccagctaatcacacttaaaatagcctatttggtaaattaccatttttgctacccctatataaataaataggccagtcttattttataaacaaggaaagtcttactttgattaacactgatcaaaagggtgatggtagagatagagtttcagtaacccttggggttatcagattctagtcctgttcattgtctttgatctattttgcatttctttgtaaacgacatgatttttttttttttttttttacctacctgtaaattgatctggatcctgctgtcttacacattttgtccgtccttaccaattttcagtttatttcctttacaatctggctgcgattctccaaattaacatttcaaatttttctcccaccatcctgacttggtgacactgagaactaaaacgtgactgcccatattattactgagataaggactctcttctctaggttgtcttatagctgccatttccccacaatatctaaagaagccctgcaagcagaagctggatgacttgctataaactacaaaggactcaccaccacagcaaattatgtatagacaactttcatgcctggagctgctgctttgtaggccatgcaaaaagttcagtaaactccaacctcttccgtgccatgctccaagaaatccatcggattgctactgccatcctcactctaccatctgagaatgcctacagcccagcttctaggaatctttttgacttgctgccctctggactcaaaaactgagtttgcagtctgcttcaaccattaatcttcgtcttccttctaactttcatggaaatctccttcatgaaatgtctgattactaccaagtgtcagagttcgttcagctagtccttcaacaacagaaacctgctgaaatgaactagatgaactggcgttcctaagtttttcaatgggaaaactggtttcccttgaacaaaatggagggttgacaaagaaagctttaaaaataccctgagtttgactacatttgagacagatttcttcctgactttagacctgaccttccttttcttagagcatttactctagaaaactttatatattatttctctacttttttgagacaaaaatattctcctagcctcttgccacttttatacctcaggaataaactttctcaaggacttgggagctagcactttgatatagaatcatcaaaaaagatagtgccccaatctgctagtcttctgttgggaggataggaatctaactttgataagtgccaatcagcaaacacagatggcctaaataagcacattgactaacctccctcctgatatctagtactttctcactaactcatctcagcacttagaggctctcctgccttttatttcagcagaattgagttcaatctgtctcctctattgcaaaagttttgaacacagtctttcttgtctgttgtctagtgctatttttctttgacaacactcacagcaatgtgaacacacacagtgttcagtgactttaatggtcagtcactacaattgagtcctttggtagtttttagtgtggatttgacattatgggcaattatgctccttatactgcaaggaagagccagcagagccacatgtcatgtttatttataaaccacagaaggaaagtgattcttgaggggaggaaaaaaccccctccctgtgattaagatgaaagtatttcagtcactaagccttaacataaaattatgtgtcccgccacacctcatattttaataaaaagtttggaaagcagtagtcagtcttatgtcagataaatagtatacctctagctcattattgaaagcattcattaaaggttaaaaacataagaccctttatagaaattctaaactggtcccgggatcttagcattcaattatcatttctgaaatctgaaatcaacatattttatgtctaaattgagagtatatttgaaaatcaaaattcaaaggcatgccttctagtgggctgactgatgggaaagggctgtgattacgcctaattttcaccctctacatcacgatctcattgattatgtttctcagcttgctaagggttctgtgaggtgattttcaagatgaatattgctatttgcaggatttcctgaataggaatatttcgggagtaaattgcacaaaccaagcaatgtgcagtcaattttcactccagcataaacaatgtattagaacacagcccttaaagcttttttttatctgggtttcactacacagctagctgcatttcatcaataagagtgaagtaccaagcagacaaaactgaggctcacagagagagggtattacatatttttctaacaggtgtgctcagagtttgactagagaaaacaaactacccgaatggcaaggcctcagaccctttgtttccgaggcagctatggccaccatggccagacaaggcaagtttctttacatttaggatttggagctaggggcgtggctgttcgtatatctacttcctttgcattaactctttcttaagattttagtaaaggtgtttttttttttttaccttgtgttaaaaaaaagggcatgtgctcaaaactccttaaaaattttatttttggtgttcagtagtttgaaactaagtaaagcaaagtctagtgtcccatctttctttaatggaaaaatagtttaattcctttaagcagaggaatacagcaggctgtaaggactaatatcctatatcttaaatcagaaaaactgtgcaatcttaataaatcatttattagtgaaaggaatggaagctagacaaagagggataaaaaacaaggtaaattattattcacacaggtcaccatttcctaattataagctgggggtttgagaatttttgggagaaactctcaagtcatcaaatctatgattttatgtttcccctccccccaccttgaacacagccacaagcagaagaaaaaggctaaaagagtatttttgaagtctgcactccagagataagaaactcggaatgtgctcagaggactgaagccaaggagttttctgccaggaaaaaagcagctccctctcccctcagtgatttaaaacaagctgcaggaggcaaatatcatgactctcagaaactacacacagcagtgagtggtgacttgtagctttgataaagaaaagtgattaacacagccgagtatggctttcacttcaaactgcagggacccatttggcagagccctatgggccatagacaatcgaagacacaatgcaggttttcattatttgaaaaccattccggggggcacagactgggacaaaagtcattttgattgagtaaacaggatctatttgtaccaagggattcaaaaaaaaatcttttcttaaatgtgttccaggaagagagatagctagcattgagtattttttaaactattataataaagaggcacattttaaccaaagattgcatttaaaagagtagaatgtgcttttaccgtgagctacaaaaagctatttctggttgggaggaaagactttatgacctttcctcttcgcaatattacgccagttactttttaagaatatactggatataagataattgagaatttggctaaggttattgtgtattgggccaagtaactgtactttcttgttggggttgtttattgagcagtgaaaaatcagtattcatgagatgtaattgtactggtgaataggagctagtcaaacacctctgagtacaatatgtactagctaagtggagaaatggtcaggatcctagaactgatggcttccctgagacgatgatgtgttttgtacgcacccagtcttgccccttgtgatcatgtatgactaaaattcagggtgatgggacatcagaagccacgtcttggtatcaagacttccactgtgcctttaatgtgcaggctgttgttacccatcctgtataatttcttaaagctaactaaatttgttactgggtaaagcctattatgtctcgtaaatttaatcatcagactgaacccaagactgtgccactggctgagcaggctgagttttgtgctagtgaaatgatgtctacttgtgacttccacagtgccatctgctcttgaggagtagctatcagaatggtagacataagtgtcaggaggaagtaaggtaaacatagtcgagaacattttgctaatctaactcattttagttgtagcaaacttccctctatctccttgttactcatgcccatcttcccgaaacttttacttcctcttcactagaatattctcaaacttccttttccctttgctctcagttccagcaaaacaacagctaaatggagattaaaatgttaggtttttacaatactggacagtaaataaatttaacaattaaagtcaattaaataaaagaaaaaactactcaaaaatgttacttatcctttttactctgaagttgcccaacaatacattcattaatagattgtaatttcaacgattcggtttatttgattggctacttaaagattttggcaaataaggagacgcaaaacggggcagcatattgaaagaatctttggaatagattccttgaaagggagaaaagaagatcaatcagcatttacaaggacactagaagaaggagatagtggtgttcaattggcaggattgtctgaagccttacgcttacctgcagtatctcattcgtattctgggtgtcttggtactgtctttattcattgacttaaaaacactcacaagtaagcatcatttactggatcctaggctgagtgtgtatgatatgagtggagaagcagagataaataagagaatgccctctgcactcaaagaacagtgcagatgtgtaatgaaatactcaggtgtataaaatttaagtgtaaatcaacatatgaacaatgggagatgaataaaaaggtttataagaaatcctaacagggattctaactctacttggggtacggaagaaaacttggaagacgcaatgactttgaattcattcttaaagaatggaagaaaattcattatatcaaaataaactgaaagaagtcatttaaagaagagagaaaaccaagatcacaggtatgacatgaaattacatggatggaaaggtaccaggtaatttgatgtggccagactatacggggagattgctggcagaatgagaagatagaaaggtaaagtgtagtcagtctgagagggctttacaatgtctacaaaagagcccagacattatattttaggaacctaatctcataaacaacttcaattttggataaggaatctatgaatatgtattaagcacaattaaaacagggatagaaaatgaatcacagtaacaaatatgatgcaggcattctagtaacataagtttaatgaagaccttatttctagtaaatgctgaggaaaaagcaacatattctagtaaaataataataattattatcattatgacaacaatgatgatgatgacaaagattccctgcttgactaaactttagtcaggcttctgaaccttcgcctgggctcatctttgcactcccctgtaaaatccaggttcagcaaagaagcctgtcagttttacaagaaccctttatccttggtacctgatcaccctcagtattctccaccattccccaagggttgtctgataagataaccctggcctatcttcagcaagaatcctgtgaggttggtttagccagaatcccacttacccctgatgtttcctcttaataattttccatctactgactcctacactgctccttggctataaattcctacttccactgtgctgtatttagagttgagcccaatctctctctatccaacctcctgtaatactccattgcagtggtccctgtgcctattgtggttatcctgaataaagtcttccttaccacactttaacaagtaatattttgtctttaataatgataccaaatgagaaaattcagtgatattgccatttttcttaaaaaagacaaaaatatttaaagcaaaaagttccctaccttaacgtcaaatggtccttcttggtttggttggttataaatttccaactgattcctaataggagataaccacagcagcagatgatttaactgctcttcaaggtcttcaagctttttttcaagctgcccaaggtcttttatttgagcttcaatttctccttgtttctcaggtaaagctctggaaacctgaaaggaaaatacattttaaaaaggtaaataattctcaaggcataagccaaaatgtttaaaaatatattttcaaaagttatttatcatgaaatattacagaatcttactgatttgtgttattttagcagcataatattgattatttacatatattacatgttgggatttaaccaatgtattcaaaattattcattaacctgctacaaaaattctttgctttaaagaaactaatacctttttggaatttcaaaacacacaccttacacaaaggcatagccaactgcaactgataaagtaaagaaatacatctttcatttattcactcagttactaaatatactggtgtgttgtgtattatatgccatacgcgcttcctttgcagttataaaaatgaataagccaagttattcagcattagcaccagatatataacacaggtcttctaaatcccaaatgagtgatttttattcaatgcgcatcctaaaattaaaaccaaaccaactataattttgtttgtatagcaatcatttcttctactatacttgcttctagctttcttttatgtcatggaagattgtaaaaggaagtcccttcatgtacaaggaaaattggtaagttatgcgtttttgtgagctatagtttgtgagtcctagtaaacagaagcaggtggttgagatgagaagtaaaaagaacatttggattagagtagactgtaacagaatgattataggttatttttattaagagatcagtatatgccaaccatcatccttggaagtttcacatttgtagacttccttaatccatccaacaatgctacgacatagatattattatgatcccactatcacacatgggtgatgacgttggggttgaaaaaaacattaaataggttaggaagcagcatgacatggtattaagcattgtgaggtctagagttaggccacttggatttcaattctggttctagttcttgcctaacattttagccaagttttctctaactctcaatgcctcctctgtagattggggacaatgatagcacctgcttcataggattactgttaggactcagtaacgtcatccctgaacataccttagagcaatactctgcatgataatgaatgacaataaagttattaagtagcagtgattattgctcaagcttacatgtaaataaagagccaggataggctgagcactgtagctcttgcctgtaatcccagcactttgggaggctgaggcaggaggattgcttgagcccaggagttcgaggccagcctggacaacatagcaacactcccatctctacaaaaaaaaaacaaaaaaaacaaaaaacaaaacaaaacaaaacaaaaaaacagagccagaataaacaagagtaaagctattttcttcagaatatcaagagttaaaactggcatcccagaataaagaatttaaacttgtaatgatagctctttacgagactattaacaataccactgtaatacaaaatattacactgcaatatgaataaaattttataatatacatctgttccataataatatattatgaataataatagagaagattttaaaaataaactagataatataccagtgtgtcacataaacaatgtcacatgctttggaacaattgttttagatacttttaaaataagtcactaatgaacagtacattgtttaattggatgcaagagttaggagatgaaaaagagaaagttgtcgagaaaaaaatcaattaatgtacagaaaaatgaattttaaacaagattgtatacgtaaacaatatgtacagtgaaacgtcttgtaaatgcatgtatatatgttgtgaaaaattcatgagactgtataagcaaaggattaacatccagcctgggctgttgcaggtcagtctgggactgaccctaggctcccacagcactgtttccttggaaacactaactttaagatgaatgggaaatgttgggcctggctttgtcgtgtggaactgcacctcatcgcaggagctgtcagttggaatacagtccttggatccacgtgactacaatggtgtaaaagactgatgggaaatacaggtggtggctcctgttgaaggtgacctgcacacttcttgcctctcattcctggcagcctttccctgtgtgggtgagagttgggcaaaagaagcattgtgtttcagatagcacagaatgtccatgaatcatgaattgagatattgttctctttgcttgatttgtgttttgtgagttcacatccataactacacctgtggtgctgaactcttgtgtgtgtgtgtgtgtgtgtgtgtgtgcacgcacgcgcgcacacaggtatgtgtgatgtaggtgatgttacaaatatactcctacgtctgtaatacatgatctaatgatgtcctcaacttatttttcaagcattttaaaggaggtaactaaacattttatttttattggatcattttctactcacaagtagatgtaaaaagcgttttacagcttcaactaacaacatctaaatgcctctagactctgaagctactgagataatagccatcatattttcctaaaatctctaaaactgagcgatgaactcctttttatctgatcatgaaattgttcacgtttcatttaggcttcatatataagcacagaaatctgtataacatttaactaagactgctggtttccttatcatcctcccatactatcccttccttgtaatagaggtaaaacaattcctgacagaaaacagtgtaatgggtcagatttgactaatatctggaataatgaaatgatagcttatcatgagacgaaattttcagcttaattatgatgttgctttaggtttatcctctcagatcttgtctttcccaccatcataacatttacctcatgctatttaactttctatttacattgctccttctcactgacctttgatttctgggtcaaacaagctctgttcctaaatatgatggaccttcaccaaaagtttgttaaaaacaatttccaaattcaggattattattttttcaatgtaagaagcagtatatgtctatagtagtcaaccacaaaaaaatgtaaattgtatcctcaagttaaataactttaattaacagacaaaaatatcagtaaactggactatataaaaaatcaaaagcttctgcacgaccaaaagagccataggcaaaatcaaaaacaaatgaacaattatgaaaaataaatgcttgtgactcatgtctaagggactaattttcctaacacatgaaagaccttctgcaaagtaataagaaaaaggccaacaacccaaaagaaaattggacaaaagataaggacagttcacagaaaagaaaatacaaaggattttaaaagcatgaacagaagcttagccttggtaataatgagagaaatgaaaattagagcttcatctattgcactggcaaaaattcaagtctgcaggtacactatgctgccaaggctgtgggaaaatgcagactcttctacgtggctggtgggaagtatacatttgtgtacctcttgtggaaggcagtttggccatatctataaaaagcatgtaaactttgacctggaaattttattcccaggaatttattttgtagatttgtttctagaattaaggttaatgtgcagtgagggtagagcagatgatgggtagggtgagatattttttactgtaccttttatattttgaacaatgtaaatgcattactgtattagtctgctctcacactgttaacaaagacatatctgagactgggtgatttataaaggaaagaggtttaatggactcaccattctacatggcgggggggggcctcacaatcatggcagaaggcaaaggagaagcaaaaacacattctacatggcagcagggaagagagcttgctcaggggaactcacatttataaaactatcagatcttgtgaaacttactgattatcaggagaacagtatgggggatcctcttccatgattcaattatctgcacctggctccacccttgacatgtggggattaccataattcaaggtgagatttgggtggggacacagccaaaccatgtcaattacttttgtaaaaaattatttaataaggaaaactactgtaccagctcatcttcctaccacaaaatgttgttgagaaattacactttgcatattttaataatgaatcattattattctggtataacatatctaaagccatcagtgaaaaatgctctgaagagttttctttggcaatatcacttaatggttgggtggaaatcaagaacttttaacacatattttttttgtgctcttctgcactttaaaacagtttccaggaatcgagagtattccaaatacttcacggaaaaatataacaggtgtgagtaatgtataacgtggaaaaagattaaggtttgtatcagattctatgtgttttaaattaatttacatttatatttactattttgcattcacatcaaagtatagacacaaacacctgaccggtaaaatacatcatttttctaataatccttttatgtattataaaaccatgctcttcatataacatgttccctgtggtgaaagaaaacaaacacattcaattcccttatgtgttaatttagtatctaagcacatcttgacctaatttcacacaagattactttccttattctttcaatctctgaatgttaatttcaaatgtatatgttttaatattaagataagcaaaagtgtctgttttagaaataaacatattaagatggatttcataacacaaaacattttagaaaaattaaagtgttaagcataaaaatagtaagaagaactggaataaaatattggcgtggggaagccttttagaagcaaaaaaagaatataaaaagattgaatataatatgcgtattcacttataaattaaagccactaatcaaaattaaaacaaatgacaactgggaatatttgcagcatatatcagacacagggtaataattttagcatataaaaaaatcttttaatgagtaaaaaaaggaaaaatctactggaaaactggataaagaacataaaaagaaattgacaaaaatgtaaacagccaataaacaagaaaaaatccagacagttagtaatcaatgaaatgcaaaggaaaacagcaatgttatactattatttatctattatattagtttctgtaaaaggtctttgtcaaagttctggaaaacaagcaattttatgatcttccttggagccctattatacagtcattcaccacatttcagtcaacagactgactgtgatcctatgagattacaatggagctgaaaaattcctattacctagtgatgtcacagtgcaatgaattactctcacgtttgtggtgatgctggtgtaagcaaacctactgcactgccagttatataaaaatacagcacagacaagtatgtacagtatgcaatacttgataatgataataaacaactgttattggtttatgtatttactatattcttaattagttcaaaagaaggcattgttatcctatgagatgatagtttcatgaatgtttcattgcccatgaagaccttccagtgggggacagcatgtggaagtggaagacagtgatattgatgatcctgacccatgtaggcctaggctcatgtgcgtgtttgtgttttactttttaacagaaaagcttaaacagcaaaaatattaaaaataagaaagctgctacaataaggatataaaatatttttgtacgggtgttcaacgtgttcatgttttaagctaagtgttattacagagtcaaaaacttaaaaaaaaagtttataaagtaaaaaagttactataagctaaggttaacttatcattaatgaaaataaatgggccaggcgcggtggctcacgcctgtaatcccagcactttgggaggccgaggcgggtggatcacaaggtcaggagatcgggaccatcctggctaacacggtgaaaccccatctctactaaaaatacaaaaaaaaaaaaaaaagataaaaatgtgtcctcataaatttagtgcagcctaactatacagtgtttgtaaactgtatggtaccgtacaataatgtcttagatttcacatttgctcaccactaccactcactcaccgactcacccagagcaactttgagtcctgcaagctccattcatggtaaataccgtatgcagctgtactattttttatcatttgtatactgtatttttacggtacattttctgtgtctagatacacaaatattgttgtgtgacaattgactacagtattcagtaaagtcacatgcagtacaggtttgtagcctaggagcaatatgctgtaccatatagcctggatgtgcagtaggctataccatctatctttgtgtaagtacactctatgattatacaacaacaaaatcacctaatgacacatttttcagaacatatctcatttgttaagaaatgcatgactatatatgttgctagtaatttggtaattcagaccgaaaagttaagcttctaccctggaaactacaaacactactgagacagtgaagaaaatgtaaacaaatagaggactaccttcttcatgaattagaaagtccaatactgtaaagatatctgccctctcttcaaataatctataaattcaatgcaatctcaatcaaaattgcagcaaccatttcttagtagaaattgacatgccaatcctaagatttatatgtaagtgcaaagggctaagaatatccaaggcaactttgaagaacgacgaagtttaagaatgtttgccaccagacatgaatatttattataattaagcctgtgtgggattgaagtgagaacaaatcatctatatagcgtttcctaatttatacgatggtgtcacttaagttggaaaaggatgatcttttcagtaaatagcaccaagttaactgattagtcatttgaaaaacatgaaccttgactctccacatcatacacaaaacataaattctagattgtttgcagacctcaatgtaaaaggcaaaaaaataaagttttcaaaagaaaatatagaaaaaaatctcaacaattttaggttaatgtattattttttaaacaagacataaaaagcattagccataaaggaaaagactgataaatcaaactccatttatcaggaaagattgttaagagaaaaaaataaagcaaagtttaggttggaaaaagatattcgcaatgcatagatctgacaaaggacttgtatccaaataacttctacatcagtaagaaaaagacaactattatttttaatgggcaaaagatttgcataatgacttcacataagaggatataaaaatggcactaatcgtcaggtgattgcaaattaaaacacaatgaaataccatttcacattcacctaaatggttaaaaggataaaggttgaaaatacatactcttgatgaatatgtggatcaactagaagtcttatatactgctggtgaaaatgaactgaaatgaccacactgaaaaactgttttttggtgattccaaagccaaatgtacacatcttatgacctagccattgtacttccacgtatattaaaaataaatatatacatatatgcagcaaaggacaggaacatcacaccagcatttttcctaatagccccataatagacacagcccaatgtccattgattagcagaatggataaactgtggcatattcacacaatagaataccatacatagaaaaactaaactaactatggcacaggcaatagcatagaataatatcacaaaaataatgttgagcaggacatgtcaaatacaagggcatatactggatgattctgtttatagtaatttcaaagtcaaaactaatctaggtgttagaagtcaaaagagtgcttatctttgggagagggtggtggcaggggagaggctcataactgggagggaacatgagaggggctcctgaggtaatgttctaattcttgaacttggtggtagtagcatggatacactaagttttttttaaaaatccctgaatttctattcttatgatttgtgtacttttctatgtgtctttatacttcagtttagaaaatttgataaaactactttaaaagccttaagattactcattcccttcaactccaaaatgctacttctatgaattttcctaggggaatatcagagataaacacagagacctatgacaagaatgttcaattatgtcactctggcgaaaaagtgaaacgaaatctccccaaatagaataaactgcttttacataatgaaatatgttgcgtccattaaagtaaatattatgaaaaacatcctattacactgaaaaatattaatgacatattaaaaatatattaaaaataaattatggttttgattttgtatgcatattttacatatcagtatcgacacacagcaaaggacatgaatagatatttctctaaagcaaacatacaaatggctaacaagcatatgaaaaaaaaaaatgatcaacctcactaatcagcagggaaatgcaaatcaaagccaaaataagatatcatcttatacctgttagaatgactattatcaaaaagacaaaagaaaagtgttggccagaatgtggagaaaagagaacccttgtacaatgttgatgggaatgtaaattagtataattattgtggaaaacagtatggaagatccacaaaacattaaaaatagaactaccatatgatttagcaatcttatctctgggcatatatccaaaagaactgaaatcagtattttgaagagatatctgccctctcatgtttactgcggcactatttgcaatagccaagatatggaatcaacctaaatgtccatcaataaatgaacggttaaagaaattgcggtatataaacacaatggaactctattcagccttaggaaagaaagaaatcctgtcatttgcaacaacacggattgaactggaagacatgatgtcaagtgaaataagctaggcaaagaaaggcaaatactgtatgatttcacttatatgtgaaatctaaaaatgtcaaactcagagaaacagagaaaaatggtggttattagatcctgggggtggggtgatttgggagatattgatgaaaagatacacaatttcagtttgacaggaggaataaatcctagttatctgttgtaactcagggtgactactgttagtaacaataacgtatacttggaaattactaaaagtagattttaagtgttcttaccacaaaaaataataagtatgtaaggtaatgaatatgttctatagcttgatttagtcattccgcaatgtttatttcacaatatgtgatatttcacaatatcacattgtacaccatgacaataatacaatttttatttgtcaattttttagaaaatttaaaaatttacacatagattttcatatttgtgaatgattagaaatacatgcacactttagtaaccttgaaaggagtattataaattatacatgattttaatgtaatttttaatatttttgtcccttttcaaagttaccactcagaaagaatattatatgttttatatgttaaatagaaataaataataagtagtactggtttggtggctattcctctgaaatattagcaacaataaaattactattataacttaggtttacaacatatttcaggtacttcatgatggattttacttatattcactttcttattctacccatgatcctatgaagtacataacattttctaaaattatcaagtgaggatattaaggatcaacaatataaataatattcataaggttactagtaagtaacaaagatggcactaaatatccaggttttactgacttcatattctactctttccttccctcttccctcccaaaacatactttccagtatctttcaaaattgacatcatctgggccgggcgcggtggctcacgcctgtaatcccagcactttggggaggccgaggcgggcggatcataaggtcaggagatcgagaccatcctggctaacacggtgaaaccccgtctctactaaaaatacaaaaaattagccgggcatggtggtgggcacctgtagtcccagctactctggaggctgaggcaggagaatggtgtgaacttaggaggtggagtttgcagtgagccgagatcgcgccactgcactcctgcctgggcgacagagcgagactccgtctcacaaaaaaaaaaaaaaaaaaaaaaaaaagaaaaaaaaagacatcatttgataaatggatctatttaaacttatgcttttcaatagttatttgtgtgagtacaatctatacccttaatacttagtatcattaaagcaatatacattgagaagtcaacttcaataagaaataatataaatgaaatgcatgcaagtaaacatattttgaaaatgaatattaatatgaatattttgaaaattaaaacattactgtttgccatttgttaattttatggggactagaagaacagttagaatgcttatcaaatgcatttttggattatgattaatccaaaatcatgtttaaattatcatgatataattgtgataagcatcttctctattttggttggcttgtcatttattttataatagaagcatagataacataagttgttataaagattaaaaataataatagggaattttcaattccaataagtaataatttacatgatattttagcattattttcaaaaaatttaatgtaaatgctgaattcggaaacttctgtacttaaaaaataaagacttgattgaattttaacttaattttaaaatcctatctcacacaattcctaactaaataccagatgaatgaaatgttacatgtaaaaaaattgaactataaaagtaatgaaaatatgggaggctattcttataattttaatttaaaagccataaagtaatgacttacattcatagcagtataaaatttctttacataaaaaatcaaacaagccaaagaaaaaggcaaaaacaattcatctttttgacactcttaagataaaaacattctcacaaatcagtagaaaaaaagacaaatactcaattaaaaaggataatgaggaatagaccatttaggaaagaactataactgacctatgtataggcctattaaaattgtttgacttcactaggaaaattcaaacagggaggtgtaatattgcacctattgatttaacaaagatttaaaacactatcttgcactgcaatacaatagtctcatacaacagaaattgtgtggtgaattgggtcttctcattactgatagcaagcaaataaaatgaaatatctctgggagtggggttgggtgtcgatgaggtaggtttttgtagttcatatctaaagtctaaaacattttagtgcacttagaccagagattttacttttaaaatttcaaaaaaattttctgcaatgaatatgtgcttcttttaaaaaagaaaatcattattttaaatataggtacacatgtatacttctatagaaagaggtttatgtatgtagtgcctaaaatgtgcccaacatatctatcaacaacatctaataacaactctataatacaggtagtattattgttcccagtgtacgcatgtgacttgtacaaggtcagatagctgtgaaatggtaaccaagctaggatttgaacccaagaagttaggctttgaagcctatcctgttaaccactgtactattttacctctcattccctttagctatatgactttgagaaaatatactatatgagtgcaaaagaaggtttgctttttgtttacacaatttcacaaaataaattcctttaggtactgactggagcttactacaatttcttcataactttgaaagtaagtgggatgatagagccctattttccttgccactatcaaattcagttttcaaaactgccactcattgattctcttgcttaaaattgtgtgactgatttccaatagcctccaacttctttagcctgcctttatctaaaaaatggttcttaacaatctgacgctatcttccattcttcaaatcttcctaataacaaagcacttcttttggtctgttcctctgacattgtgtactctgccattaaaatgtcttcttttccctcaataaaatatctcttttccttatcgacacatataaaactcttcccaatccttcatgttttgggtaataaaagttccacctcctcagagaagattgcttaatccctctggaaggaaataatgattctatctaataaactctagcattaattacctgggctacttcattagacaccgtcagttattacttttttctttattttactgttctcttccaacttatgtcttctttcttctcttgtctctccccaaaagctagaatactcacacatacacacagccacaattgaattttacatctttatataccgttagtaacttttcttacatgatatagcatttgttaaatgaacaatcatacaaaacaatcaatcattcgctaataaaacagaaaagagaaggtaaatctcctaaaaacgcttatgttcttgtacactttgaaaacgcttatgtccttatacatgacatttccaactctgtttcccattttaggctatgtgtgaatatccaagttcactagcacagtcagaacaggtgttacttggcggctggactagtgaaatttgatgtgaggaatacagagtagaagagggtagaccctcttgagggtcagtcaagaggactaaggaataaaattcttgatatgttttctgttagttagcttgatgtcatggattctggggctggagacagggctaggtattaattaattgcaggactagtggtaatatccgtgtaattaattcaatcaatatttacctagtagctattttgttccagccgctgccctgtattgcttctgtagttgactgaagttggccattgtatggctacgtgtaagtctccaatgccaatatccctctaccttgaaaatagctaaataacagcgcactctgaatgcattttaggcaaatattctgttgcccccaaccaaaaatcacctcccccaaattagtaataccaattaaataattcatgtaaaccattatcttcttttggataaaatgcacgtagtatgaaatatttggagagttcattttgcctcacacatttcttaacaacaataaattaatgtcactggagaactagacttagcaaagatatcttcccaggcacaaaactcgattatttttacaactggtctcgtggtaaaatatccctcactaggaggtcatttattttctttccctctggaaatttaataaaataatgatgaatatatgactgaaaaatacattgtggttatatgccaccagatattttaaaactataaatccatatacaatgtaaaagtgactaattacaaatcatttttatgacattcagcccccagtggcatagctctcggaatattactttaaaagtaagtggatttcctttttaaagcatgtggattttacttacgatgcttatacatctatatttcctacattgtttccagttttaagtatctgataacagtgaagtcccctgtgtcaaatcacagtgtatgttagttttattgcataaccacttcattaccacacatggattttgttatttttctcaagacctcaaacatataatacattacgaggtaaatgaacatttctagcaagatttcaaagtcagtaaaatttgatgtacaataaataggttggcagtccttggagaactctgcccttattaccacactaaaaccatattgacttttcagtaaactttggtgttcatgagcagcactgttattcattaatttatttgtttgcagtataagcatctaactccatggtcaaagaatacttaataatatacgtgagtacatggataatattttctgactgttcaccttgatctaaacctaccctaaagttaggtaacaagccctttaatggctcctggaggcattagacaaatgaagtgaataggtgacattgatttgctcaaacctcaatagttctaaaatggattttatagggatttatacccatctaactatccacctacccacaaactcttcactaaataatgtgattttggtcacatactgtttaaaccctgaggacaataaaatttaaagaagttaaatgtaatttaatctctctctctgtctctctctctctctctctctctctctcacacacacacacacacacacacacacacacacacgcacaccacagaatgtgttgttacaaattaaccccgtatttttctccctctctccctccctcccagccgtactctaaacaaaggctctacaaagtagcactaaacaagggctactttattcccacactctccaatcagaaatctttgatcttatttgcttgaaggaccttagcatcagcctggctgatacagaaaaatgtcccttggattcgtaggaaatatcatttttaatatttttgtttgctcattttgttcatttgtttgataaaaattcaaggaaaactaagtcatgatctgtacagttttacccaagcaacaagaaccataacaaataacaataacttgatatttatttaggccctgaggtgtctgttaaaatttggtttcttaatagaatttaaaaaaaaaaaacagtctccttctttttacttttatataaatcactgtacttcagaatatggatttcagggggggaaagaaagggaaaactacaccacataatcacgtatcctcaaattcagaagtttcatttaagaaacaatttagctggggatggtggtgcctgcctataatcctagcactttgggaggccgaggaaggaggactgcttgagcccaggagttggataccagcctgggaggcaacatagtgagattgttgtttcaaaaaaaacaaaacaaaaaaaaaaagaagaagaaagaaagaaagaaaaaagaaaaacaaagcaatttatcaaaatgtaactttaaatttaaatgtattaaacttaaatacaatttaaatatcagttccttagttgcacttaccacatttccaatgctcaaaacccacattgtattagacagggcagagaaagaccatactcattataaaaaagttatcttgaacagtgttacaagccgtactacactatttgcttatgcatctaaaaaacttgccaatcttcatgattttttgaaagcgtaacattttagaaaataatcagtagtgttcaaatatatataccaatttgatagtttcaataatatgaccatgaattgctggttttaatttcaatattttctgtctagaaagcttgtttttctccaaaactcattctctaaaaaacaaaacaaaacaaaacaaaaatagaaaaccaccacactgaaaagaaatcctattcctttgccttcatctgaatggaatcattttattgtcatgtttaaacatataaatataaaaaaaattttctatcaaatggcatgacctacataactcacatttatcttttctatgtgtaatattcatattgttgcaatttgatgcattattgttatttatactatgaagcaaatgcatattgcttatccactcaatgaaacatggctaacaaagaagaaaatcagtatccctggaacttttaaccttaccaacaagtaaaataataatatcatatagaattgctactcctgggaatggtgatgcttagaaaggttttgaacacaacatcgggaagagttggcattggcatatgtgaagttgtagctttactagctgtgtgacggtatgaggaaagtgaatacaattcaaagatgggttggtctcttcctgctggccagaagagaagagagcaaagaaaaaaagagaatatggatataaatttgaaaaagaaaaatacttgatttctctggaaacaataaaaaaatcagggcaaaagtcaggtgccaaaatagttttatattctgcgaggattgttgccataaccccatttcaacaggagacttgggcagagggcagcaaactatggcttatgggtcacattcagccaccatatgtctttgtacagtttgagaactaacaattgttttaacatttgaagaaactgaaaataattaataaatgggtgagacatgaatattatatgaaattcaaatttgtgtccccaagtaaattgtcacgggacacagccatgcccattcgtttatgtgtagttacgtattagggctgcttttgatccacaatagcggtgttaagtagtcgtggcagagacctattggcctgcaaagcctaaaacatttaccatctggaccgttatagaaagtttgctgacctctgctctaggtgttcaaggagttgtggcccaacctccagtccatctaagtcttggtcctgcctgtatttcagagccgctttaacgggtgagttggtgagtgcagtacagggcttcaatgtacgagaaataaaaaaacttttaaatgcagtatccattaatttacccaaattggaaaatggacaagacagcatcctttggtggaaatttttttaaatccacgaccctcctggtctgtttttgggacactttgtagccagtatgtacaaatgtctgatttagctgggccatccatctgggaccagctagctgaagcttgcaatcgcagttagctgaaatttgaaacttgaatatttcaagtggtagacatttagcaataacaaattatctacatcattatttgatatcttttaatttgcattccaagaagttgtgcgtttccaaagcagtgaaagaaaataaaacaaaaatttaaaaaatggaaacgatatgtcaacataaaagccagaaaaaaattaatttttaaaatactattataccctgtaaattacgtgtagccttgatgggcatagaacttcaccggttaatatggtagccactaaccacatgtagctattgagcacccagcccagaatatgcctatttggaatagacatatgctgtaaaatacatattggattccgaaggcatagtactgaaaaaaaaaaagaatccaaaatattttaattcatccatgcatcacttaatgacaggaatacattctgagagatgtgtcattaggtgattttatccttatgcaaacatcatagtgtgtacctacacaaacctaggtggtacatatagcctactacacacctaggctacatgatatagcctaatgctcctgggctgcaaatttgtgcagcacgtgactgtactgaatactacaggaaattctaacatagtggcaagtactcgtgcatctaaacatacctaaacatagaaaaaggtatggtaaacctactgtattataatcctattagatcaccagtgtatatatagtttatcatggaccaaaacctcattacacatagcatgactgtatttttgcactgattgcaacgtcaaaatgatacaattttagatacactgggttaaataaaacatataatccaaataaatttcacctgtttatttttactattttaatgtggccattaagattaaaataacatatgtggctcacattacgctctgtaataatgcaatagcagcttttattctatagtaggaatagcagaaaaatattaaatgaaagatcatccatagatgtcaaaagtcatgtgagttttagtatatcttctaagttgattattttaataaaaggtaagaggtaaagaggttttcttattaacataacatcaatttttcttgcccccactaaataaatgctgaacaaatattttaagcaagcgtatgaaggagcatcaaatagtagcttgtcttgaacaaggtgtccccagtgtgtttcctagactcattgaaaagaagcaaccttacgtatgttaatcccatgtggttaatttctggcctccatgtttaattgatctctcatactagggcctctagccaccgtcctccaaggttgtgcatgaaaccagaaccctacagttttgtctgaagcacactgcttgtcctacatttttggcccccaggctgcatatcacgcaaccctatttttcattaacttctggtctgagggggaaggtactgaaaaaaggaagagctgtacttgaataatgttactgtcacacaaaaaaaggggaaagggagggagggagggaaaagacctggcctccattcccgggtctcagatgaggatgcctggtggtagtttcccttgtaggagggataggcagggtaatcaagggaaggaaagagagagaggcatgtggcgaaaaagggaagtgagagttgagggattacactagtgctgcatgcaggggaagggacagtaactaacagaggtttggaagtcaggcaacctgacttctaataccacctctaccgctacttatagaatccgagggccttccctgagtatccttggaactgaaaaatgcagacatttgatcagattaattctgaggtcccttctagcttgactgttccacaaacattttgtctctggcagggaatggaggagtatacacagccctgaacgtgtcactgagcttcaagaagacaaagactgtgtctgcctgacacctggatgcctgtgaacacaaaagatcttctctgagggtttattgggagcttgtgacataggcctaaaatgtggaaaatcctgtgacaacaggataccctgtcaccctaagcagatgtaagcttaattttcttcacagcaagataatgagcaatagaatagaacctaacaaagcaattttggatgagggcttaacacaatcaactgccatggtgttccagccatttatttacaggatttaaacgtctttcctccaaagccgggactcctgccagataacctgtgtaatggacctagtgcaatgacctacaccaaatggctaacaattttgtccagcccatgggctttgcgagtggggctcatctcttggctctggctaagtatgcagctacattcccgatgatgtggcaacattttaggctctggtttccaggagagagctgagacacagctattctcaggccttgggaaccaccgctttgagaaacaagttaggaaaatgcagaggaccttacgtcccgggggaaactcacagaagttttggggcatctttataatatttgtcaatgaaagggaaaggaacattcctttgaaaggcaaacacagaacttgctctgttcccaacttatgcctccaaggctgtgtgaggagattcttctgaagtctacacatcgctgtccattagagcatctctattagacagacattttaatttcttcattgggatgaaactttttacacagtagatactgcgactttgtaatgtttgtatgaactgaagctggaattaaaacaacaaatctgaagccatggtctttttcatcacttttatataaattactcagagttccagattgcaattcatctatatatttttacaggtgaagcatgaatttaaaaaaaaatttaaaaagtggtttcactcatttaaaaaactgttgaattggttagttggttactggttaaaagaaaaattatttagggccttttatatgccaggcagtatgctaggtaaatcatccctcccttctatgaacacttattctggaagaaaaaaaatgtatttaaacacagaattcaattaccaagtgatgaatactctaataaagacagacacaatacactacaaagtcatggagtctggagggcctctgtctcctggagaaagaatggagagacaggaggcaggagagaaggatgatttcacagaggatatctcatttgaattttctgttaattaatgggtaaactatcgaaagctattctgcgcagcccattaaaaggtactctgttggctcaagcttgacagtgtgtgaggaagaagaaagagatcttatgactagggttgccttataaaatacaggataccatttacattttgtataagcaatcgatacttttcagtattttttgttgtagtatttgggacatagttatgcttagaattctggatgtttcatatttttatttgctaattcttgggatcctagttatgactggaatgtggaagaaaacaataccagctgaatatgatttgaagagttttgtgtgccatgacatggagttttgaacttattctacagggataaacacttttgaaaagagtttatacaaagttgactttagaaggattagagtcaaagggggacttgaaaccattaagaagtcaagccccagtaatggcatgaacagagctcattctgctttccaaatatctaatctgcagtagatacttagtggctggaatcacctctgacatggctgacctgtgacagctatttcatctgcacattgccaatatctctgtgcttaggagattctctaaagcgcggcataatttttcttggatttcccctttcctgtttcattaaccctattctttcactcttacatttgaggatgaacttctctgcttccaatttcttgtcttacattctgttcttgagtgtatttaaactaacactttatccttttccatttcttccaaaaagtaaggataaatggtccttgatttatttgcaagctacttctttccctgaaaaagtttgggtgatccttagcatcagggtttagtatgactaaaagaaaaatatgtattagttattgtacaagataacttgaatgatcttttaaattttacagttcatatgtgaaagaaacttggcagggtcttcctaaattggacaataaattgtaataatttatgtgacatcaccaataataagttgaaaatgtaaaataaacttttctaaactatcaatgatagaagtcaaattttaatcaacaatgctgggggaaagagtaaattattttctgatgctctcacatgaagaggtgctgaaagaggatgcatccagaaagatagaaaaaattatttcagacactgtatattctagtattgcagagatggttcattattaagaaaacattctgcttatttttttcaatttttgtgatgtatgtggttatctgtcatctttttaaaaacgtataatttgttatgatttcctttctttctataatcatgttcatacctaattttatatttgtcctgttatattctttgacttaaagaaaactgccaaattagaatgtgcttcaagtttcagaaaaccagatctacctctgcttattcttttacctttattgagtatagaaaaccatttcattcagtatcctaaaataactaatttggtataggcattgcaaatctcttcttttactttgaagaccccatcgtttctaacagatgtaaaaacaaaaagaaaacaaaaataaaaaatgattttatctgacttataagtagtacattaaaactagttgagtttttgatctaaaatttaaaaataattagccgagtttctgatagaacaacattttacaatttctttgcttttttcttttttttttcttttattattgtactttaagttttagggtacatgtgcacattgtgcaggttagttacatatgtatacatgtgccatgctggcgcgctgcacccactaacttgtcatctagcattgggtatatctcccaatgctatccctccccccttcccccaccccacaacagtccccagagtgtgatgttccccttcctgtgtccatgtgttctcattgttcaattcccacctatgagtgagaacatgcggtgtttggttttttgttcttgcgacagtttactgagaacgatgatttccaatttcacccatgtgcctacaaaggacatgaactcatccttttttatggctgcatagtattgcatggtgtatatgtgccacattttcttaatccagtctatcattgttggacatttgggttggttccaagtctttgctattgtgaatagcgccgcaataaacatacgtgtgcatgtgtctttatagcagcatgatttatagtcctttgggtatatacccagtaatgggatggctgggtcaaatggtatttctagttctagatccctgaggaatcgccacaccgacttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgttggagttcattgtagattctggatattagccctttatcagatgagtaggttgcgaaaattttctcccattttgtaggttgcctgttcactctgatggtagtttcttttgctgtgcagaagctccttagtttaattagatcccatttgtcaattttggcttttgttgccattggttttggtgttttagacatgaagtccttgcccatgcctatgtcctgaatggtaatgcctcaagagaataaaatgcctaggaatccaacttacaagggatgtgaaggacctcttcaaggagaactacaaaccactgctcaaggaaataaaagaggatacaaacaaatggaagaacattccatgctcatgggtaggaagaatcaatatcgtgaaaatggtcatactgcccaaggtaatttacagattcaatgccatccccatcaagctaccaatgcctttcttcacagaattggaaaaaactactttaaagttcatatggaaccaaaaaagagcccgcatcgccaagtcaatcctgagccaaaagaacaaagctggaggcatcacactacctgacttcaaactatactacaaggctacagtaaccaaaacagcatggtactggtaccaaaacagagatatagatcaatggaacagaacagagccctcagaagtaacgccgcatatctacaactatctgatctttgacaaacctgagaaaaacaagcaatggggaaaggattccctatttaataaacggtgctgggaaaattggctagccatacgtagaaagctgaaactggatcccttccttacaccttatacaaaaatcaattcaagatggattaaagacttaaacgttagacctaaaaccataaaaaccctagaagataacctaggcattacaatttcttttcttaaggaatgatggtttgagtaatcctttagggttttaccctttacatgccattaaattgtcataattaatcatcatgcaacaggttgtaacatgtaaagtgacaatttagaggctgatacagaagaatagcgaataacaggggtttagtttttatgcatcatttcttcaggaaaacacatcatgaggggaaatagctttgaataagttcagtgaaggttgccatttagttaattaacttaaccattttcattagcagactcagtattgactttagaatactgtctgcttaatttcttccaaacaatgaatatgtatgaaacaccaccaaaggtaaagtgaaaatgaagacaatataggtaaaatgtaaaaattaaattattaaaatatatcagaaaagtatgtggaatacatttataaacttatattcaattgcagtgtgctcctccaaacttttaagatatgaccttggcataggcacattatttcagctgcttagcacaggatttgtaataatctcaattttataagaaaatgcatttctaaattggttggagaaggctaaaacaatgcataaatccagtgcactgaatataattttctgcttcaactgacgatctagtcttttgaagaacaggcttttttttttttaaccatttttggccatattcattttctgcaacttcatgttggaataaataaaatcagcaggtgcctattgatttttggagggagaaatctcattcgtaagactgaaaaaaagtgaagtccatcataaccaactgatgaacaaatacgtgtgaaaattgaagaaaataataacgtagaaacaaagggtaaatatcgatacaactatttaatatgactgattttcaaatctggatttgttgtctctaggagttggaaggtgggaaggcctgcaaaattttttttattaatttaaaataggacgatatacattccatacagcgattatttattttcttaaccataacagtcttaactagagcacacagcagaatcaattgggtaggagtttttgttttattttgttttaatatgtatatccaagctccataccagagaatctaattccataagtttgtaatggagtcgcgatagctcaacctaatttttctatttataatatagaaatagatgcttagatcccagtggtacaaacatccctgctagagcccacacaaactgcaatgcctattagtagtaagaaaatgagactgcttctctttttaacattttgttctcattctcaatctgcatttacctcagatttactaagtctaaaactcaagtcaagtgtagtgcagtaaaacaagtaagttaagagctggaaggactcggtgtaacagtgtgcattatgacttatgtgcctttggattttagttttggggggaaccactttaagcccatttcttcttttgtagaacagagagttaattctcacagtatctatacttcctagttcctcttccttttctccatgtgtaatttactccacagtcttcttttattttgcatcactgatacggtttggctgtgtctccacccaaatctcatgttgaattcccatgtgttatgggagggacccagtgggaggtaatttaatcatgggggcaggtctttcctgtgctgttctagtgattgtgaataagtctcatgagatctgatggttttgaaaagcggagtttccctccaaaagctctctctttgactgctgcccatccacgtaagatgtgactcgttcctccttgcctggtgccatagttgtgaggtctccccagccaagtggaaccgtaagtccattaaacctctttcttttgtaaattgcccagtctcgggtatgtctttatccgcagtgtgaaaatggactaatacagtaatttggtaccagtagagtggggcactgctgaaaagacacccgaaaatgtggaagcgactttggaagtgcgtaacatgcagagtctggtacagtttggagggctcagaagaaaggaaaatgtgggacagtttggaacttcctaacctcttacatccagcctggccttttacattcccagagcaagaagtctgttcaagtccttattatctgggccaccggaaaaaatatatatctcaaaccagtttgtagacctccagtctctacctgctgtaattcaacccctgcattgccatcagactgagtcttctaaaataaaacttaattcttaaaaatgagtccctcccctgtgagtggattatcagtatttgttgtatgtgcatatggggaaaggttacgctacccatgctcctctagacattctggtatattctcccatgtagacatacaaggcagagccaaggccttcctttatgaaccatttactgggggaaaataatgtatcggatcactttactccctgatatggactaatgctagaagcagttgaatctactgtctttaatgggacagagttgtgctcaaggatcattaaccacaaccaccgcccttactcagagataaagatttaagatctcttagcatggtggctaaaggttttcaaactcttgcccaaacataccttttcaatgtcaaacacaatcaccttgctctattcaggaggaatcctaccataatattttgtttacagtctctccacctataataatctttcctcttctcttgagtactgcaaattctacttcagaatagaacaatgtctacatgagggccttcttttgtggtccaaggccattttgcttctgctatagtttatttgagaaaataattgtctgtccttgggcaactcctgtactaccgtcctttgttgcaatctcaactttccacataattactttccaagctatactacgaggcaaagggaggattatgaagggtttagggttactctctcttccgcttcactgtaatttctattctttatttagaaacattctgtctattcctttattattttgtagtctataataatcatacaacatcttattaatatgacactatattttggatatgccctctattatattactaatatttacataaatgtaaacatttttatttccatgatcctagtgacttttaccgtttctaatgtatttatttttaaattaacacataacattgtatgtatttattgtgtacaacatgttttgaaatatgcatacactgtggaatggctaaattgagataattaacatatgcattaccccacattcttatcatttttttatggtgagaatgtttaaaatgtaatctcttggcaattttcaagaatacaatgcattgttattaactatagtaatctccattccttttaggtatctgcttaggctggtatcatacacataataaatgttcaattatttatggaatgaacaaacccaatgttttatttctttaatgaattagttcattctgaaaactaatacttctgtcaatcaacaacaatcaatcaaccaacttcaaagtaacttctcttcgttagagatgactagcagccttagtatcaaattggtgattattaagacggacaacatgataaaatattcaccccataactcccgctctccaaagtgaattctttaaatctcttttgatatgcaaagttcagtgagaagtgaacaccttctgtcacctagcaacgtgctgatcttaaacaaggccagttaacctcgctgaacctggatttctctttctgaacaaagaaagacaagatccacctcctataacttctgtgactcaaatgagctaatgtataggaaatactgtgcaacatatagtggtttataaaccataaaattctgaaaaaattagctgattgaaccagtgagtagagcgtaggcaaagcgatataagagcagtactaatttgctgattaggtgatgaaaattagtaaacactcagattttgctactaataaatgtattgctgcaaaatgtaactgacggttaaactacaatcattcaataataatttgttgaacatctcctaggtataaagcattataagaccaaaagaaatccaagaattacatcccgtataatcctagttgtggatttatatttttctttttgatactgggtgtgtaaaatagactcaaaaaatgattttttcccctttaagatttttgtttgctcattgaatcgtggttggctacatcaggcagagattttaagggaaaacctattttcaacaagacagagtaagtcaattctaagcaactctgcggctaatacatgttgtagggttcatataatttcttcttcacagagacaattgtccctattatgacacctctcaacattgccattgtttatctagaacaatgacatccaataaaattataatgagagcgatacatgtaatttaaaattttctacacattacaaaagtaaaaaacaggtcaaattaattttaatgttatattttctttaacttaaatagccaaattgttgtcacttcaacctgtactcaatataaaaagtaccaatgagatattttatttttttcatacttaggttttgtaatttggtgagtgttttatacttacagcacatttcagtggggactagccatatttcaaatgctcatatggtaggctgttgttaccacattggagagcactgatctcaaaggaaagttggacatttcgtccaagtttttgttcaaataaaaaactgattaaactttgagcaaatatgaattattcttatcagtctcttattgtttcttcctctcaaaaatattcgcaatattataaaaccagcaatgttaaacatactgaactcaccatttgaaaaagatggaagataagaatcattttcacaataaatgctgtaccatactatccccacaccaaagcagccattttgttattttaagaaatacatatgaaaattcttctgtgaatactgaaagcaaatgtgggtataaatctctgcttatgcaataaaatgtatacttaaaattacattacagatgaagaatcatacatagctctacctttgctgtattttgacatttctgtttgcaataaaagctttttaatagaggcacagctcttcatgaatatagtaaggattttagttactaggaaataagaaagaacattacttcaatattgagttcttaacataaatgagagcataaaaattacgtcaaagatatctttagattttactaggaaatatttgccacaatacttttgaaaaaataataggaattttatagacattcattatataaaaaataaaacaccatatatgaaaatatgagagtttaaatcagcatgagaagctttgcattaaaactaaatacatatgaatcatctgtatttgggagcctcagtggttgcagccttatactatctcttagagaaaaatatttcataatccattccaatcatgtatgtattaaagtttatgacaacatagctgtcccccaaccccatgtactttttgaaatatgaaggaataaattcaatttcttaatatattactacacttaacagattatgacaaatacttctctaattatacaaaaaaattaggtttggagaatcccagagtattagctgcattttcaaatgccagcaggtgaagggaaataatccgtggtgggaagactctaaaatggcactcagtgatctctgtctcctagtatttgagtcctttaataatttcctccccttgagagtggtcaagacttttgacttgcttctgacaagcagaatatgtcaaagacaaaaggatatcacttctccaattaggctacataagattgggacttttgtcttgctagcaatttcactctttctctgtctctttcccccctcccccactttctctcactgattttgatgaggcaaattgccatgttagagaccgaaggaactaaacgtggccatcagccaacaagaaaaggaagactacagtccaataacccacatggaactgaaacttaccaacaacaggtgagtttggaagcaggtccttccaaggcaagctttcaaatgagaccctagccctggccaacacctagtgtgcagcctttgtgagagaccccgaagcaaagaatatggataatctatgcctagacttctgacccatatgtatcctgatactctaaagatacagttttaagcccctatctttgtagtaattgttatgcagcaatagacaactaatacataatattataatctttttaagaaacaaatatagtaacataaaaattaaataatggtgaagttgtagggttttcagtataggagtattgcaaatataagaacggaccatattttaacgagttactgaaaaatagtggcgaattttaaagtttcaatgtcagaaagaagaaatcaaatatatactcagatgaaatgataaaaccattaaggtttcatgcaccctctcacatttctaacattaattttcaaattttaagtagaacagtgataaagatgaataatattgtcaatcttctagttttattttagcaccttgcatttaaaacagacaatttatctttgagttgttggtacttcaaatagtttttttaaagtttccacaatttcacacagagacgaatgctaagaatctgttaagcttgcttttagggaaaaggatgcctcaaagtcacaaaactttttaaacttggttctttgggggtgaaaaagcaggcatatttttcaccaattttctaaattttacatgttaaattggaagtaagatttatgttaaactgtttattaaaacatattaaagataaaccatgtgagagaatggaatcaaaatggagaatttcctaccttgctcacttcaaccaattaagaacataattggtagcaaaagatgaagagggagatttcaggtaaaagagaacagaaattaaaaaaaaaggaaggggggagaaaggcaacagagacgagatggggaaaagagcaaaggggattaacacatcttgagagggtgagatgaaagtgtgaggaaaaagtaaaaaattatagcatgaaaatagagatgtagtgtactaacatgtaatatagagttgatgaagacatgttggaattaacttctgaaaattgttgatgaatgcacagtttagaaatgacgaataatagttctattccatttccatttaaaggataaaggcttcaaaatgcatgaaaaattataaagtgaatttttaaatggttcatgaaatctcagctttctgaaactaaattagcttcttttgtttttcagattcgaaactctatgatatggtttggctgtgtctgtaccaaaagctcatcttaagctgttgttcccataacccccacacgtcctgggagggatcaggtggagataattgaatcacggcgggcggttaccctcatgctgttcttgtgacagtgagttctcacgaggtctgatggttttataaggggcttttccctcttttgctcattctcctccttcctgctgccatgtgaagaagaaggtgtttgcttccccatctgccatgattgtaagtttcctgaggcctccccagccatgctgaactgtgagtcaattaaatcactttcctttataaattacccagtctcaggtatgtctttattagcagtgtgagaacagactgatatatttcattccatacaacaccaaccaggtctcataccaggtcttgtagatgataccaaataaactctctgaaacatatttttcctaattctttttgtcccattgaattgtgaaattgtacactttcatctacagcaaatattggaaagtttctgcatctggaagattttgaaagtgaaaagaattatcttatattgccatgaatgacacagcccttgataaatgagtaggaatatgtgagatatttactttaaaattgtctttaaaggcaatatccattctattattgacatcataacattgagtgaacatattatcagccagatttagtaaaactgtacagtgaattttccagagatatccttgtataacataagtcatctagtctccacagaaatgattgaaattccttgactagactaagcagctccattggttacagtaaatccaaacaatttccccctccaacctcaccttctactttatgctcacatctacttttgtttatgatctcaatttcaggtccatgtcttaaatgtagacctactaaaataggacatttactccaaatttcaattccttccctggttgcagccatgttttgagacaccagaatgtaagacacacagaaacagaaaatactgtggaaggaagaatcaacatcttttcaacttattgtgatataaatttgaaaagctatgacatggaattctgattcaattgatatccatgatctccttgtaagtacctgagtactgaagccaactgtcttgatttgggtctcccagtagcaaacccagaaataaaaatttgagctcaagtagttttgggatgtgattccaggacacatcaacagggtgagaagaagtgaaatagggaagatagccaataaagggtatattatcatgcaagtcatcaatgtgaacaactgaatcttaatactccctgttatccctaaaagaagatgtaggaaactaaggctactgtaaccaaaacagcatggtactggtaccaaaacagagatatagaccaatggaacagaacggaagcctcagaaataataccacacatctacaactatctgatctttgacaaacctgacaaaaaacaagaaatggggaaaggattccctatttaataaatggtgctgggaaaactggctagccatatgtagaaagctgaaactggatcccttccttacaccttatacaaaaattaattaattcaagatggattaaagacttacatgttagacctaaaaccataaaaccctagaagaaaacctaggcaataccattcaggacaaaggcatgggcaaggacttcatgatgaaaacaccaaaagcaatggcaacagaagccaaaattgacaaatgggatctaattaaacgaaagagcttctgcacagcaaaagaaagtaccatcagagtgaacaagcaacctacataatgggagaaaatttttgcaatctacccatctgacaaagggctaatatcgagaatctacaaagaacttaaacaaatttacaagaaaaaaaccaacctcatcgaaaagtcggccaaggataggaacagacacttctcaaaagaagacatttatgcagctaacagacacatgaaaaaatgctcatcatcactggtcatcagagaaatgcaaatcaaaaccacaatgagataccatctcactccagttagaatggtgatcattaaaaagtcaggaaacaacagatgctggagaggatgtggagaaacaggaacactttcacaccgttggtgggactgtaaactagttcaaccattgtggaagacagtgtggcgattcctcaaggatctagaactagaaataccatttgacccggccatcccattactgggtatatacccaaaggattataaatcatgctgctataaagacacatgcacacgtatgtttattgcggcactattcacaatagcaaagacttggaaccaacccaaatgtccatcagtgatagactggattaagaaaatgtggcacatacacaccatggaatactacgcaaccataaaaaaggatgagttgtttatgtcctttgaagggacatggatgaagctggaaaccaacattctgagcaaactatcacaaggacagaaaaccaaacaccgcatgtcctcactcataggtgggaattgaacaatgaaaacacttggacacagcgcaggcaacatcacacactggggcctgtcgtggggtggggggctggggagggatagcattaggagaaatagctaatgtaaatgacgagttaatgggtgcagcacaccagcatggcccacgcatacctatgtaacaaacctgcacgttgtgcacatgtaccctagaacttcaagtatatatatatacttatatatatacttatatgaaagatgtagggaattaagcttggagttattagatctgaagggcaagggggacagggtattgatctatcaactgctgctctacaggggcataactgctacatttctgctctctcccaagaatgagcagagatagccccaagcaaagagatgcaagtacaggaagttggaaattaagaagcacgtataaaaatggtaagtgctaaagggatatcggtggggcaccgacagtatctgctacaacacctcatacattttttccttaaatgatctccacaacctgcctacatttggaaagtattgttgtaatgtcaaaattaccattcagtttcattaattgactaaaaaatcaagtcaaagcaatgtgacagatattggttggttatcttttcctaattcatctatctattctgtctacctgtctgtttatcagtcaatcatctttcacccttacgttcctttgaggaactttgcacctacttctctacctttgttgtggtgcagctgtagagtttggttgagatttaatgacttttagctgtagaagtgaggtgtgatttagtacaggaatgagcatgtgacctaattcaggccagtcagtttcagagcagtctttcctggatgctttgggaaagaaggtccctaaagagatgattttcatcaaaagtaagtttgcagatgtgggttctgaaacggcttcaggccatttttgtcaccaagagggaagtcaggtgaagctgctaggtcaacacagaaaaatagaacccagagaaatgtgaaaaaaaaaaaaaaaaaacaagaaacaaaaaaccggaaccttgatcatatttattgtttaaatcagtttgagaccagttttctgtcacttacagcattaagagaaccaatagacgcattaagtcagttacttacaggcatattagttagaactaatcctccatgacacttcacagaaggtgaagattcatgcatttttaaaataattcattctatcattttacttgaatatcataaaaatctctcggttagtgttaacaaataatagttttctttcgtttttctaacacctaaaaccatatttcataatcccataatgtgaaatagtgtgaataatatgtaacagttcaaacattatgttccagaagagagagatttttattttttctttctattttttgaactccagagagagatttttaaatttgcagtttgagattagagctttccaacagctgaagtgtttactattttgagagaagacttgcgaaagcaaaggttaacctagtagtacctgctgtgccttcgttggcaaatgaaggaaaatcacacagatggtggcatttgcctgggagttgggtgccaggggtgtcctctcaaaggcacacaaaaagatagaatgaaatgtctctcttttcttaaatatgtggatgtggatttgttggaaaaaattactttacccacacttgaaaagtcatcaccactgtcaccaccaccacaatcaatcaatttaatagtgaacatgtattaatcctttagtatgtaccacattctcccttgccaggcaagcaaggaattcagctttgttctagactgctgtttggcacagtcttaggttattctccttctaacagtgcaaagcacttagaatacagtcgatacacagtaagttattaataaatattaactatcattacctaacacactgaggaatctttaactctcccaaggagtggggaggacttcaaaacaggaatcagttaaatttctccttggaccgtctagtgcaggcttggtgtagatataaaaagaaataaaatattggtacaaactaaatgcctgacacatctgaggtagaaactaacgaacgttgtaagtgaaatactgctgtgggctgaggataacaggaggccaagatggatcttgtttggagatgacaaggcaggctctatgggattagaaaggagaagtcagatttagagattggtggtattaagagagaaggaaaaaaggtagactttctaagtggaccaggcagggaatcagaggcgaggaagaaaacagaacaaatggaaagaacattgggtagtctcattttgatggcagcctgagtgaaaatgaccagtgggagaaaatatcagaagatttctatagctgaatgacacaggggttggaaacccagggctaaaggagaaatttatcaaggaactgtttcccttactaaatccacagcatcgcccacataggtacagacttgtttgtctaggattttgtgactacatggcagtttgccttatcaaagtgagtgaaaggatggggaaaagggaaagcaagacaggaagagaaaaagaaatagggagagtgaggctcttgtcacaatcaacttgtaattgctgaacagtgtgttggtgctttcatgtcagaggtaacatttacagaaatgacacattttaaggccctgaggggaaggcagattaggatagaagcttataatgtattgctgctttatagttttatcactgtttggaaagtatttcattttatttatagctctgtaggaaaattactaaaaaaattatgataactaatacttactgatgtcttaccatgtgctgagctcaggtttcagcttcttaaatgtgtcattaggtgactacaaaagtaagtgttgttttcacattcatggaacttgccatttgatattgaaatacattcttaaataaatgtgattatgttatacatcattttaatgagcatttctcactttttttttttttgctaatgacttattacttgctgtttattttatgtttattttagactatggaaatgatgttagacaaaaagcaaattcgagcgtttttcttattcgagttcaaaatggattgtaaagaagcagaggcaactcgcaatgtcaaaaacacatttggccaagttactgctaacaaacgcacagtgcagtggtggttcaagaagtttttcaaaggagataagagtcttgaagatgaggggcgtagtggctggccatcagaagttgacaatgaccgattgagaccaatcatcgaagctgatcctcttacaactacacgagaagttgccgaggaactcaatgtcaaccatttcacagttgttcagcatttgaagcaaattggaaaggcgaaaaaactcgataagtgggtgcctcataagcagagcgaaaataaaagtatcgtcattttgaagtgccatcttctcttattctacgccaacaacaacaaaccatttcttgatcggattgtaacgtgcaacaaaaagtggattttaaacgacaactggcgatgcccagttcagtggctggactgagaagaagctccaaagcactttccaaagccaaacttgtaccaaaagtcatggtcactgttcactggtctcctgctggcctgacccactaccgctttctgaatcccggcgaaaccactacatttgagaagtatgctcagtaaattgatgagatacatcaaaaactgccatgcctgcagccagcagtggtcaacagaaagggcccaattcttctctgtgacaacgcccgaccgcacgtcgcacaaccaacgcttcacaagttgaatgaatcgggctaggaagttttgcctcatctgccatatttacctgacctctcaaccaactgactaccacttcttcaagcatctcgacaactttttacagggaaaatgcttccacaactagcaggatgaagaaaatgctttccaagagttcattgaatcccaaagcatgaatttttatgctacaggaataaacacacttatttcttcttggcaaaaatgtgttgactgtaacggttcctactttgattaataaagatgtgcttgagcctagttataatgatttaaaattcacggtcccaaactgcaatttcttttgcaccaacctaatatatctcagtccatttttgtagggccatttttgttcctgtttccaggtgagaaaactgagaccacagagagatgacacagctagtaaggaatttgtggaaggcgattatttggcagccccacaattaatcacgcctcttggattcatgcctttgtgtagtcccttctcattttgattctgaacttggccatatgcctggctttggccaatgggatagtagcaagtgtgatacaaacagaagcttgataagtctttgaagattggtgcttgttcttttggaaggcttcttcacagaactcaaccaccaagctgtggggaagccaaaggagacacatggagaagacaatggaaacaaactgaggctcatggccaatagctttagctgagttctcagctggtaggcagcaccaactgccagtcatgtgagtgaggccattttggactttccagctttcccagtgtcttggttgatatcaggtgaagcagatgaatatcatagtcaactctcagaattatgagaaatcgtaaaactatcttattttaagccagtaacttttagagtggtttgttgcatagcatatataactggaacagagtgaaatcaaaatttgaaccaggcagagtagtaacatgtcgaactaactatacaggattaaaaaaaacagcttctcaaagtgaagcagaactttatctttatttgttttttgaaataaatattctacattggctataccagactacgtgatatactagtatgctattttaccttactgtgtctctcttcctgtttcctgctcttatgtgaatatacagacaatcctttctggtgacattatctttgctctcaggaacaaagaatgaccttattacatttacctatatcatcactacccctttcacattttaattagcaccaaattgtagaaaaacaattatgtaaattattagcagagatagtggcctctctgtctctttcaagattaatatgactgagttgtggtgaagaataagtcaatgacaaggtcagcatccattccagaggaagattttgaaaaaaaacaaaaacaaaaacaaaacaaaacaaaacaaaacaaaacaaaaacaaaacaaaaacacttaggcatttggggaaaggctgctcttatcactgagacatttatttgggtaagaatttttcgataggtgtatctagaactagagaacttcagtgagctttgccttcaaaccaaatcacagtatcttctctaataattatctaaaaacaaccattgcctccacttctggactgcgtcagatccacccgttttatgctctcttgctttccttgtttgcatcaccacaatttgaactaagcaattattactttgatggtgggattacataaaaagcaacgatttttctcatccttgacttcaaaaagctttattgaatcatttagcttagcttacatttgaaaactcagaatggagtggtgggtatgggggtgtggagagggagagaagtactggatttatagtctaggtcttgcataggtggtcgtccagcacttactgctgtctttgtgcctgggctggagagaatgtggagaaaaggaaaaccttgcacactgttggtaggaatataaattagtacaaccactatagagaacagtttggaggttcctcaaaaaagtaaaaatagagcttccctatgatccagcaatcccactgctgggtatatacccaaagaaaggaaatcagtatattgacgaaatatctgcattcccatgtttattgcagctctattcacaatagccaaggtttggaaaaaatttaagtgtccatcaacaaatgaatggataaagaaaacgtggtacatatacacaaatggagtactattctgccatagaaaagattgagatcctgtcatttgcaacaacatggatggaaatggaggtcattatcttaagcaaaataagccaagcacagaaaaacatctcatgttctcacttatttgcagaatctaaaaatcaaaacaatggaactcatggacatagagagtagaaaggtagttgccagaggctgggaaggatagtggaggagtcggggagggggcagcgggatggttaatgggtacaaaaaatacttaggaaaaatgaataatacccagtattcgatagcacaacagggtgactatcgtcaaaataatgtaactgcacatttaaaaataaataagagtataattggattgtttgtaacacaaaagattaatgctggagggggtggatcccccgttctccatgatgtgattattatgcattgcatgcttgtgtcaaaacatctcaagtaccccataaatacatacacctactatgtacccacaaaaatttaaaaaaattttaaaaagagagaattggttgtggtaggagcagatagcataactttcactttataggtcactggaccatgaggaaccatatcttgatctgatggagaagacagtgcatcatccacagacaatggacttttagctggatgcagtaagtgaatgagactttgactggtctctcttgggaaggcactgtgtgttctcttgatgataagaaagagagtgcatggatatttgtgggaccagcatggagattttgaaatgcagtattatattgagaatagtatagctgccttgctagcctgtgttcctttttagagcagagactacgtacctaggctggactttatgtgggaaagatacacatatctatattgtttgaaacatggaaacttggggtatttttattatagtagctcagtctacaccctgagaaatctgaaaagacaatgagaacggctgcatttgtaattatataatccattttaatgtttgtccccctccaaatgtaagatccataaagacaagtgtctgtctgttcataactctatcctcattccttaacattataccatattggaaacacttaataaatactgaatgtatacataaaccaaggtactgtttctatactcctaggattttgcataaagtatctttgaggatctttgtgaccctctagactattggcttttgagaatattgatactgtgtcaatattacgtgagaatcaggattagttgattagaaatctgaatacataggaatgcatcttaactgaataccttacttgtgagggggtgagaaacttaatagattgcaaggtgtggtagattgcactggtgacctctctgtatgcacatctttttgcaatgtgacttttaaagttgctaccatcaggagttgtaacctatttccctaatccctgaatatgggcctgccttgtgatttgctttggttaaaaaaatgtgttagaaatgagtgagccagctccaagcttaagcttcaagaagtcttgtttccttctctattagaatcctgtttcttgcatgagaataagcccaggagcgcttgccgaaggatgagagaccatatggagcagaggtgaatcatcctagctgcgcttatgctagataagccagcccctagcccacccattagctgactgaaaatgtatgagtgagccagaacaacacaacagctcacgggaccccacagactgtgtgcaattataaatggtgataattttaagtcaataagttttagggtgatttgttacataacactattgcaaattttacactattggagttattacttaactgatatataggggaaagccagaaatgggagtgaggcttggtacagttaagagttcttaaataataccagagtcctcaatcctaaaattactgattttgattttgaatgagtatctaaagtcaggctcaattctttgcaaagatgtctgaagagacattcatggcaaatcaatgggggtaaccactgaaaaagtgattttagaagatcattattagaagacctaataatagctagtattttttggccacttactctgtatcagctgttgcccaaagcagtgaaagagggaaagaaataccctgaaatctccccttctcctgctctccaatctcctgccaacgcctcccactggttaaatctatacagaagatagttgagaagaaagcctgaggaataaggtgagtggaggtgagcttcttgcaatatacaatatattgcacagaaagaggaaggaaattgagtgaatctgtgggaaagttatacttgggttatgaaccccacaacgatctatgtttcaaaggtataaatcatttgaatgtgttcatattttctgtcaaagttgatatgtatcttctgtggtcggatgaatgtgcttcataaatatcaagagacaaaatctttttgcaaaggcctttccagtatctcagaacacactgtatgcattccattgaatgggattggtggtcaactcctacacagactcttgatagccactctctacctccctaccatttaagaagtagagcaaggggaccagggaaccagcatcttgaaattagggggggaaatgcagaacctcaggtcctatgcaagagccattgaatcagtaacctgattttaacaagatctcaaggtgattcctgtttcagtaagtcatcaattaatgttgttgatagattctgggaaactgtgacttaggcaaaatgacatataatgaaaccaatcttaccataggctaattgataaacaagaattaagttcctactgcatacctgtgttcacaaaacatgatccaacatctaaataaagaccccaagcacttctaatattaaactcagaaataaatgtgagatatacatccactttagaaagattaataaaaaccaggaggaaaattatttacccagtttttggtgaatcagtgagtgacagtgtttgcagtggcggtggttcattcaaggaataaatgtttgcaaagcataaactgccaggattgccttctctcaccacaaagttcaaaaacaaacaataatcaatatggcagctcactgagcacttctgtagagcatcaattattgtcacgcatctttatgattattgaatactatatgaatttttatttcacagtaatttatattaattcagtcattcattttccaagccacgtattccagttcagggacttgggaggccagagcccatcctggcaactcagagcaccagacaggagccaacactggcagggatgccattctatcgcagggcacagtcgtagacacataaacactcacatggggacaatgtagacacaccaattcccctaacgtgcacagtttgggacatgtgaggaaaccagagtactagaagaaaacccacagagacaaaagaaaaccccacatagacagtgcccccctagctgagatacagttttttcccttgccaatattataacacagtgatgctcaatgaaacaacattattcaaggacctgccgtacattaaagtttgagaagttctgctctacgtgatggcacgtggatctttaccccttaccactgctattagaattttatggtaacctactttgtaatagtaaccacaatttaactcctcgtaataaagtatgatagtatatattgtgtttttagttcctcactagacgctgggagatgggcaaacatgcttcataatgcatcactgttggacaaatgaggaactagaggcactaagagatttaaataagtggcccacagttatgagttagtgagtgttgaacctgggtctagactgagttatgaactgcaagtttagtgatctttccaggactgagatgaggcatggagaataagaaggtggaacggtggcactcattacacaaaccattagaatatttgaggccacgttgggaattaaccacacgcgaactgagaagctggaaaggggtatctttaagaaaactaatccttcacccgaagtagaaatgattatttaatcatactgcattctagtttcagcataaagacttgaacatgttaatgtcaacatctttttttttaatctttttttttttgtttgtttgagacagagtctcactcggttgcccaggctggaatgcagtggcgtgatctcctttcactgcaacctccgcctcctgggttcaaatgattctcctgcctcagcctcccaagtagctgtgattcaagtcatgtgccaccacgcccagctaatttttgtatttttagtagagacagggtttgacaatgttggccaggctggtcttgaactctgacctcaagtggcctgccctccttggcctcccaaagtgctgggattacaggcgtgagccaccgtgcccagcctcaacatctttcttaattattttagtaattaaaatagtttttgtctgctcccaaactatatgaaatcttacccatagagtgtcttttctattaattttcctgttttgtgtgttggcctttatttgttctcaatgaataagggcctatatagcacctgaatattaatttttttctcttccttaaccagcagctcagtgattctaacatcactgataaaatacacatcactgatgaaaataaaacaataaagcaacctctaggagataactgcaatggtctaaaatttgtcacaaaagtcatagcaccaacagaagcaatcttcatgatagtcatttacattgcaattgagttcagaatgttcattcttttataaaagtttcaataagtccaagaagtactgtcctattcaaaactgttgatgtcacccacatcacagtcagaatgtgtcactttcacaaaaaaatatttttagactgcatttgaggtataagcatcagtcatcagtcacaggttgcctgcagaatgtaaccatcagaacaaatagagttttcttgaaatacccttttgatgactttggtttccggcccatttgctggtccatctcttttcccaccacacttggccaaccatgccaaagatggactatacttgtcccggtgataactgaaaatgttcacaaattataagtgcaacattcagctcaaatgctttcatttccacaacaaaattgatggattttctctagcaacaaacaatgaaatgctctcgtcaatgtcttgtaattggttctaatatcagcaagccaatcaaaagggagaaaaaccaaatttctccatcaggcccttatcagcccttttgttacccatacagtggtcttgccccgaaccataaggtggataaatgaggggaatgctgattttggcatccagcttactttcagataatctagctcatccttctcagctgacacgagacagaaataacatcaaagggtgataaactctttcttgcaaacctggggttccatggttcactggccccaggcctaatccaacaatccattttctacacaataaaaggtaagaaacccattacagatctgttataagccttggcaggtggtatacggcaaaaatggaatacacaaccaacccagcatttggtatcccttttctatggtttgaagcactaggggtcagctgacatgaatatagtagtcagcatttagtattaagttattttagctacataaataaactcacatcttgatgtatgagtataaagatttgacagaaaagttcatttttggtatgattctgatctttaataaaaatcaccctgttattttacttttgtatggcatattggctttgcaggtgatataataaatgaaactgggttagaatttacaatatgtggtcttaaatatggcctttaatctttgttccttatttaacctcagtttaaggagttggcatatgaaaacttccatttaatatcatttcacgattattaaattattagaaaggaaggaaactccctctagtctcagggttggtgctatgtaagtaaaagcattgcagaaacaaaaggaaagaaaaaacattttatattagcaaaatccccttttattatgtcatttcttctcctttctagaagtcattgcttcaggcaaacacctttgtgctaataaaggagttacttaaaaatgctacactgaagatgcagagttatgaaatttttctcctcctttctcttttcatcatcatttatactcttcatcattttaaatccatcatgaacggggaggagagattgctaagaatagtcgaatttgtttttagttgaaaattagcttaacttttaaataaaatctagggcacagcatacttaagtgacacatttacatgcttgatatacattttcagtatgtagatagtggcaacaatgaagtttcactatggaaattagttgttacacaagtatcagtgcttcacaatttatgctggatttttgttatattttttaaaacattattatattggaatgaacaaattatcttgtatttggtgaggtttcctaatagaaaattatctagcttcagtgtaaccttctacaaatgcttttcctttactttgccaaaatgagggaaactgatgtcaaaaataaaggtagggggaagggatggggaagcagtgtgaaagtttacttgctttctgcttggatttctgggttacaatcaggccaatagattgataaaaacgatgttcagaattaaaagtcctctgaattatgttcatactttaaaagtgagaatgctggtgtttgaaaacaatgctggctttgttgggcttcttaggcaataggaggagaaaaatctatcattttccaacacattttagctgaaatgctagttggtcatagaaaatgaaagtaatatcagcggaataggagagcagtggctgaaaatcctctgtgccttccacgagagccatttggttgtcttgctgcctctaactctcctctccttcacctgttgcattcataatagtagcacatagttcagctttctccccaagagccatatttacaactttgattaagaaggtgagacttttggagaatttggaggtgagaatcagagatgattttgtgcttgctctttgcatttttctattttagtattactcctactgtttttaatctaacattttttgagcaattacaatatgccagatactgtgttacacatttcccatttactacctcattgaattttcaccacaacctggggaagtgtcttcttttagtatttgaattttatggatgttataacttaggtatggacagagtaggtataagatcacatagctggtagcaagtggaatccataattcataatctcatcattaatgcctgcagtaaattacctcctcatcactcctgtttactttttccttgtttgtaaagtgtctgatccatattcttggcattgcctatatggtattatagtacatactggtttctatccaggttcctggctcataacacccatagcccttgttacagttttttgttataatgttggttgcgttgggtctcaggggcaggcctctgaccttctcctgctctcctttcactttaatgttccctcgcctttcagattataggtcttaaaaacctcctgttagagggtcccaccatatacccttggggaaggaatgctgatgtcatgaagcttccataaaaaacaaagaggacagagtccagtgagcttccgggtagctgaacaggtggggattcctagagggtggtgcactcagggagggcatggaagctccatgcccctttccgtccctccaccccaaccatacctcaccctatgcatctcttcatctgtgtcctttgcaatatcctttatcataaacaggtgaaagcgagtgttttcctgagttctgtgagctgctccagcaagttagttgaacccaaagagagggtcatgggaaccccaacttgaagcccatgggtcagaagttccagaggcctggacttgagactggtgtgtgtgtgtgtgtgtgtgtgtgtgtgtgcgcgcgcgtgcgctaggggggtgcagaggaggcagacctcggtactgagccctcaatctatgggatctgacactatctctgggtggatagtgtcaggactgaattagagacacccagctggtgcctgctgtttggtgtatggggaaaaaaattccacaaatttggtcataaaagtcttcttctgtgttgacgattgttacgatttgagagtagagaaaaaacacggttagaaagaattttccatacacagcgtaacatttcaataatttggaaagttaaatgtcacgtattcttatatactattgtcattaaagagtgattaattcggtaataatggcaatcagatttcttggataggccgaaattctcagctgaactaaagtattaggaaggtagatgatgatgacaaggacgatgatgctactaagaacaaaagcaatcatgataataatagttattgagcactggaccaagcctagctctaaaagcctgatgtttgttctcataactagagtgaccctctctatatattttatcttctaaagtggaatacttatgacaatgaaagagggagctattaaaaattatgataggataacaggcaaaaaccagaacagtcagagcaaattgagatgtactcatgacacacaacctagtaataaacctcatgtcagtgtgaaattataggaggcaaagtcaaggatgcttatgttataaactttaaattactactcccttcccccaaccctcagcttcaaactgtttagcaactataaattagagatatgaatatttataatgccaagccctataaaattatgcatgtcctttaaataagggaagggtgggaagtgattatgatatgcttagaacagaatgtggcacatagtagtcctttaatagatagctcttgaataaataatttaattacagctttgctgtaattattaactacataaagaaaacatccaaataatggatttccaggaacttacataaagaaaacattcaagataatgggtttctgggaactatcagactatatgcccaataaataggtgaacacccttttttttttttttttttttttgagatagagtcttgctctgtcgccaggctggagtatagcggcatgatcttggctcactgcaacctcctactccctggttcaagtgattctcctgcctcagcctcccaaatagctgggattacagacacatgccaccacgctcagctaatttttgtatttttaatagagacggagttttgccatgttggctgggatggtctcgatctcctgaccttgtgatctgcccgcctgggcctcccaaagtgctgggattacaggcgtgagccaccacacccggcccgttttcttatataatagcgttttagcacacagatttataaaattaaaaactgtgtgaactgtgttacaaatacacttcaagggagaaaatcatgagcacataaaagctccagtggaactatctggtccctgctaagacttccagctagagaaatgatttcctataatgattattatacttcctactatatattttacagcatttttttttccggggttccataaataccagtcaatatggtaacaatgccagtgaagattctattatttggttgaaaaaacatcacgttaagggcaggactgaatggtaactattagaacaatctattaatcgtcatcttgtgataggaaattgattggacaaagtgtccatttttgagcaaggagtcggaaagccaagctctagctttatttaattttctcctttttgctattcacatttatactgacgactaataatgactgtcattacatagcaaatacgtctggaaaaagactaaacattcatttaccttatacaaatgaaaataaatctgaaatgtttactcctcagatacatatttagaagcaacatgattagagattaatacaaaatgaaccagatttctggaaatttagatacagccaactgtatattgtggaagatagtttgtgctaggagttgcactgtatttttactttcataatttttatttggtgattttttgaaaataatacctgtattattatcaatattacaaaaattattcccatattaaaggtttgttatatatgttgtatttgtaaacctacctttttcctcggtaaagtgaataagatgcacttaactaaaattcactttccagccaaatttcttaattgttttccaaaatgcttttttctttatgtgcaccattttatactgtctgggcagtaacaaattcaaatagtaatttaccatttacatataaacagtatatcttatttgtaaatggtattttatgtgtagatagtaaattactgtttacatgtaaaatgcgatgaaaaatttaaacttatttaacaaaatgacaacatatttattaaaactaataggaatgcataacgtacaccacctgtaaaattacttgacattaaaaatagtaggattttaactaattctgaaacaacataaacatgttttgctatattacacaactgtaaatgttccacagcagagaaggttctagaaagtaattttaaaacacagcatctagttctcaaaaagggcaaaaaccaaagcaaaaactcatatagtttttttaaaagaaaataaatccccattttaatattaggatattatccacataaaaatcacttgagcttcaccaaaaggttaaaacccctactgtttattttggaatcacttttatatttaaatagaaagctacatggtctcaaataagtcacataacctttctaggactcggtgttcaaaaataaagaatgataaagcatattttggttttaaataaatgggtagttaaaaaaatacccacatataacatatacaaagagcaatgaagaatgaggaaaggggacacaaaataaaaagacatgaaagagatgaaactgggattaacggggtcagggaaggagagcagaagagaatgtgttacataaacaactggggcagaaaaagagtggcaaatatgcaaatagaaaagtagattcatggccaggtgcggtggctcacgcctgtaatatcagcaatttgggaggccgaggtgggcagatcacctgaggtcgggagtttaagaccagcctgatcaacgtggtgaaaccccgtctctacttaaaatacaaaaattagccaggcgtggtggtgcatgcctgtaatcccagctactcgggaagctgaggcaggagaatcgcttgaacccaggagacagaggttgcagtgagtggagatcgtgccattgcactccagcctgggcgacagagcaaaactctgtctcaaaaaaaaaaaaaaaacaaaaagaagattcctaataaatatataaaaataaattcctataatatacgtgtcaattcatagatgaaaattagcctaaaagtgagaaacacagaggaagagagtgatgatgatggcgagagagcctcctacacccacatgcatgttcagagaaaatacaaagaaatatgaagagggataaatattaaaaacacctgagtcagaagtgtgggtgaagatcatagaatgagatgatcagagagaggaacacagaggctagctttaataacatccccactttgtggctcttacgggtatcattgttaaaggctgtaaaaggtcaagttatgtattagacaagaatgaggatatcatttcatgagccttcattgcatgaagctacccataaatttacgctaatggctatattcagtttaaagcaaccctgtccaccactcccttaaagaaatagctatattatcttcacctgctgttttctctcttcagtaatgaaatataaatgtacaggccgggcgcggtggctcacacctgtaatccccgcactttcggaggctgaggtgagcagatcatgaggtcaggagttcgagaccagcctggccgacatggcgaaccctccatctctactaaaaatacaaaaattagttgggtgtggtggtgcgcgcctgtagtcccagctactcgagaggctgaggcagaagaatcacttgaacccgggaggtggaggttgcagtgagctgagatcgtgccactgcactgcagcctggatgacaaagcgagactctgtctcaaaaaataaataaaaaaaaaaataaaataaaggtacaagagtaaggggtcagttggctcaatacgcagaatgcagcatattagagttagctgtggagaaagtcacctgccaactgattatgatattaggatatgtttggagatactatgtactaaggaattgacatattcatgtcacagtaactatgacccactagttccaattatatcacccactctaacctttggatgaagggtagggctggaggacacagggagggggtccgctttatttctaccctcctgtaataagtaagagcttgagatttaatgaagatcaagactgtctgccagtgttataagccattttcttttacttttaaaaaaacttgtgttatttacctaaatctggtactgatcatttgctttctatccctaaatctaaactaacagggatacagaggcatatggatggagaaaagatgattaaataattttaatatgactaatgaataaaattccaaatcctgtggcatttaatggcaaagacattgcattaaaattataattttggcataggaaacagatattatggatgctgtagtaatataagtctatacatgatggtgttcgtaacctcagttttaattttctatcataaaaatttgactttttattctgttgcaggacacataaaaccttgactctttcacaacccacaaagctgctattgtatattttagatagttctctcacatttcctacaattataatttttgttcttctttttgtcataagatgtactgagatattgtagaacattttgggtatccttcctccttgttctctttttatgagggatgatttcatttgtattgttatgtagctataaaatttaattgctgggacaccaccttccctccatacataaaagtctgtatctttacacagatgttttgcaatcattaaaggtagaaaccaagaagggatttttttttttcaaataactacctgcttgaaatagagacacttaagcgcacattatggttttaatgtcataaaattggtacttattttagttcctaaatattttatcagtcgtgtaaatgatctgttattagaatgtcagcatcaccaatttaaaaaatacaataaataacctgacacaattcaaaatgttcacaaattagatgactcagtatcgtaaagatgttgactgagctccagattcacaaaatttcaatcaatatcctggaaggctttatgtaaaaatagacaatatagttctaaaatttattcaaagaaccaaaagtagccaaggcaatcttgaataggaagaacaaagtggaaggtttacacaaccagatccaaaatgtttaaataaaatgattgcgtatatacatacaatggaatattattcagtcataaaaaggaatgaagttctgacacatgctacaacatagatgaaccttgaaaatattatgctgagggaagtaaggcagacacaaagtggcaaatatataattccaattatataaaagatctagaatagccaaattcatagaaacagaaagtagtccagaggctactagcggatgggaagagagagaaaggggaactattgcttaatggttacagactgtctggttggagtaataaaaaattttggaggctgggcgcggtggctcacgctgtaatcccaggactttgggagtccaaggtgggcggatcacctgaggtcaggagtttgagaccagcctggccaacatggcaaaaccccatctctactaaaaatacaaaaacttagctgggcatgctggcaggtgcctgtaatcccagctactagggaggctgaggcaggagaaccacttgaacctgggaggcggaagttgcagtgagccgagatcgcgccactgcactccagcctgagcgacacagcgagactctgtctccaaaaaagaaaaaaaaaaattgggggtggggcataaactgtggtgatggttgtaataaatgccactgagctggacacacgaaatgactaaaatgacaattttttatgttatatattttatcacaccttaaaaaagtaacaccgaaatacgattgaattgttcactttaaatgagtttaatggtatgtgaattatagctcggtaggattgttttaaaaaaaagattgtaattaagccagtgaagtactgttgttaaagtacagatttaatcaaatggaagaggatacagaatccagaagcagattcatacatacaagttctcttgatttatgacaaagatgccatgaaaatacagtggggaaatgattgtctttgaatgaatagtgctggatcaattgatgttgctttttactataaattcatatgtaccacttgctttatataaaataaatatgtattaatttaataaatagtattactgttagatttatatagtatgcaaggtggaaagatgaaaactcacaagttaataaatcagtaggtaagtaaataaataaacttgtggcgaacgttagtgtacattaattattaagtccataccacaggtgtgaataattaattttgatttatgacacttgtttaactagaaccagaccacgtcctttcagcttaaatactgtcagtacatgcctggccactgaattaaatacttcgccatttcttcagtctgattcttcagaataatttatgcaaaaaattgtggtataaattttggcatttggtcattaatgtaaagccattcaccatcatcattttttctagccacaacaaaacatatagccaaagcaaacggtcaggttaaaaaaacaaaacaaaacaacaatccacataccagcctcctccccgaccaatgaagcacccaggaaacaaaatacatacaaatacttgcaacatttaacacatgtgacggaagagatggttaatgtctaacctttatccactggagatttgtctgcttgagcttattttcaagtttatcttgctcttctgggcttatgggagcacttacaagcacgggtcctccagtttcatttaattgtttgagaattccctggcgcaggggcaactcttccaccagtaactgaaacagacaaatgcaacaacgtttaaaatgaattacagcacaattccaactaccttgtctttgcttctattgattagtctatcaaaatgaagcgacttgaccgagggcccagtggtacctcaaataccaacagttttctatctgagcacagagctgattgactgaaacactcaccccctcagtagataaatctctgtagaaaataaacgattatattatccctcataaattttttaagagaaaaatgtgagatggtaaagcaacactccaaataaagttagtgtctgaaaacctatctctctatcagaaatagaacaatgtgaacaaattcatcagcctcttgggtatcatagcatgccatagcataccgtagcttgctgctgagaaattgcattatcatcttaagaggtaactgacattgagagtattgactctcaatatacacagtgccaggcactgtgctaaccttttcacatttattatcttagtttatcttcatattataataattatatcaggtagatccaattatcttcattttatatggaaggaaactgagacaaaggggttaaataccagctcccaggacacaaatctagcaagcaacaaaggtgtggttcaaatttgggtagtttcattctggagtcctcattttttacttcatatccctaaatttctcgaactcattcaccaccacatagtgtatgccctttcccaagacctccaaaatcaccatggtgttaacacttcatttttgtcaactaaagttactgtgtctgctacagtacccattagccatacaacgctattaacattcaagttaatcaaaattcactaaaataaaatctcaagttcctcagtcacacgaccaactctccaggtattcaaaaggcacaaatagctagtcgttacaaaaatggatgatgcagaatattttcatcatcacgggagttctatttgaaagcactgatctagattctttcaggagaaaatagactcatgcatattaattaataagaaaatgccactaaatatgtttcgaatgaattatcaattatattactatatatgacactcaatacatttgggaaagataaatttccaagaaaagactgagttcattgttctagggtataaccatcttcaaatgattcccactcttttctatttttgaatcccaaatacctagtaaaacatcggatgtatagtcagtgctccatatttgtttattgaattacgccatattttatttttatactttatttcttgttcaggtgtaaacctcttgtttcacagaaataaacgtttgacattggactctaatttacatgtgtaaagcacctgaatcattgataaaggaccaatttcatttccctttgattatgtgaccgtgtaaaatgaggataatagcaaccattgtcaaaatctgatatgaagattaaataaaatagtggctgtaaatgtatctaatacttggcacataacagggaatgattaaatattaatttctcttcccctttcaccttctgcttgacaactaaaatgaaatagatccaaaagagctgctttcctaaaactaaaaccatgaaagttaatccaattgcacaatcagagcatgtcagtcagccaagggaagtaatcagtaataagcagacatcacagtaggacggtatgaaaagccactggaataagctggatgtctattcaaccaaatggaatgtgaaccaacaccacgtcccacacccccagacaaatcagctaaaacaaaacattgcttcgggggaatataatgcctttaagtagaggctgaagtggtgagactgatctggcaatccagatcttccctaagaaaatggattcttctttttaaagactcttctcaaatctccaggtaggtaaccaggacagattaaaaaagtgattcccatttagatttagattttatgattccacaatctggtcttcagtttttaaaattatatgaagttgtgaagttctcaagtaaaatctaaaattaatttcaaatcaaagataaaaactgtgaattatatacatttagacatattgaatctatacatctatatgtgtagatgtatagatgcaatatgtgtgtgtgtatatataaatacacacacacacatatatacatatgttcttatgtgcactggttcagaactgcagggttaagaagaaataaagttgtgagaaaaacactttagcaaggaactatgaataacctaatgggcagaaaaccaatgattgaattaaaaaatagattcatatacttctttatgcaagcaggccctgggggatttgagaaaataaaattaccttgacttgctcaagcttttcttttagttgctgctcttttccaggttcaagtgggatactagcaatgttatctgcttcctccaaccataaaacaaattcatttaaatctctttgaaattctgacaagatattcttttgttcttctagcctggagaaagaagaataaaattgttatttttttttccaacatagttctcaaactatttgttaatgcaaactgggacacaaacatggcaatttaaaaataagcaatttaaaagatgttaaccatacataatttaagaaaattcattcactttgaacaaagtaatttcaatatttcaagaatctctaaatgataagagattaaaatcgaacaagaaaaattctgattcaaaaattcctggccaggcgcagtggctcatgcctgtaaccctagcgcttagggaggccgatgtgggcggatcacttgaggtcaggagtttgcgaccagcctggcaaatatggtgaaaccccgtctacactaaaaatacaaaaatttgccaggtttggtggcaggcgcctgtaatcccagctactagggaggctgaggcaggagaatcacttgaacgtggaaggcagaggctgcagtaagccgagatcgtgccactgcactccaccccgggcaacagagaaagactccatctcaaatacatacatacatacgtacgtacatacatacatacatacatacattaaaatgaataaaataaaaattctaacaacattatgtcattatatctgagcaaggtttctcaactttagcattactaacatttaggtttggaaaattctttgctgtgagcagctatcctctgcattgtagggtatttagcagtatccctggcctgttgaacacactggataccagtagtaacacctcgcccctgagctgtgacaaccaaatatgtttcaaggcactgccaaatatgctggggggttgggggtggggacaaaattgtccctggttgagaaccaactaaagtaagtatataacctaaagttacaagttttaaaatgtttaattaaagtatacttatggaaaatgagaggacaaaaatataaacaaggtttttgttttgtttaagtagcagccattttatctgcttcttattctgtgggtcaaggatttggatagggctcagttgagcagttctgctttatgtggcttcagcttggtttaaaataaaacactaaattattacatgctaaactgttttccgaattatgactcacaaccttatttgaggaaagagaaaaactgatttaaaatacttaacatatgttgtactcgtggaagttttaattatgaaaatgcatataactctatgctaattagccataaatttattcttacatattcgattgtaagacagctgaacaaaattgtttgtgcttaaaataattgaaaattttttgttttgttgtcttttgggaactatgtgtagcttccatggaagcttttaactgaagtgtaatatacgtacaggacactgcacaatttaactgtatagcccaatagtgttttaaaaattgaacacactgtacaaccagagaaggaaatagaatattatcagaatctcagaaatctcctcttatccctttgcagtcactgcctccaagtataaccagtaccctgtcaactttgattattttgccggtactgaatattatgaaaatggaattgtatggctttatactcctttgtgtctcgcctttttcattcaaaattatgtttacgataatccatgttgcatataattttagtctgttcattaacctggctgtatagcatttaattgtgtaaatatagtactttagatggacatttgtgataattcagttttttgaatgattagctatttttttttttttgcttcaaattaacaaatgtgtattgggagcttactaccttctaagagctcaattgggcattaggattaaagatatatacgttatataccttgtcttgaggatttcatagtcaatgagaagaaacaagcatgtaagccaaggattatgattaagtattataggaggagaagttatttctggggcagtgcttgggagacatcccagagaagataatgatctgagtcttgaagcatgaagatagatcagcatgttgcaggaataagacacagcctgttcaaagacagggccttgagagaactacagttgcgatcattctgtaaatcagaatctggttattggacttatgcttgcatatattcattcagttttcctatatgataagagcctgttcaaagtctgttctgggacacgtaaagttacattctcccctctgtctattctcttttaaattcatttatacatttattcgcttatttttacaaatgtttatgatttattgtttttaatttttgtagggacatagtaagtgtatgtacttgtagggtacgtgagatattttgatacacgcatgcaatgagaaataagcacatccactgttcattcctgggacactgggagcagggtctgtttttaacctatcccgaatataacatctgatctagaagtacttctgccttatctgactgggaagatgaatgctatttacttcagctgagagtatattttgttgtctcatatattttggggaaactactagtttaataaatcaagagatctggagctcggggagagaggaaagctggaaataaggactttagtcattagcaatcagttggcagagaaaacacggtaaactaacttttgaactaataattaacatttcatgtttgctattttctgagtccattctttcttcgttttatgaattttaatcattgacaattctctcttatttaaattgaaaaataggaaaagtcaatttcaaagccttttgttgatttcttatgtatggttaaccttacggttcctcctcttcttctactctatgtgcttggccatggaaagccaaaggaatgcctacggtgctcttctggcctctccaaaagctacacagacctgggaaggaggtctgcagattccaaacattcattgaagtgagaggatgctttttccttcttggagtctacatacttactctcagtgattctctcgaagtctctacttctgactcagagagatgaaagagaaggaactgtcccttaccacaaactgcactccccacaaagcttactaccccttcctacctgagtctttttaatcttgcctgggacacggagtacagaggagattggaaattgcttggaatagagataataatccctgttgctttagagtaaaccctatggggaagtggctggtctcgattgctggcagtttgttttagaatgtggaacagcaccatttcccctcagattctgaccttagaatcaattgtggaagaagaaaacgtctagtatagtacaggcatcctttatttgtttaaatgttccaagcagatttaattccttgggtctagattttgagggtctatctcatctttttctctctctctgtttctactctgcaaatcattgcctccattactatttgactccagatgattttgcacagtgttctgaatacttttagttaagtaaaatcttgctaaaatctgattacatttgaaaaacctagacacattggcaaggcttttaaacattttcaactttcatctagaagcagacacgtttaaggaaaagaaaaccccaaaccccccaaacaaacaaaaatttaaggagcaggaaaaagtaatatcaaaccaaaaaaataataataaccctcaagtttagaaaattctaaatcaaacactcccctcttttcaaatatgtctcaaattatttactagcatatttttttctatcaagaatatccagtacagaggagagatgttgtgcttattcatcatagttgagatttatatgtattactgggttcaaaccctatattgtatgcttattttcttcatttattattctactatgtgtctctgtaggtcattaattacgctttaaaaacttgattttttaagatcctagtaataagatatataggggtaccctatatttcaccattattgtgttattaggaattttgtttgctttcattttttattataatgaataaccctacaataaacacatttatttatacattttgaatcatgtatctgctggaatgagaatgaaaagttaacaatgggaatcctaaggatttagatacacattgttgaatttctgtcaaggttggtactcagaacactcgtaaactcccaccaacagttacaaaatacttgtctcactacacttttgccactattgagcattataattgatataccaataaaacaaataaaaagcttgccatagatattttaagtattctactaataggaaagttgaaaatgttgtatgtgtgtacatgtttgtcatttatttagtttccactgtcaattatcggcaatgtctgttgcccatttttcctgtgttttcctatttttaagagctcttttcacattatctgaaacatagattaattgagactacgtttccagcttcctttttgccttttagtagttttttctaaataaaatttaacagtttatttctttgatattatgttcattgatagtatccttaaaattgtggccattttaccattgttcagatattctcatttattcttgatcctttactctttcatttgttaaaaaagaacaaccaaatatttaatccatcttaaatttatatagtgttgtttctaaccttgaagagtttttcagaaactgatattttttcccccagcaccatctcttctgaattgatttatggtgctttcttcatgatattttaagtttctgcttgttgatctactgtagatttttgtgacagtaatgcactatgtcaattattgcagctttaaaatatgtttaatttctggtaggttaacccgctctcccactttagttattctaacttatgtaatgtatcattcagtcaaattataaaacaattctcgctgaaaatttttaaatgggattgcattatatcaataagttaatttgtgaagaattactgcctttccaatataattctgctaaactttctgtatttacagtgttcttggacacagagtatctgggactcaatgggacactataaataattaagtacattttataattaaccttcagcatcaatttgaaagacagcatcttgcatatgattttatggatattaaccatatactaatttagaaaactcttaagaactctcagaataaatcatcacttaaacagtaaaagctttggctaagctttttgctgtctttctttttacacgatatttgtggaaaactttttttccagtgatttaattttttaaaaaaacagcatcttttaaatatgaaaacatttggtagtcatttcttatctagattttttttatactttgaaatataaaaaagatggtgacaaaatcccgttgggaccttgttataatctgcttttccaagcgcatgtgttttctgaaatttcaaaagcctcgatttgaagttttaaaagctgcaatttgaatttatgtattcagatgattgcagaaaagcaaagaaacacagttagcatttccaggcttgtctcttgacagaacagtttaaacgtgcttcatattggcattcatcacatgaagtgttatttctttgtttacctacttgcttaatgcttatgggaggatttattcagacaagtggtagtaataataatgagtgagatatttaacattacccatctgcaaataagtgctaaatattttacttttagaagcatttcaatacatttagacatttagctttttttagaaagaatggcttctgtttgaaatattggctctgttaccatttacattacaaatgttcccaatgaaattaaaggaagcacgtattacgatggtgagagatttgcataatcagaaaggaagcgctactcatgtgttgctaaattcaatgaatttaacattaactcttaatgaacattttctgtcgggctactcttacgctaagaggaatagactgccaaatcacatggcatgattttggtgaggggatctaacaagtgtttcaggtaaagtgctagatagtttcacagtggaatcttttaatattccatacatcctttggattgccttttatatgctttcaatgaagaaactgaagttctagagattgatacatcacatacccaaaggtgactatcccattttccaaatgagaagtccctctctccaagttttttgatcacctttaacatagaaactttagaaaatggagatacaatgatcacctgtttacatataatgtttaattcattaatttgattgtgtgtactactttaaaattatatagtacaaaatattatgtcattagatcacacttcttcattcatatttcatgcaacaattttgttcaaattcttcacaggcaccttcaacattgaaatttgcatcctcatggatgcacttgttgttgcctaactcagttttccagagggcatcatctttacttacatccatgtggcctgaggtatagtactgctgaatctagaggtaatgtttcactaggaattttactgcaagccacaagcacacatttacataacagaatacagttttatgttatgtaaagacagctttatcttttttctgtgccatatgtccatgagctacaccatgtaaccacttaatgagttacttttaacagtattctttccatagcttgtttacaatggcatccaactcttgcaattgtgatgtcatacaaccaaagtcaatccctaaactgtgttaaatttattttctcccagtgtgtgtgtgtctgtgtgtgtgtgtttttgccctcctctatcaggtttacttctacaagcctccaaaataagcataaattgagaataagtcaaggcaatacatctttcccggacagtactttgttgttttgattgaagtaaaataaatgaccatcttgtaatttgagaaacttcagaaggattcaagtataagttgacccttcccgagggaaaaccaaaacaaaacattgatttctacacacacctagtaacctcctcaggccataccctccgtaggtcattatcagaatcagaacccaagcatcaactttatttttaagccaacatgtctaccatacctggttggtgcttgagttgtacaagtagacatttgttcattttccctaaagtttgtgtcttgtcggaatgaagtgctcctgagggggataatatatcaagatttctcagtcatttatgcctcactattaaggaaatgattagcaacttttgagtagatgtggaaaacgatgagggaaaaacctgaaggttagcaatgcgaatatctgtatggaaagtaagtccaaatctaaatgctgccagttatcagctgagtacgtgaacacgggcgagttccttaatctctttagccctcagtttcctcgtcttaaaattagaacaataaacattttagagtgttgtgaggattaaagttttttttgcagaaacccaagatttagcctagtgcttcactaacagcactcaaaaaaaatggtagagaacataaaaggaggtacaaaaaagggaaaatatggatacagagctttctgttttaatcctagaattgtgtctaagcccacgtgcttacatagataaaagtatttataaaacattatgagtacacaggaggagtactcaaaattgaacttttgatgagccacctgacaactttatttctccctactgacaaactaccttgacaaattttgctggggaaaaaacaatagagaattaatgtcaatctatgagtaaatgtgccaccagatgagactacttctaggtgaagcatatatgtaatcacaatgcaacagccatttattgagggtctactagtgtccattgatatggccgtgaatatcggcagcaatccctgcctcatggaccttacatccgattgggaggaaggggaggcagacagtaaacaagataaagaaataaaatctatagattgtgatacagtaagtgttacagaggaaaaaaatgaagcatggaaaagggatggaaatattgaggggaagatggggagcagttgtgattttataaagggtgatcatagaaggttccatggagaaggagacatttgagcaaagtcctcgtggtagggactggctagctgctcattagacaagtctactcatttctcttaattgtgcagctagctgtcatttcccagtctcccttgccattagtttggctacatgactgagttcgagccaatggagtgtgagcaaaagtgatgctcatgaatatgaagcctggctcataaccccacctccaataaccaccaccacatatgtaatattccttgttctttttcattcttatgtacaagagcacagtgattttgaaatccgtatgttaaagacatcagagccacaaaagcgaagtgccctgggcccccctgatccaccatttggaggaaatctacttgttgaccagaaaatttttgtaaagtttgcatgaacggaaagtttctattatgttaagccactgaggtgtgggcttttttttttttatagcagctttaataaagataggtaatatagaaataaagaagcgagggaggaggccatgcaaatattgcgggaaagaacgccctaagcagagaaaacaagtacaaaggccttgaggcaggagtgtagtaagaacgtcctaaaaacagcgaagaagtgaacaagaagttcagaaatggagtgaggaaaggagattactagatgtggcccaaaagccttctattcagagattctatctggaatctgaaggcttttataatccctatcccacatcgaattcagtttctgggtaaaaataaattatagagcaatatgtttgggaaatctcagactgaactgtgttctccaatgctactttaatagatccaatcaactaactgagccctaggacttccccccagatttttgtgtgtgctgtctacacagttgctgaaacaggcttcgggaaaatctgaggatgctttggatcttcatctgtcagaggcagagttacatcacctatcagtaaagcctgtcacaaagccattaccatccgatagaaaatgcaattaagagggtatgacttcaaaccgttttttctgatttgaatcccagttcagtttttcccttcgcagacattcaaacaccatcatcttcctgcctaaacgtgctcctctgtcaagttcaatggatgactccaccagctcccggttttttaagctgaaagtgtagaagtcatccttgattcttctctctccctcactcccagagcgtatcaataagcatgtcctcataagtccacttgagaaatctctcttgaatctgcccacttctctccatcctcctgtcgctgtctccttcgctccttctcattctgatttcaacttttatttttgatccaggtagtatacgtacaggtttgttacctgagtatgttgtgtgatgccaaggtttagggtaaaaatgatcccaccacacacaggtagtgagcatagtacccgataggtagtttttcaacccttgcccctctccttcctcccccttctagtagtccccaatgtctattgttttcacctttataatgagtacccaatgtttagcttctaactatcttcggttttctgttcctgcattaattcacttaggataatgacctccagctgcatccatgttcctacaaaaggcgtgactgtatgctttttatgactgtgtagtattccatggtgcatgtataccacgtttatttcattcaatccaccactggtgggcacctaggttgattccatgtctttgttactgtatagtgctgcgacgaacatgtgagtacatgtgtctctttggtagaaagattcgtgttcttttaaatatataccaagtaatgagattgctgggttgaatggcagctctcttttaagttctttgagaaattttcaaactgctctccacagtgcctaaactcatttacattcccataaacagtgtataagcattcccttttctctgaagcctcaccatcatctgttgttttttgactttttaataatagccattctgttctgatttctaacagcctctctgagactgctttctaattagctcgtgcctcctaccttgtctccttcttatccactctttacacttcagaataagagatctttctaaaatatgttgctgatcatgtcctcatatactcaacaacatcctagtgccaatgggataaaatataacttctctaacatggtcaaaaagccctttgtgatctggtctctacttctatttcttcatctttctttgcactgtatagttcatggaacaacttactcttccttaaaatccagcactatatccatatcaggattcatcatacaatgttccctctgcctgggatgtccttccatacatcttcatctaggtagctccaggttgacctttccaatctcaggttagacatcacttcctctacaaagctttccttgattaattagacatccccaacccaggtataggtcacaggtcctgttatgtagtcccacagcccctcataatgtttccatcacaggaaatactgtaatttcccatgttcatcaaactattgcagattttctatctattgtgatcgcaccctatcctcagtacttagcatatagtatttgcttagttcctatattaataatctcctaatgacatcatcttaattgtatatctccaagtaataacattatttcatagtagtctggggagattttccatgaagaacaaagtgtgtgtgtatgggaggcaggttctgtataaaattaacgaaattcaaccagggaaagctatacagcaagtgtttgtaaactatggctcatgaaccaagttgtgctcaccacctgtttttgtaaataaagttttactggaacagagctacactcattcatttacatattgtctatggttactttcatgctacaatagcagagttgagtagttgcagcaaagattgaatggcccacaaagccaaaggcatttagtatctggcactttactcaagtttaccaccatctgctatgtgataaatctccttcttagacatctactagggaattaaagatacgagagttctgatataagaaaatctgtataatctctataaaccagtggtatgcgaagtcatgaaaatatctatgataattagaactactcctcaccccttgaaacaatcatgagcactttacacaattattatttcacaggacaaatagaaaaactagacattgcatctgattataaacattaattctgtttaaattcacgaacatttccaactatgagaaactatatctacttaccttagaatcaaacatggaaaatagtcaaaagacctatgcctctgcctcacttttcttgtcttggcttttacattatgccagtttctttatatttctctttcttcctaacccacaaccaactttatcatttattttataatttcacctcttttttgttactcagttttataatttcacctcctattttgttactcaatttttttcccctctgggctttatggtgatttttattactgtgtctgtattttgaattcctcgtggtagtaattctttccacccccagaaaaaatgtcatctgttttctcaaactatgtatgtttccagtggaatatgaatacattatatagagacggaaacccgaagttccccagagagtgagagagagagagagagagagagagagagagagagagagagagagagagaaaagggaacattttgatcatcactttcatactcgagcagaaaggcaaagggtatttccgtttcacttatttaaactctgcacataattgcagctaagttcctcagaaacagaggttactattctttaaaagaatatagccacaggaggtacaaaaatagttatattccctgaaacagtatttccttaaatgtggtctggggacccctgggagtccctgagacccatgcagtggttctgtgaggtccaaattattttcgtaataatactaagatgttatttgactttttcctctctcattctattatgagtttttcagaggctacatgatgcgagatatgacagcacattcaatgcagaaacagatataagaaccagctgccttctcttaagctaacttttaaagagatttgcaaaaatgtaaaacaagatcactcttctcactatattgtttctgttgtagaagagatagtttaaaaactaaacatttattttttatttcaacatgcaattttaaaatgaattaataagtaaatattttgaacaattaccacttttttttttttttttgagacggagtctcactctgtcgcccggctggagtgcagtggtgcgatctcggctcactgcaacctctgcctcccgggttcgagcaattcttctgcttcagcctcccgagtagctgggactacaggcgcccgccaccactcctgtttgtttgttttgttttgttctgcttttttttttttttttttgtatttttaacagagacagggtttcaccatgttcaccaggatggtctcgatctcttgacctcgtgatccgcccgcctcggcctcccagagtgctgggattacaggcgtgaggcaccgcgcctggccaagataattttttttgtagaaaaataatatgtccttgtcaactggcataagtaatgacagcttatcatgcatgccgagtttgtcattataaagacctcagacaagtaaataatacaatgtaaaatgaaaattgaaataatccattaggtatgaagaaatccaccacaaacattccagttggagttcagaaatttgccaatgaatttattagagacagagggaggtgaataatgtaggccaatgactatgagggtcaacttttagagttaatgaactgcctaaatatttactgggaatctctgtgatatgctaggctaagtagggcaccttcaaatgatatacacactgctcacttacagattatatttcactgaggcaagctcgcctgtcattaacttactgtattttatcaacaaatatttgagcatctaccacataccaggtactgattttgctacttgatgaggtagttaacaaaatgttgacaggctagtcagtgatacagatacatgaatgggtctccttttttttattgtttttattttttgagatggagtctcgctctgtcacccaggctggggtgcagtggcgcgatcttggctcacagcaacctccacctcctgggttcaaacgattctcctgcctcagcctccgagtagctgggattaaaatgcgataagcattgaagtgtagctatgcattcaccaaacatttattacacatctaccaagggccaggcactatactatttttgctggatattcaggagtgaacaaaacagagccagtccatacacgtagcttatggtgtcatgggtgacatcaacattaaaccactaatcatacaaaagagtttaatgcaaaccatacatatatatagaaaaaaattaagattgttaggagagtactccttttttacaaactttcactttcagaactttcataggtatgttgctcctaaaggcaaatatgcatcaaattttactttccatgaataaatggggtcactggtcagctatagttattatagtttttggtatcatgtctaactttagactaagatgtgtctcctctgtgtgtatttttgaaatgttttctaaacattattaatctcattatgtgccatgagtacaaaagcaaagcaaatttgttgagagtcctgggaaaacatagaaaagaagcaataataacaataataatcaaggtcctcaacatttataattttctcaaagggcttaactgaatatctatcggtcttttgaatggagacatatgttctaagaacaaaagcacttacagtcatttggaatataacctgtttctaagaagagcagtggatcttacttagattgaaaaggctgtggtggttgtaacagtgagtccctctgagtaagtaacattgaaattgagccctgaaaactatgtcaatatcagccggaatacagatggtacaagacaaaggaattagcttttatcaaggtagaagaaatacttagcgagtcagaggaattgaaactaggaattcagtgtggctaaagtttagagagaaaaatggagagttgcaggagctaagtccagagaaatggacaggtaatatcttctacattacctctgggcattaaaatttgattctgcatgaactttattagtgtattatttattttacatccatgtcaattactaaattcattaaaaatttggtacaaggtacagatgaacttagggagtctacctaacagattactcaagattggttttgatccttgaagtagaccacttcacttagctaagcatccgttttaaaatactagaatccaaagggtatcttcaaggatttcttttttaaacagacctagccatgtacaatagagtcaaggcagtgtaaactaaaatatgtgttttctggttctcagatcaataggacatacagcagactgacatagcacttaggagaaaatttctctgtatgtttacgaaaactgaagggagtttttttttttttctccactgggagctgaccatcattaccttccagctgaatctatgagagaattctgttcccattctcctgaattaatagttgctaagaaaatgccacataatttatttgctatatgacttaaaaggcaaagcataatgaaaatgagagtaaaataaaaggccattaacgagaaaatattgcatatataaatttgtgtcatatatatagtaaatttgcatcataccaatatcagggagaaaagtaagattaccttgtcaagcatcaagcacaagtagctaaaccttaaatacagtggataatgaggaacactgagataccaatattttttaaagcttctatttatttattttgagacagggtctcctggggtgtggtagcatgattatagctcactgtaacctccaactcctgggctcaagaaattctcccaactcagcctcccgagcatctaggactacaggcttgcatcaccacagtcggctacatttttaattttatgtagagatggaatgttgctatgtgcccaagctggtcttgaactcctggcctcaagcaatcctcttgccttggcctcccaaagcactgagatgacaggcatgagccatgtgcccagtcaacttttaattttcatttaacagctttattaagtatttaaggtgtacacgatgggtccataattaacaaacagatcttccccgactgactacgatggtttgacttacaattttgaagttcaccatggtgcaaaagcgatacacatttagtataatcctggactgaggatggggttatatctggatatactcactgtaagttgaaaatatcattaattgaaaatgtacttttgactcataacattttcaatttatgatgggtttatcaggacacaatcccatcctaaggtgaggagcatctgtatacaatgtgatgaattgggatataagcatacaaccatgaaaccatccccataatcaaggtaaccaagtatatgcatcaactccaaaagtttgctcatgcccccttcattttttctttcttcttcttcactttctccttctccttcttcttcttcttcttatggtaggaacacttaagacatatcctcttaataataatttaagtgcacagtacaggcactatgttgtacagcagatctttagaacttatttacattatataactgaaactttatactcattgaacagcaactcccagttcccccttcgcccagcccctggttactatcattctactctctggttctacgagtttgactgtctcagacacctcatataaatggaatcattcagtatttgccctttggtgactggcttatttcacttagcataatgccttccaggttcatacatattgtcaaatatggcaggacgtccttcccttttaaggccaaataatattccctgtatgaatacaccacattttctttatccatgcattcttccatgcacagctatgctgtattgatatcttggctactgtgaataatgcttcagagaagatgagagtgcagatatctttttgagattctggttttaattctttgggatatatacccaggagtgaggttgctggatcatatggtagttctatttttaactttttcaagaacctttctactgtgttctatagcagctgcatcatttttccattaccacctatggtgtactagcgttccgatttcctcacatcctcaacaacatttcttatctcttgtttttggtttgtttttatagtagccatcctaacaggggtgagatgatagtgttcatctcacagaggttttgatttgcatttccctgatgactagtgatgctgagcaccttttcacatacctgttggccatttctatgtcttctttggagaaatatatatttaaatattttaaaaatcaagttatttgcctttttcctgttgagttgtattaacaatcagctctgtttctgtacactaacaataagctacccaataataagcttttcttctattggattatcttgtcacctttgtcatatattgattgaccataaatataagagtttattgctggactatcgagtctcttccattgtcaacattaggagtgcagttagtagatttaagaaaaaaatatgaataggtttgtttcctaaacctacaggtgatctataagcctgtccttatgacagtaccacactgtcttcatcattgcagatttacatcaagatttgaaatcaggtaatgtcctgatttcaaagtcctctaacttttttcttctttttcacaattgttttggctatttggtacatttgaattgctatatataaattgtgggatcaatttttcaatttgtgccaagattgtgcaatttttcaatttgtgccaacatctgctaagatgtcgatggagattgcattaaatctatagaacaagttggggagaatcactaccttatcagtattgagtcttccaattcatgaacatggaatatggtcccatttatttagatttttaatttctctcagcaatgtattacagttttcagagtacaggtttagtacttatattttcaaatttatgaccatttaatctattttatgctacaaagaatgaaattattttcttagtatcattttcaattttttattgctagtacacaggaatgtaatttattcttgtatattgattatcttgcaagcttcatgaacttatcagatctagcagttattttgtggatatcagatttttctacatacaggattgtattgtctgtgaataaagagagtttcatttcttcttctatactgtggatgcctcggattcctatctttctcctggacctgggtttttttgttggaaaattttaaattactaattcagtttctgtgtttgtgttaggtctattcatatgtctatttttttcttgaatcagttttgttaatttatgtctttctaagaattttttcatttaatatgttttgcagaaattgttgacaatgttgttcatgttattacattctagtctttctaatttctgtagggttggtagtaattacccctttttcctttatgattttggtaattcttttttttttggtcagtctagctaaagcttctccatgtaaaaaatattttcaaagattaatgtatggtttcattgatttttctttcttcttcttctattttattgacttctgctctaacccccgttatttccttccttatgcttccttcgagcttactgtgttcttctttttctagtttcttatggcgaaagcttgagttaatgatttaagaattttattcttttctaaaataggtatttaaaactagaagtttccctgtaagcactgctttagttacatcctataaatcttgacatgttgtgcttttatttttattcagttcaaaatattttataatttcctatgtgatttagtttttaaccaatggatttagaagttgttgaatttcaaaatattttgatatcttccaaatttccttctgttgaattccaatttaattctgacatattaagagaacataatttttatgaattcaagcctgttgagtgtattgagatttgttttttgacctagcatagaatctatcccagagaaaatttcatgtgcactttaaaataatatgtattctgctttcatttggtggcgtctcctataaatgttagttaggtcaagctggttgatagtgttggtgaattcttctatattgttgctatttttctgtctaattggcctgccagctattgagagtagggtttgaagtctccaataataattgttgaattgtctagttctcctttgaattctgtcaatttctgcatcatagaatttgggactttcctattaattatatacgtttataattgttatattttctgcttaattgaccccttatataattaaaaatgtctttttctcttgttacatattttgtcataaagtctattttgtctgacattagtattgtcacttcattttttatatgtaaacaatttgcatagtacctcttttttctttgaaattatatggttttggctctaatacatttctcttttaaacaaactatggttggatattttaaataatcctgtctgaaatctctgcctataattggaatgcttagttcactcccatttactataactattgatatgtaggttgagtatcccatatccaaaatgcttgggattggaagtgttttggattttggatttctttagattttgtaatatttgcatatacctaatatcttggagataggacctaagtttaaacacacatactatatatatacatatatatatatatatatgtgtatatatatatatatgtatatatatatatatgtatatatatatatcttaatagatatcttatacatataacctggaggtaattttataaagtatcttaaataattttttgcatgaaacaaagttttggctgtgttttgactgtgactcattacaggtcaggtgtgaaattttccacttgtggtattatatcaaccttcagaaagtttcacattttagagcatttcaaatttcagatttttttaatgggaattctcaacttttagttgcaattacatgtgccatattgtattttttcacatcttattcatgtcttttttgttcctgtttctcctttactgcactgtcttgttagttatttttagtgtgtaattttaaattttgtttttaactatttattttcttagtgcttgctctaaagattacatatgcatcttaattgatcataatttacttaagttcaaactaatttaacacagtaaaatttagatatttttctctgctaagctccatttttgctcctcctgcttataaacacaataacacaatgttataatttttatgcaatcttaggtcttttaaagaagttaaaagaagaaaaacatatatctatatttgtacagtcttttatatgtatctacatatttatcagttctgtgattctttatctcttcatttgggttcgagttactgaatatcacttcttttcagcctgaatgactttatttagttttttcttgtaagtcaggtcagctagcaagaaatattctcattctcaacttggtaatatatttattttacctatatttttgaaggatagttttgttttatgcggaattcttggttggcaattttgtgttctctgagaactctgaatatgtcatttcaatacctctggcctctattgtttatgatgagaaattaactatcaatcatgtgatccctgtacatgaggagtcatttttttctggttgttttaaagactttcccatttgtctttcaataatttcaaatgaaactatttcaatagtttgactcttatgttttagggtattgatctcttcgtgtttattctatttggggtttgttgagcttaaccgtatttgtgaagtgtttggccattatttcttcaaataatttttctgcctctttaacaacattctctttttttctggaactcttgtaacatctacattgatatgctcaatgttttgacacaaagctatgactcatgttcgttttttatactgttttacctctgacattcagattggataatttttatttatctattttcaaatttactgatttttttttttttctgtcttactatctgctcttgagccccattagtgatttttttaaattttggttattctactttccaattctagaattttcatttggttcttttatatagtgtgtatcttttagttgagattctctatttgtagttattgttaccatactttcatttaattatttaaacatgcttttcttcagttgtttgaaggtatttatagtaggagcctttaagtctctatctgccaatacctgggccaattcagagacaacttttgttgactgcttttccccatgagaatgggtcacagttgaacgtatcgtaaatttttcttgaaaatttgacattttaaataacatattaaaggagccccaaattctgatgttccttcttatgcccagcgttttttaaattgaagttttaataacttgcctagatgaaatctgtggaatctgtttccccacagtgtgtggctgttgatattctttctctgtcaaacaacagaaacaaactgtatgcctagtttcctagaggtaagcatagcttaatttgcattagtcaatagttggccagcagttgatcttaaatacctcaagccagtaagacttccaagttttgctaaaggttctttatatgtgttaaagggtatattcaacatgcaggcacattttaagttttcatgaaggagacacaaggagtccttactgaggcctattacggctgcctcattttgcagatatgctggttaaattaaatttctggccagtctgccagtcagttacttgttccaatcaagactgcaactttaggccagctgagttgctattctgcctttttgtttgccgcctaggtctccaccgttactgacaatgcttctggacatggagttttaaacttctgcttcaaataaaatcagtccctgtggtgatgaagctgcttatttccatggcttgttctaccttgatagaactattatgcttgaccaagctgggagtggggactgggggcaatacaggcaaatacaccacaaattcatattgttcatatacaaagtttagtactttttataaataatcactttttaatttagcatatgccgttggttgatatccagggtcataagatgttttctccagtgtgtcccattttactgattcttggggagatttatcgagctactcactttatcatccccagaagtcatgtacccagacactaacttctaagcacctactcatgtgctgggcatagagctagccaatttatttacattacctcttactcttacaacatctctataaatatgtactattatctttatttttggattagtaaaaggaagctcagataatttaagtagctggtgcaagagaaaaaagaacaaattaaaaatataaacgcaaagataccatgttacatacttccaaaggtaataaacacaggtgggaagataggtgattattacccagcatttagttgccaggtttatgtaatggccaacctgaagtccaagtactctgatttactactgcctagtataaaggctaattagcaagaaaacaccaaataagtcagtaggagaaacaagctgtttttgtcatggatagactctaatcattaaaaaaacaatcattatattggctcataaagttagaatttgattcgcacatgtaattctaataaaatccagggtcccacgtgacccatattcgttaaagagttacaccaacagagaatcagcccagcaaaaatagatcatcaaaaaataattataatctcaatttacattttaaaattaatatagggaactcatctacaatttacagaacattccagaactttcatttcttctcctcctcacttttttttatacccatccagttcttcacaatctttcaacctctgaaacactccagaaaccgtatccacattcacagattctcttgttatctttatggggtagataaaccttgcttttgtagatactttccttttacacaatcgtcatttttccttaagtattctccaaattccacaccatttaaaatttataggatgaatggataaagaaaatgtgatatatatatatgcaccatgggatattattcagccatacaaagggtgaaatcctgtcatttgcagcaacgtggatagaactggaggtaattattttaagtaaggtaaaccaggcacagaaagacaaatattatgtgttgtcactcacatgtgggagctaaaaacatggatctcatgaaagtagacactaccttggtggttaccagagatcagaaataggagtagggagaggggacaaaggggaaaaataacataaatttacttattaccactgaactgtatacttaaaaatggtaaaggtatatttacttttatttatatagaggtatattttacctcaataaaattaaatttaaaaaattcaggccaatcacattggctcatgcctgtaatccccgcactttgggaggctgaggtgggtggatcacttgacctcaggagtttgagaccaggtgggcaacacagtgaaatcctgcctctaccaaaaaaaaaaaaaaaaaaaagaaatagctgggtgtagtagcccgtgtctgtggtcccagctactcaggaggctgaggttggaggatcgcttgaacctgggagatcaaggctgcagtgaactgtgatcatgccactgcattccagcctgagtgacagagccagaaccccatctcaaaaaagaaagttcataaaagcatatcaaatatagtacttttccttagacataagaggaagcacatatctgagaagacacaggcttgaagctgttaaactggcaaataatcataaatgtagtggggaatattcactttcttatttgttctaccctgtcgtcactattagctgctttgttcacatagctagatatggtcatatgtaacaataagggaaaaggcacagatctgggtctaaatcactgacttttagttctcgatccttctataactttggttagccttggacatatatcttgttttttcttgtgcttaatgtggtaatttgtaaaatggacataagaatgctgccatgctttgcttatgatctcgaagagtcaggtgagatgatggacgtataaaatctctataactgagatattgcgacaattaagtgggaaacatttgtaaaactcttatcaaagtcctgttcatagagtaaatgcacaaaacttagtgtcattaatactagctcttgtaacttccaaatttatagtttgggtacatgaatagatagtgatatcacccacagtagattttgggagaggaatataacatgttgagttttggatatactgactttgagatggctttgagacatagaagaggaaatggtccatttgaagctacatatgtaggtctaatctgaaactatatattgggccaaatattagacttaggccataaaatgaaatcggtgactttggtagagactgcttagctgcttagcccatgatccattccactacattttgaatgcccattgcagtttggcattgtcatgagaataaattctggccaatgacatacaagctaaagtgttgtgtagatcttccatgaagtccctttaaaagggtagaggtatcccttttttgtccacttcctacaccttgcagcctttgaaaagcagttgtgatagatagagagctgatagtcatcttgatccatgagtgtaaggacctcaccaaaggatggcagatctgtgagacagaagggatctggatcttcaacatcatagagcaatgataccaacctcggactacctactggcagattccttctacaagaagatgaatatatttctactttgtttcagttactataattcttttttaatctccctagatattattctaattgatacagtgaaagctacatttgttgctatggataacaatcagggaaaccgtatagaatgagaagaagggagggttcagaacatgtcctagagaaacatcaggatgtaaggggcaggtaaagcaaggagtgtcatcaatatagtaaggaattacatagagaggtaagaataaattcagataagattagtgacttggaagataagataggaccaagtgctaatacggaaagtgttcagttaatggcacatggcctacggataataggactaagatatgtccagtggatttaactacaagaaatcattgttgttattggcaataatggtttctgagcagtggtttggatcaaaagcaaacagcaaaagagaggagagggaaatgtgataatagagaatgtgtgtttaagtaacagtgactaactatgaagaagattcaaatgggaataataacaagaaaggggaagtaagagacatttgttaactttggttgcccagaatctgaatgccctgattatgtcgaacaaaatccccaaatacaaatggaatctgatgggggaagttcagtttttgaatctggaatgagtgacagaattataaggcactatctagaattctttccagtagcaatgacattcttcacccagtgtctgcagtggtagagtggtgcatggcaacgtttacatctagtgtatgggggccagacgtcgtggcacatgcctgtaatcccagcactgtgggaggctaagatgagtggatcgcttgagtccaagagttcgagatccaatctagggtatgatttggactatagttcttggagctgagcctcttttttgagttctgcccattttgagctggttttctatccctttgtttaggaatgggaacaggtctgtatctttctcctaaagtccgtttccgcttctatcaacaaaaactgggttctgttattcacagctatgaactctgacaagtacagtggaatgaatgcatttggaaaggaatgtctgaatatatttatattgtaatctaggagctaaaaacattcacctgatcagggatagtgaggcagcagaaaaagggtaaagatatgcttgtgtttgtgtgcattcaagagacagaataattaaccggggcaagattcctctgaaatgagagataaggctttctgctgaatataaggattgttatacattcaccatcataatggtaaatgataaattgttagattggcagcttacacaaatatagtactttcattttacaaacgatttttaaaaacatttatcatagtagagagagataaaataaaatattttaattcaaattaacctttgtagaaaaaatcacattataataaatttagacttatattaatggtcaaactatgacaacatataattagtaaaacaaaagagaattttaaagggaacatgataatagacttattatacatatctaagacatccattaactatattaaaccaaggtaaggaatcaataaaatgatcaacacatttttctcttaggactttgggttttcttttgtaaacaaaggtaggacactcacctgaggatagtgtattccttttttggagtgttatgatttgtgattctaacataaaaagaactttgtaaataagtgtttctaattataaaatgtgtctcaaaggacaggctttgagggtagacaattcaagtttcttcagcaacaaggaaaataaatgcagaatgccatttggcctgttttttttttttttttttttttttaaaaatggtacagtcttggtgcagctgctgttgggtccaatcaacagatagactttaaatgcaataaccttaaagggagagagaatttacagcaacccaagtaaggagtctgactggggcatgtatttctttgtgtttccttttcatgttatgggctctgtagctacccttgtattgaccatttgcagtatattcaaataaatgctgtattcatactttaaatatacatatgggcatctactctttccctagggtgccccaaataaaaagggctcatttcttatctgcaatctgtaggatgaaatctttgaacttattttcctgtatgttgtggtaggttttccctgatttatccccaatattttgtttgtcaacccttctgatttgtgatagtttacagtggtactctgtggccccataaagatcacccatatcactttggttcatttgtcaccactagtgctcatctgccacgttggcttcctgacacctgaactccttttccacagcagtgcttaatggttaatgtgtactctgggaattctggtttgtttactggttagcaaattaatgacttgagaaaggtaccttattgagaagcagttagttcaatggagattgccaccatctctacattgacagcaaaatggctcagtgtcttcagcccttgtcttcctcctgatgttcagacttacctattcaaatgcgtgttttctgatcaccttattttcaatgttccaagagctccttaagactattatatcccaagttgagctctgtatgtctgatttgctttcctctttccattcagttactctcctttgtatttcctatcctgactaacagccttccatgcagccagttcccccaagcaaaaaacctggaaaagggatcatcctagaattgtcccttcattcccctcatcatcccatctacttaacgactaaattgttccactttcatcaagtatttcttgaatctgtcaggtttttaaagttctattctgcttactcattgtctctaacttgagtcaccctgccactagtttcactctctttttttcactctgagctcaactgtcaaagggacatatgaggatgcaaatctaaagcatataaaaacgtcccaacatccttatattctaccctggaaaaaattctttgagatttcaaatcttccatgacctggtccatcttgacaatttcatttgtcatggcgtcatttttcagccttcctacatataaaaggaagtccccttatcaaacttgattagggtaagtggataggcggtttttggaaaaatattgtaaaattggagggattatataaatgtgtttacacatcttcaaacattttatttttcttagaatatacaagtggtcactcatttacttctcatttggtatggggtccgagacttttcctggagtaaaagcccacaggttgaagttaagcatattactttttgcataaaacacttctacatttcataatctgtgacttttagtttggtttctttgaattacagtcagatttggagatgctgaaaataatctcaatgcaaaatacctccattttttggggattctatccctcatacccaatcttaaacagttgtcttacctacatctaattcaacagcaccgtggttttttttttttttttttttttcctcactctgtcacccaggctggagtgcaatggcatgatcttgtctcactgcaacctccgcctcccgggttcgagcaactctcccacctcagactcccatgtagctgggactacaggcccacgtctggctaagttttgtattttcttagtagcgatgtggtttcgccatgttggccaggctggtctcgaaatcctgacctcaggtgatccacccatctcggcctcccaaagtgctgggattataggtgtgagccaccgcatctggccttttttttttttctaatcacctttatcaagtcttccaaagcattcaatttagtattcatagaaaccacaattctcttatcttttcatttctatttcattagttttcatgatatttaattaaataggacaattttaataataagaataacttgcatagccaggtcaggaaccacagactgttgcctcttggagaacatactctcaaatggtgggagccaaggtacatggtaccagaaaggatacttgaacacctttcaaaaacatcaataggttactaatatccatcaataggtttggagtgggaattgggcagtttatatgtagaaaatgaagagtttagggtaagtcaatggtgcttgcttaacagagcctttttatactgaactgtgtatagtccttcaatgtaggccattttttcttgcttcagtgattttgctcctgtcactttttctctctggcatgtccatttactcttcatttgcctcttctcatcctttaagacccatcccagagatcacgttccctaacaaactctccctaactcctactttcccaggcacataaagttcatggaaggccacaaataaagtacattcacttgtatatctccacacagtggtatcatcattaccagccaatgcaacaacatatttggtgccagctagtctgtttcactagaactagccaagttgaaaaaataaaatatgacataaaacaattaactatgaagctgatttttcatagtcttttgatgaagaattatgaatgcccttgaaagcttttcaagagtcatcagagaacagatgggaagagaccagcttttccattgacacctgtgaataataatatctgtatgattctctctgatcaatctaaaaatagctctttggtgatatggattgcatctaaaacatcttgtggctatatgtaggatgaggctaaaacattcagtttcagggctaattcctgcttaattcacttaaaaggtattagttgagatacagtgagagtaggataaacaaatgtacaaaatgtttgaatcaaagagctgctttttgccataactagctaaataaattgaagttacttgtctcttaaatgtactaaattctgaagaatacctaaaatattattaaccaaactccttccatttttttaagactagaagggatcaaggtcaatttctagaattgcaaacgtatccatggaaatgtgataacatgataaaaacagaaaaattggtctggctctttagatctatttttaatctatataataatgtcaagtgtaaagatttaaatcttcagtttaatctgaatgtgaataaaattcttacgatttaaattaagaaagtacttactggccatctacaatatatcaggctttctggtaagtactgtgggttatagagataacaataagagagtcctctgccctcatgaagcttttaatcttgctgggggaaaagcatatgtaaataggtatgatacatgatatatacatacaatattacatgagtgttataaaaaggggcaagaaaaccttaagagaataaactgcttatgtttgagaagagcaggtcacaattcattgaggtaatagcagttaagatgagtcttaagggatgtgtaagattttgggaaaaaaaataaggggaaagagaattcaaccaaaggaagcggtttttttttttttttgtcttgttttttgttctttgtttttttttttttgcaaaagctgaagaacagaaaacttcaggtcattcaaagcttcagacataaacagaaatagtggaaattatgaaaaacagggttggaaagataggtcagaacagattctatgttcaattcttttgctactacgtgtggccatcaaaggtaaggagaaggttggtaggaagaaattgcaagtgtataccagagaatcctgatggacaaaactgggataaataatgcaaaatctgatctagagtaaggactccggaggcagactgcgggactgcatcctggttcaaatacttgctggctgtgcaatcttgggcaaagagttttatcagtctgtgccttcgttgccctcctgtaaaattaaaaggagaatagcaactatttcatagagttgttataagtattgagctacgtaaaacacttggaacagtgcatggcaatattaagtgttatcaccatcacttccatcaccaccctaaccgtcatcatcatacaaaggtctgcatgaggtactataaaatcaaatatctatggaaaagcaattaatataaatgagcaaagtgggacaggtgctgcaaactgaggacaaagcttgcttaccccaggcaatgcttctcaaactttaatgtgcccatgaatcacttggaaacttggaaatcttattaaaaatgctgactgttatttattagattctgcatttcttagcaactcccaggtgatgtctgtgctctggaccagagaccacactttgagtagcaagaaaatgaaacatctgttactcagttgtaggtgatggtgccaagagaaaatatagtaatgagtgcctagtagccagatctaaattttcaaaagaagacagaaatccatatttttttaaaaaatgaggtctctcaatttttaaaagttgtcaattatttaaaaacagtggctatgcaaaaatactgcatgcattcaggattcagcctgtgggtactcagtttccaaactctgggctggatggagagtcaaggtctaaactggcaatgagaaaaaaaggaagtttgagtacagagcaagcggacgggacagatcctgggggcaaaatgtgaatgtgtgagcaggcttgtagcactggttcacacggatatactgggtacatttaacatattgcacacactgtaaagagccatttgagtcattaaaatattcgcttttaatttgtaggaaataagatgctgaaaagctatttggttgaaagctatttggttgggggtggggtctgaatttgtaagaagccaaagttaaagaaaacttaagagacaacagttgtcttacaaggaagcgcatagagcaatatgaattgctaatggagactttcaagaagaggaccaaccaggcctactttaatgaattagataaggctcatttctaatcaacagcgtgtatttgcatgcaaacaatgagctaaggtctttaaacaataatttcttcctttaagtacatttacgaatgcctcccattatcttatttacaccattaatttgcatggcaaaccagcatagattatatactagtacattttggtttaagaattcagaagtagagaggtttaaaggagtagtaacttaatgaccgtacatgaagtctcacacaagaagggctttttaacatgtctagacttacttttaacttccatgtattctgaaagagatttgtcaagaatcatttccaaggtaatctgaaaatattatctcctttgggactgcttgccagaaaggtgcacacattccattgagaaggggctactacccagatgtacgtttctacgtactattcacctctaaaagtaaccagagttccttgaaaaaaatgggtaattctaaatctgggataggcaaagtccaaggtgagcctgggacaattgagcaggaagctctgggcaagaataataactgtaattcataataatatattgaataaataaaaatttatgagtccattttgacataaatatagaggaaaaaccttttttttttttttttttcaaacagaagaaagccagctggtaaatgttaagatcatgtcagattaggaaaacctccattttgcaagccccagtgtaataactgagttagggaaggatcatcaatggatactaaagccattagatgatttattaattgcgaagaaaaaatgtgacattataatgcaagatctgtcagtcaccacctgaagcaagtaataaaactttgcagcatttagtgagactacttcatatgatgcacctcctgatgtgacgtaatacaaaatacacagcatctcatatgaagtattctcgccaaacatgtttgacatgcatctcttgaagtcttatttagacctaacttccagtttactagaaattcagagactacagaacaagttaaatcatcccatcaggggaaaaaaaataaaacaaatcctgaaagatgagacattttttgaggctagcgtcctggacattttcaaatttcaatatcggtgaaaaaaatgtggaagggctattttagactaagaaggatgaaaaataataataaccaaatgtaatgcatgagccatgataagatattggtactaactcccctgcaaaatataaaagacatttttgaactattaaggaaatatgaatatggaatggatattaacaataatgcagtattatatttaatttggaggagagcataataaacaggcatggttatatatggcatgtctgtatttcaaagcgacacatgctgaattatttaggggtaaaatataatggtatttataacttatttgcaaaaatgttaaaaagtgtgtgtgtgtgtgtgtgtgtgtgtgtgtgatgccctatatatgagagatacagaaagagggtagagaaagcgagagaaaaaaagcatatatggcaaaatgttaacaattgttgactctaagaatttagggggaggaaaacagtgtaaatgggcatatgttttgcaattgtttcaatttttctatatgtttgaaatttttcacaaaaagacttggggaaggaaaaaattcaaaattattttcattaaggtaacacttaaattaaaaccactattccttaatgcatattagtagaataattgccttatctgtgatatgggataagcaatatcagacttgtctaaaagaagaaagaattataatgttttgaaatcttaattattattgctaaggattatgattcagaggttcctcaatttaggaattccacttcccactgccttgcttccgtctcccattcaaacttttatcaactgacattattctaagtaaaatcctcttcattatgttgtcagcaatccattgcttgaaggcctggctccccagaacccctcgactggtatgtcttctcctagaatactccagaagaaaaggagtgtatgaagatagtgactgcacattaaaatgactgaaaccatagtaaattaggatgagattctgggcagataaacagacagctggctaggatcatttttttatgccttggacttctttggcaatctgttgaagcctgacattcctcagaataatgttttaaagcccaacaataagaccctgtagcacatataataagtactgcagttttgaagtagtgataagcataaatgatattttgatatatttattataactgtaatgagatgtgtacatatctgtgacttcataggtactgattgtactactgtgatttttttgcctactttcaaaatgaaaaggaatgcttaatttcagttagaggttagtaaagacaaataggtaattttcttctccagtgaagagcatggcgccccttgctattcatggacgcttgcttaaagacttgtacacaggcttgctttgtatcaacctatgacttccccttacagccgatgataggtttttatttgcacctccttcgtgtacaaagacagttttggtggctacgccatcattaaactcattattatcatgcttaagcctatagatgtatccagttcttctgttacataattgaagctgtagtgaattgtctatcttaaactgcatcgctaactgactacatttcacacttcatttgcttccaacatagactaaccttcttggatgtccactattatttgaacttttgagattttttttcctatttctaatatcttaaaatttcagaagacttaaagttttgcaactacagggctccatatagacatctagcttgaatttatacactttctttcattgatgtccctggactaaaaaatgttaaatatttctaaccgctgtacttaaagtccattacaaacgaagactactgttgttaagttgaataggcatcttatatatttttcaccggtgcaataaataacttctattcccttctaacatctgcttgcgttgcactgagagtacactattgattagcaataggttcgtgattacagcccttctataattaattgttaggttaacatattattcataaaatattattttattaatttttacttgatttgctactggatgcttagaaatagctatgagtatattggtagaaccagtacttatattttattacatttttacatttcataaaatttaagtgatataaaaatcctgaggaagtatgccacaaaagtggtctcagtggaaatttaaatatgttaacatttatttttaaaatgtagcgtgaaatagacaactttaaaagctcagcttaaaaaaaaaactcaaggaagctgaacttgactttttaaagcactgaagtgcaatatttaatgtaggtcaacatgtttaaatgggaaaatttttttcctaattacagccaaatccctagctgtaattaacttaaaatttgtatactatttcacaacagagtcagcatataccactttcttataaaattagaaagatctaaaattttagagcttatttggtgaaacaggcatattgctacatctttgtttataaattataatgtgcctttagagcccaataacagataacaagattttgaaaattcaggtgaattagagttatcagagggaatgttaatacactctattcaaatactatatgagtaagacatttaaaataggaaacaatactttatatattatagaaaaataatcttccagtcgatttaatccactttatgaattctctccgtatatatatatttatagtatggtattcaatttttttaattttctcatttcttaccatcttaatttggattagattgagcctagttcagaaatgacattatacaggtttatacctgttcatagtataagcacatcagttatctaaataataaaatacttgtatgattaagagaagaatttcaatctgggaaaaaagtatatgacttacctaaggaagtagtttaactacaaagtttagttctttattttatctatctataatcaagaagattttcaaaaccaagacttaattattcaaaatatcttttgatgaggctataattctttaactttggcaaggggtgtgtgtgtgtgtgtgtgtgtgtgtgtgtgtgtgtgtgtgtgtgtgtgtgtgtgtgtttaggtcaactaatgtgtttattttgtacaaaatatgaattgtatctactttctgaataatgtaacatgaataaagagggaaagaggaggtgggcaaagacaactgacataattccaaaatcttctttttaatacatcttaacgaaagatattcatcaatgagttgttctagcttcctgaatattaaaatccacctattatgtggatgatgggtgggatgcaagagcttggcaaaagaacgaagttttcattgttcataacaatagtctcatttggtaaataaaggccaagtcttcctttacgaaacaagacacattaacatcaacaactggaagcataatacaaaatcccatttataaactctctaggctttccaactgcagcagcacgcatttggctttctgtgccttcaatacattccaagggaaatttaaatgatgattgaatttgacagtaacctttttgaggttttgttttccccattaaacttgtacctctttggctcaagttccccttcaagaatgtattcacaaatgtggtgaaactagaggtaagtgacactatcactttttttagcttcatagtcatattcatagctatttttaaaactaagcaaagatctgtctttcctacaaaacaatcatttataattgctttctaaaatcttcttgaaaaacaactgagattcagcttgttgaagttaaaatatattgaagatattcacctttaagcaatcatgggtgatttttaaagcaaacttcaagtttaaaatagcagaaaaccactaactagccacaagtatatattttagtatatgaaaaaaagaaataaaaaatttctttactgctgttgattaatggttgataggttctttaatgttagtgcctttcaccctgcttataatctctcatgaaatattcttctaaagaaagcttaaaaagtctgctaaaatgttttcattcctattagatctgtcgccctacctcttttttctgtctgacagctgtttgcagacctcctgccaccgcagattcaggcttcccaatttttcctgtagaatactggcatctgtttttgaggattgctgaattatttcttccccagttgcattcaatgttctgacaacagtttgccgctgcccaatgccatcctggagttcctgtaagataccaaaaaggcaaaacaaaaatgaagccccatgtctttttatttgagaaaagattaaacagtgtgctaccacatgcagttgtactggcaaagaaagaaatacaaaagctccatgtgaaaatttccctatgaaactgacatgcccatatccaaaggatacaagacagaaagacaccttttatgtgtcagggaaaaaagcaccctctcggttagctccagtttttatttttgtaagcttgtcagctagaggatgttataatgtcctacaaatcaattagttggaaaccttttcaagagcaaattcgatttcttgtccccacaaggatgttccatgtttaatagtctatgaaatgttgtaaaatttaaacatgaacaaagtatttgggtttcttagtgatcgtggatacgagaggtgaaaaagaacaaacataggttagtcacagtattaaaaaaaaactctagagatatttaaataaaattaattgctatattagaagaaaattcatttcaaattctgtctgcgtcaatgtattttgcattagaagccacaaaaaactgagaattaattgctttcaggagcatcccatcaagatatccctaagctacagtaataaattttaaaataatctatagtcaccagagcatttttatgattgtcaagcttaaatattgtttacttttttcctgaatgaaattttaagagtaaagtatcagaaaaatagctcaattgaaaaggagaatattacaaccaagtacacacaaaaacaaaaatgctttttaccattaaataaaaatggcaattacgttctatttaactttttaaaaaagataatctagaatttgtaaggccattaaaataacatattaactaaatacgaaccttagaaaatgaaataatatctgagaacttgaggtacctaccgtatttaaatctgaatgactcaaatccttatgtcactgacagaataatgtgcgtatgtagaaaactctcctaatagatgtgattcatattctctaatatttttgtattctcctactccttgacacaatagcaagctgacagtagaccccagtacatgcttcctaaatgaaggaaggaatgcatgttttctgagactgaggtaaagctcccttagactctcgtttcacatacatttcttggcttttttctttttctacattcaagcaaaattattttcgaatactggaaattttggtagcatacagttagcaattaaaatactctgtaaatcagcaaaccggtgacacggtgcctcacaatgaatataaaactatgcacagttactgaactattcacaagctgtcctggccatactctcttgaatgcccatgagatgtgctctagtaaacatgtgatatttccttgtaactagttggctttgctccattgcttacatctcactctttaccacctgttcagatcagcgttgcatgtgacagtcattgcttagtaatagagacaccagtcataacaaactgtgtctatatattaggttggtgcaaaagtaatcacggtttatgccattacttttatatcataaattctttgaggtcagatattgtgtcttattcatgatagtttcctattgtttagtacaatgtctgatgcatggaaggtttcagtaagcatttgctgagtgaacgcatgaatctatgaataagggaagtggggaagaagcggagggaggaagagaggaaggaatggaggaagaaaagaagggaggaaaggagagaggtagaaagaaaggaagggaggaagttcaggctcatcatcaccatggagtcattagtattaatacccattactgatcctcctagagattcaaataaataagcacaattttctaggtcttaggcagtacataatctagttgaaaaaataagacacagttgcaagtgataatttgttatactacatacagtaggataaaaaaaaagcaaggtgatcaacaaatggtaggccagaagagggatgatctcagtgaaaaggatgagcggaggagacttctgggtcaatttggaatttaaagaatcgtagaacttaggcatatggagggttagaggcagtgagagtacggcagaagttaaagcctgtggtgtgcaatctccatgatgtgaccaagagcataaaactgggctctatgccactgtatgagagcaggcgttaggggaggagtacagccctcggtgtatattggggcctgggcagagaacttgaggcaacgtaaattattaaggcaacatgaactattacatgagaatcaccattgttttggaataaactgcatcgtgcaagcatcagtgactactgaaatgggaaaaaaattttgcctaaaacatagatgtcagggaggtatttagagagtaaagaccatggctcttatttgttccttcaagagtgtccaatacttacaactattacttcatacttttaaaaaatgcatgggcacacatcagatgtataccatagcggtgcttcctagactttaatgcgcatacaaatctcctggagatcttactaaactgcaagttctgctgcattaggtccgtggaggcaccaaaattctgcatttcctacaaacttcaaaaaaatgccaatactgctggtccaggaatacctctttgagttgtaaggtaatggagtaaatgccttttgagtctttgttaagcaatcaaggaattcttattgctgcttataatgctataaactaatgctgcagcatttttatctcagcctctttgctttgtagttttgatcttggcacttttgcttcatggctgatggctacggtgacttttacaacctaattgtggaatcagcaatggttttattatttcggtttcccaaataagagatagaattgaacagctaagagtgaagcaataatttaaaattgttagatctaaatctcatttgtatagaatcgcaaatcagggctttcaggtttttttaattttgtgaaagaagagctcattacacagtctactgcatttgtatgagaaggttttgcaaccaggagaaatatttacagtgcatggcctgctcaaggagagttttcagtgataaagcataagaaagaaaaataagggatcaaaacagaaagtagtagcttgtatgtggtgttttctgagctggaaaagataacactgggtttacaaaattaaatgtaaaatctcaatcaactttattcacacagtgaacaacattaattaattttaattctatagcttctaaatattttaagtactgaattattcattaccaataaaatttccaagctttgatatcatattaatgtactgctgtcataggcattcttatctatttctctggcaattaacatctagtcttggttctggacaaaaagaaaatcataattaaatctgttggattattcatcatagttagaaagcttattgtgttttgattccaatattaagcattcattcttaataagaagtgcatatctaactcccgtggggagcttttcaaaatataaaagcccagaattccattctaagtctactgaatcagaatttctggggacaaaggtatatgaaagagatacactaaaaaagaaaggggaggttacaaacatgtgcagagagttgggaagcaggaaggacatgtagaattactatattattttcaacttctcttctgctttttaagtcaaaagctgttcctaaattatagaaaataacactgttacatatctaagtccttcaagtctggtcaaattgggggaaggaaagaggaaacataggcaaagaaagaactgctacatttttatttttatacagggaaggatataagaaaaagaaaccactaccttttctatgaaaacattacgtacatttttttaaaagtctatttgtaaaactttccaaaactgcatgaaaacacaatagatgaaaaatagaatgtgacaaatgaagaaaaggaataagctaagaagcagttataagaaattgtacaatgacagattggatgaattatgtaggaaataaaaaattggcaaaaaatcacaaactagggagcaagataaaaaaacagaagagataaaatgcaactggaagaaaagataaatacagggaaatagagggaagaaaaaggaaacttcattgaacaaggagatgtttcaagaatccaatactgagatttacttgtaattttgttcatgaattattttgagacaggtaaatcattaaccgagtttactgattggtcaagagaaaagatgtaataaaatgaaatttgggagagttgtgaaacagacttttatggtgcaatttcctacaaatatggtgctttatcttgtttttttatcctaaggtcattctcattgtgtctcttcgtcagtgccaagaattcaggagtttgatatacagtttctgatacttttttcaatgataaataaagcaagttaaccagtcatgctaattattagaaaatatagccaatactgttttcagagattttaatgtgcttcagcaagtttctttcaacttctatcggatgatggatttttgtaaagaagcaaaataaatgcacaaatactcaaggcatatgctaagcacagcaccaggacccattcaacttagcctgtccatagactgagggattccgtcttggtggaaggtctgataaccttgtgggagcacctgaggatagtcagaacaattgaaagatggctaaaattggggaaatctagcagttaggaaaatggagagaagggcaaaatagtatagaaaaaaaaaagagtggaaaaatagtatagaaaagcaactaggaaggataagaaaacagtgaaaaatggctgaaataaatggcctttttttgagtaaagaaagaatgaaagttataggaggtaagaatcaaggtcaaggagagctcagaatgagaaggacaagaatccagtccatatatgaagtataagataatatccaaacatgttagtacaacagggagcatggaaaggaccatcctcctcttctccccactgccttctcggctccgtctcctgccgcttctcctcctcactttcaagcttagctccaatgcccagtaaaactgagtaactttctacttccttgacgatactgttaagttgtataggacaaattcgttactcatctttaatagttagcataaaagtaccctctttctagaggacttttaagaggcctaggggaactaagtgcccctcctttgtataggtatttataaaatgtttccatttgtgtcattctcatatgttttggactttacagctgaatattaagcatgaccgaatgagggctttcttctcttgaacagaaaatacatctctaaatttgaacggcactacagattcaacttttaactaaggacctccagatcttttattagtaatttgcaaggaactcagtcaaataaaaaggtcctgtcttgtgctattcacaatagcaaagacatggaatccatctagttgtgaaacaatggtagattggataaagaaaatgtggtacatatacaccatgaaatactacatagtcataaaaagaatgaaatcatgtcctttgcggaagcacggatgcagttggaggccataatcataagcaaattaacgcaggaacaggaaaaacaaacactatatgttctcacttataagtgggagctaaacatagagcatatatggacgtaaatatgcgaacaacagataccgcggactagtagatgtgggaaggagggagggtgcgcattggttgaaaaactactcatcaggtaggtactatgctcactgtttgggtgatgagatctgtaccccaaacctcagcatcatgcgctattcccctgtgacaagcctgtacatgtaccctctgtatataaaataaaatttgattattttaaaaaggagcagtctttacaatgaacgatcagaaataaaatgcacctttttagcctcttctttctcctgttatctttttttttttcaatttcagtaaacatttattgtaccttactaatacaaatgctgaaaccatacaaatgtgtgtgttcatttgttacaggaactagagtcaggagcaggccttgttagatttcatttaatactctctttttcctgtgaggtataatagtagatatgctcttggtacaatttcccatctgctcctgataatggttgctataaaagaataatgagaattccttctaaaactagaaatagactgtttattttccaaagcaaacatcctgccaatgaactgaaggaaaattatgtacagtagcaatttattttaatgggacatttacctaatatcaaattgtaatgaaatttccttttgatgtatttatcttattcatatcaattatatatatatatatagatttgttattatcactgctattaatgtgtataccaaaattaattcatcataaagagctttaagtactacatgttttgtaagggtatcttgggttgtttttctttctcttccaagaaatgctgccctgggccaaaaagaaaaaatcacgtgctcctcaatttcaagcagagattcaatacagtgttacctaaagtgaggaaaatataaatatgttaagtttttgccctctgaaactgagggctacattttaaatctggtcccagacatgttttggcgttagaactttgtttgattaatgatttgaatgcctttaggtggggcatgaaagcattcaatcattctgtaaaggcatttgaattggtggctcttgttttaaagaaaactgttgttacaaagtacagaacagaactttgcaaagcgaataggttttagtttgctaaaataaatgttagctctctctacgttcaaggatttatttaatccttctcgccttctaactcattcatgagaacttcaggacaaatagaaaacatttaagggctgtgtttttctctccatttacttagatttgcaaagaaaacaaattggcctttccctgataaaaaggcatcttgtccacagctgtacttgttttcttattaagtgatcctggttatagaacatgtgacttcaggcataaaattctttctacatgattactagcatgcctctgaacacattaaatgtttcatcgtggaacatattgcacgtaactcaaaaaacactgtctcaggacgtgatattcgaaaggaagcataggtcattttaaaatttctaatttctcttctctctagaggtattatcaatttggagccacataaatacttcttcaaaagccatttggcgggtagagggtgatacaatatgtatgtgtgcatatagaaaaagccaacaaaattgtttttcaaaaataagacaatgtgcaagtcaacttgattatacactgtaaatatttgatggaagtatctaatgtcattggttctaaaaccctgtagttctctactggtatttgccatgcctatattttcactctgtaagtcaattattgattggatacctcctattagccagacactgtggaaggtgctagtcatcattctctgctggaggatgaatggattggaggagcccgggaatagaagtaaggagaccaagcaggagatatcatggtagttaaagtgaggaaagatggtcgcttggattgaggaggagtcagtggcagaaatggagagaagtgcatggaaccaagtggcatttggaaagtaaatacacaggacttaatgcattggagacagaaatgaaggagagagtatcaatcagacagttgaagatactggtctggaactcagaggaaatattaggactgaaaatataactgagagcattattggcagagctatgtctaaaatttatgatgtgagttttgctccaaatgtgtttgagtcccttatttttattgaaacgattctgggcaaactcaaagctagcaatcataatccaaacatattttgggaatccctgagtatctgcatgatgactaattttgtcattattgacatttgctacatctaatatgtattattttcatttgctggcagagagattaatatcataattagcataatgtagaaaattgagaggccgtatgattccccacaaatttgaagaaaatagaatatcgttttgatgaagctgcttgtgttttcctaccctaactcccacccacctattagttaaaaaaaatggtcaaaggtgatttcaaaatatgttttgagaaagtgttgtgctttaagagaacagaattaagcttgttccttaatacacttctattctgtgttcacaagaattccatgggcctttgctgtggcatagtctttaaatgctgtctaatgtaggtaaattgttcaatgcagtaagtgttctctttagtgtgactgactccaacaaatatttaatttagggtaactactaggtgtctcaagttttacaatgataaataagcttgtattttcttgtcaacactctcaacttaatggggacaccctagaaaatgctgtgttacaatataactatggcgattgctttgagaacaagatagatcaatgaatttggcgaaatggtaaggaaaagaaacagacaagttgaggtaattactattataaaggccttaaagacagtcttttccccatttcctatatcaccaagtacagcgctgagcactgctcagcttaataattgcttaagaaatatttgttgataaattgagcagaaaactaagcaagatattataatcttcttgattgctttctcattctggaaagggtcaaaagtaactttttgaaatacatacaacagcctagagtgaaaaagagacatttaaaaataattgtgtttttatcaaagtttcatctcctaccacaaataacaagttattaaggaaagctgtcgtttctcaggctcttgagaatgggaaggcctagaaatacgataaagagggatcaaagcagatctctgtgtctaacatcaattaattgattttgagcatttagcttagattacagaacccccaagacatcaactaacaatccacatctaagcacatgttgggcatcactaagccttatatgtccctcttgccaagttatacaggcattaaacacaaattactcttttatttttccccaagccttaagttctgaggttaggtttcttgttttccaactcattatctgttgtatggtaatactactctccttcatggaattagatgagaagaggtgatgataaaaacaattgtgcctctcttgttgactgggcacgccctctgcaaatcaaaaaaaaaaaaaaaaaagaatgcacaagcatggattcactccccattatcagtacattgtacaatatcaatgatctgtattttattgaacaatatataagccagaggaacctaaggataaagcagacaaatgacataagcaagtcatctgttagatttttctcaattattcatgtgaatatctaaaaggttagggatatttgtaaaagagtggtgaaaactataggttttactttcttatcaatttagcttgtatgaaggaaaagattaaattatcaaatgtaaatcttttctaatttttttctctctaggaacgcttccttcttaggctaccacgtagcatttcaggaccttttcatttgactgaaacctcaaaggaaatattttcaagccaacatccacttcactcctaaaactggtttcttatattcattacattatttatttgaatgacatctgtattttccagtatggataccagcagttcaactttgttttgtccctttttttttcattcctccaatccaaattctattttactgatcctaattgttatacttcttgcccggttgattccatcgttattgcttttcctccagcctggttattcattacacttcacctatgttattaatacaccctcctaactgtttcatctcagactctttcactgcataacattctacacaatctttccagattaatcctccagatgcatagttcttctggtggattccctgctcaaaaatttatactgaatactcagtgcctgcctgttgaagcccaaatagcgtacataacattcagaacctcatagcatccctgagagatacctttttaggcttcttacaatgactttccaattcttcatccatgcttcagtgcaattagacaactcacagtgacgtcctggtcattctccagacctttgactattctccatcctccatcatgtgtgtctttacctctacttatgtaatcctttcattccagttgactagaccatgagatccatgagagcaggaactgtaatcttttctcactctagtgcctagtaacgtgttgctacctggcagtgctcaaaacatgtttgttaaatggataaaggtgtgccccaaatactaactctattgtgaatacattttcaagcaaaagttatctatcctataaattgggaatacattttcaagcaaaagttatctatcctataaaatcatactgtacttgaactgtatctacataatggtttttcacagtctataaaaattaaattttgttattattagagacaaggactcattctgtcatgcaagtttgagtgcagtggtacaatcatagctcactgtagtctccaacccctgagctctggtgatcctccacctcagcctcttgagtagctgagaccaccggtgcataccaccacacccagataatttttaaaatttttttgtggagacagggtctcacttttttgctgaggctggtcttgaactcctggcctcaaacaatcctcccaccttagccttccaaagtgctaggatcataggcatgagccaccatgcccagcctaaatttcattattttgattgaaaatttatgattgtctttatttcagggacattgtcttctttacctttgaggtctccactatgctcatcagttaatttgttctttttactaaatggctaaatgagtgactgagtttcttttactggtatgtggtgaaactgcagaatttttatgcacgttgaaagaatctctaagagcatagcacatttggtaaaaagcatgattaaattctatttctgtacttttaaatacctactaggggtctagcaaaaaaaaaaaatagtgctgatgctgaagctggtcaaagacaattcaaatgttctgcacttcatattagtggtggggttgccaaggaacagagcttttacaaagctaatgccctgctgctcaggcagcaacactgcattctagtagactcttcagataaagtaaaaagaaaagaaacaaaacaggaaaatgtctgtcattcccagtcttcaagttatatgaatgacctcaaaatgatactattttcacccaataatcataaaggtaataatcttcaacacacataatctatatgaatgtccaataaatccatgaaaagatgcttaatagtgctagtaatcagaggaatataagttaaaaccacaacaatatacctacatattctgtaagatagcaaaaattaaaatgactgacaagaccaaatattgacaaagatgtagagtaactggaactctccatcatcactggtggcattgcaaaatggcacaaccactttagaaaactgtttaggtgctgtttgacaatatctcataaatttaaacatttcacccagccattccacttctacagagttactcaaactaaatgaaaacatatgctcacaaatggcttgtacacaaatgtccacagcatcttattcataacagccaaaaactgaaaaccacctgaatgtccatcaaaaggagaatagataaataaattgtggtatatctatacaatagaatattaatcatcaataaaggaatgaacagctgatacacttacatggatgaatctcaaaagtagtatgctgatcaaaatagtacattttgtatgatttcatttatacaaatttttaaaaagacaaaactaatctatggtgatataaatcagaagaataggtgcctattggggctgggaattgactggaaggtagcatgaaaaagctttctgaggtaatggaaatttttattttattgaggtgtcactttatcagtgggaccacttcacaaaagttaacagattgagcatttaatatctttactaacttatacacctgccacagtataagttactgtcacacccagtaagaaagcgtggaaaatatattagatggcagaatctgaatattatacaaagtatcttgacagattgaagttctcaactaaatatgacaggttgaaatgttatgtaagaacaaactcttcctcctctcccaaataagtctgtttcatcttatataaaattttacctcaattaagaaataaaaacaatatcatttttaactgctctccttacttacacaataccttagccatgctaacaatcagggcatccagcaaatctaagtactttctctctcttacttcacacagtacatatggacccttcttatgcaagaaaacaactaactgaaataggctgattgccaaacctcagtcatttgcagacagaatttaaaagagttcagaagactaatcaggttatacaggaacagacttcgtgaaccatcagggatattatacaattcacccttttatccccacacacaatgatcaatttagacaatctataagacgagtcaagtggcatctgtctttcaggaacacacgtgtgtatgtgggggtgtatgtttattagattaagaaggaaaaagcgtagagattcaacgatcttgaatttcaagagaaaatggctcaagaaagcctgtaaaagctctttagaataaaattttgacaatataatggcaaatcatcccagtgagtataaaacaaagatgtgtgccactgtatggacaacctcaaaggtgctcagattctaatagagtatgaacatgggaagaaacgagggacagagaactgagggcaaatattagaagaacaatatagaactgtataaacagtgaggaaaagctgagcttggaatgaattgaggctcgtgataatggtaaagacaacattcagggcctttttacttccatttggaggaagaagaaccagaaagacgaaggttcactgattggggcagaagggagaaggttagggatagagacgacacagaaagcagcagtgtgcagctccttttgcttgtctgctctgtcaaggagaatgttcatcagactggaaaaggcataaccgtataagggaaatgaagcccaaaataggtgagggaattttaaaagagcaccttgctgctctaaatgagctaaaatctctggccctggaccaattatattctagggaaatgagagaacttgcgcaatacagtcctaccccactgtcagtggtctttgaggaactatgttaacactgcagatgggcaaatgtcatctcgatttttaaagacaggaagaggtcactgcgactgtgttccatcaattcctgctaaagagcatttctgaatgatggaacaaggagcaaacaaacacttgttaacaaagacaacgtggaggcagctaatttgggtttgtatgacaactcgttcttacaccagacatgtgtgcctgtgtttgcagttgaatctcttttgcagtatgaaaattgaatttcacatttctaaacaacttaaaaaccacttctttttttttccagctaatgaaagttaaattttcttaaaatgaaataaccatataaataatgaattgtgttctgttgtacaaggagcagcatgacatccagttgcccaccacctgaaaaagtttgaggtcctctggcaaataatggacagagacaatgatcttatacgtgcaccattttgtgttatttgacatggtgacaatgggtctcctttctacaagaacagaacaagaggaaataagattgcagagtagttggggaacctacacaggagggagtcttccgaaaagagatttagactgtatcaatatccagaaaaatgtcgaaggtgatttttggaaaatggcatcattgtttacatttattcttttggttttcttctatcacttttagtggatttttataatgaagagacatacgtttatgatcagaaaaaaataaccctctacccatttgggaaataaattgatataatcttaccaaaacaaggtatttttttctggatttttttattcaagagtgagagaatagataaaatagtctttcccagtactgtatattaattatttaaatatgatattttaaaataaagttatcatactttatctactatggtatcagcacctgtagacataatttactaccatatttgcattagtacatattactaaagtttttcagagatatggccatatatagtgggtaaaagataccaaaaatcataaataacattttattctttctcaagtaacattattcagctcctctaatataatttcagagcttttgttaatggtatttttctacatactagttttgaataaattcatgtctaccatgaactatctagggagaaatgttgttaaaaatgctgttacaagttccataaacttagtttacttgatatcttataaacatgctgccttttgcaaaatacagattactactgaaatcaggaaagcttagaattattaagacagacgtattgtagggaaataagggaaaattgctctaattttgttctgacattcagaatataaagataataggtattatcatgatgtcaacatgctccatcaaaactcccattcaataccattctttttccatatatacttactttttttttcctcatccttggccttaatacaaaactcaatatttcatttatagtttgaaattttgttacatactaccctaatcctatgtggattgaagaagggtataaatcaataaaacttaaaactgaattttctcctttaagcagtttagatattttaattagtaaacacaaacaaataaggttagctatgtattgcacatttaaagaaatatcacactgtcaatgtgaaaagaaatttgtaaggaaaaaaaagaacaaagatcagtctgggacatctgcaatacattccagattcaggaacaacaagttaagtatctacctactcatcttttctggcatgatcttctgttaaaacaaggaaaggcagttaccatacagaaatgttgattttgtcagacagataaagacatcactaatactatgccaaagaataattgcaattatcttattgtgataatttattgctttcatatacttcataaagtgctatcagatgattgttccatttgagatccacgtgaagtatgaggtcagaaaaatgtgttattattcctagggtaaagacgaggaattgggggtctaaatatttgtccaagttgtcctgcagataaaggtcccaggaccaggccccagattgttatcacatttcagtgagattcccattattcggtactggctcttttctgactcaaatacttagatattaaagagatatatgcgagacatgaaaagtagaaagtacaaaaaaatcggcaagttgtacacttttaaattattgtgaaaataattaaccaaatacttcataattatagatgtttttggtagaaaaaagatgattcgatactcactttcctattaaacatctattttgtctttcactttgataatgctgttatcttcagttaaatataatcattatgtgaataaacaatgtggatcaaaaaagaatgagaaatatcaacccagaatatgtttgaagctgatttaaagaggacaacagcatccctagattagattacatgtttttgtaaagctgctatattagaatgtcatgctgacatgattcttgataatgtatttaatgggtaaagtatgcatagtgaacatttgtgtagagttcatcacatctaattttctgttttcttttgatacacgaaggtgaatgatgcaattgtggtatttctgctgttgaacttaatgaaaattctgtccactatcaatcaaatagatcttttctcttgtttgttgtccaaacaaatatgttcaaaagtaattcatttttattgaaaagtcttgtactcacatgatgaaaaaaacacaaacaaggctttaatttatttcacatgcacttgcttgcaagctatacactggagaagaggggaagtttagttttatatttatgtaattcaagttatgtagatagaccaggtgttatataaatggacagatttttaaactagtatgtttcaataaataatatgagccaatcttcagaaatgaatataaacatgtggcatccttctctataaaaacacaaggttgaatggggctcatctgaagtgttgctgcaacagtgtgatgtctgtcctggccgagagtatgtgggatgatttatctcaatatgtttttgcagtaacaggtcatactgaaacaatgatgggacaacaaatcacaatgtatgccatacaaagaaatgatatgggaagaataatttcattcccaagtatttaaaattgatactctattttgaagatcaccatagaattagaaacaatgtaaaagaatagacctggtaataataactataatttctttcaaaaagagaattcataaacatagaaaccaaggactcagagaagaaccacttataaacattagaatattaccttctgccattcctaatttagcatataaaggtaactttttaaaatctctgcttttcataactgagagccagaaacaaaacgtctgcatgatgattaggtgttctttgtatatagcaacagtatccccttgccaattttaacaatattaagaaacatatgccccactctccagaataaatagctgtgtagaagaaaatgctttgaaacattcattgtcttcttaaaatatgaaaatcaacatttaggaaaatatttatgtcgcttctacataatagcctttgggtaagtacagattaacttgacagaggtctttcacgcttaaacatcgacatttaaattttgattgacaaccaacagtaacgagtaacgctttcattttagatatttaaatatacagaagtaccatttgcctgcaagactgagcaaatgaattaatttgttcagtaaatatttattgagcgcattgcatcctgcatcagacagttcctgaccttaggcatttcattgcaggtatagacaaacaataaacaaacaaagatgtacatacacggaataaacacatattgtggtaatagggacaaaagaaaatcacgggatgctttcacagagaataatggagaataatgataacggagactaataatgctcaatagttgaggatttgcaagattatggtgtaactttagataaagtgacctggaaaggctttggagatgaagttactgaaacgggagatgcacaaagaagaacagaattaactacttatccagatggagaaaacagcatgtatgacgctcccgagtcaggaaggaactttatatgcctggatataaagaagctgaaagaaaacgagaatggttggagccccttgaatgaaggggagtgtggaatgaaatcaacttcaacatacagattcatgtacaaggatgttcactgcagtgaccaaaatgtggaagcagtcccaatgcccaataatgggagaataattaattatttacaatcacatctgggagtttactatattgtattgcattttaaaatgacatataaaatttaaaataattctaattattaaacatcaataaaatattaaataaaagatgataaaattttttttgtacaatactacttgctaatgggacagaactcaagaaaacatcaaaaggtgtaaaacccattaagaaggcaacctatgggagaaagactataggtgcttttttgtttgtttgttttgttttttttctgagacagagtctcgctctgtcaccaggctggaatacagtggtgtgatcccggctcactgcaacctctgcctcccgggttcaagcgattctcctgcctcagcctcccgagtagctgggactacaggcacacaccaccatgctcagctaatttttgtatttttagtagagacgggattcaccatgttggccaggatggtgtcgatctcttgacctcgtgatccacccaccttggcctcccgaagtgctgggattacaggcgtgagccactgtgcccagctgtcttaatttaatacttttgtgtattttcaaacttttctacactgagctttaaaaagtataagcaaaaatgaaaaacaaagtgaaaccgccatattgcctttgtcctgaaatattaaaaaacgaactaaaatgggcacagaacaaaaactataatattcctatatgcatgttcacattgagaaaaatagtgagacaaaatgtctgaatcctggtaactatgatagaaatggagtgtgcctatatgcacgtgtgtgaagggaaaggtattctctctcgattatctatatttatctatttatcatttatctgtcatctattagttatctatcagttatctatctatcatctatctgtttaccatctagctgtaggtcataaatagaagacattttaattaatatttgctattgacctattctcaaaaatcactactgaattgtttacaaaactcagcatgctttgccaaataattaagacctttatttgtattcatgagtcttaattgccaaacaattaagacctttacttgatcaaatcaagaaaattagcatatcacctcaaacatttaccatttatttggggtagaaaccttcaaaaccctctcttctagccgttttgagatacgcaataccttactgttgacaatagtctccatactatgcaacaggacaccagaactaattcttcctttctaatcgtgactttgtacccattgacaatcctctccccattctcgcttttcccctacttcccccattctttggtgaccaccgtccatttactgcttctatgagatcgatgtttttagattgtgcatatgaatgagaacaagctgcatttgtctttctgtgtttggcttagttaatacaacatatgaaaaaatgttcaacatcactatcaggaaaatgcaaatcaaaaccacaatgagatatcatctcattccagttagaatggctattatcaaaatacaaaagataaaaagtgttggcaagaatatggagaaaagggaacccttatgcactgttggtgggaatgtaaatgagtacatccattatggaggacggtatggaggttcctcgaaaacttaaaaatagaactaccatacgatacagcaattccactactggggacagagacaaagcaaataaaatcagtatgtcatagagatatctgcattcccatgtttattgcagcattattcacaatagccaagatatagaatcaacttaagtgtttaataatggatgaataaagaaaatattgcatatatatgcaatgggatattattgagtcatataaaagaataaaatcctgtcatttatgacaacatggatgaacctgaggatactatgttaagtgtctgaagttttgactcctgaaatgttataatgtcctcggtttaggatattagcttgagtagaatggcaacaaggtttgcacaaatatttaaaaagtgactcacaagaaaaagtgctatttaagccgggcatggtggctcatgcctgtaatcccagcactttgggaggccaaggtgggtggatcatgaggtcaggagatcgagaacaacctggctaacacggtgaaactccgtctctactaaaaaaatacaaaaaattacccggacgtggtggcggccgcctgtagtcccagctacttgggaggctgaggcaggagaatggcgtgaacccgggcagtggagcttgcagtgagccgagatcatgccactgcactccagcctgggcaacagagtgagactccatctcaaaaaaaaaaaaaaaaaaaaaaaaaaaggaaaagaaaaagtgctatttaaaaatagcaacactaagaataatacaatattaaattttcatagtattttaaagcctccatagcatattaatttattcaaataactttcaggacaccagaactaattcttcctttttaattgtgactttcatacattaactccatgaaaaattgaggtcaccttttataccaattttataactttgaagagtaaccagtgatatttagagaaattatattagggcactctcacactcacgttcttgtgctctcatttctctctctgtctctctctctctctctctcgaaaccagagagggagagacttattgtaataaattggctcattacgaatctggagaagtcccaagatttacagtcagcaagctggagacccaggaaagccaatgatgtagttcctgtctgagtccaaaggcatgagaaccaagaaagccaatgacgttaagttccagccccagaactggaggcttaagactcaagaagacccaaggtttcaattcaagctcaaaggcaggaaaagatgggtgttccagctttagctatcaggcaggagttccttttaatcaggctttttgattaggtcttcaatcgattggacttaggtcctcaattgattggatcagacccacccacacaagggagaacaatcggctttgctccctctactgattcaaatgtgaatctctccagaaacagcctcataaacacacccagaataatgtttgaccaaatgtctcggtaccctgcggcccagccaagttgacacatgaaattaaccatcacagaaattaagtaatttgttgaagttaaattgatagacttgagatttttaataacaatcggttccaaattctagcctgatgtgttttttccttttattatattaaatttattgcaaaatgttcttaaagcaaatttggaaaaggctagatttcttcaggtcagaaattctgccgtattcaatgcatgaagaaagctcaaatgaatctatttgacagacctggagcagttattttgtctgatgctaaggttttgatttacaagcgcaagaaaaaattgtctttgtgctttctgattgtggcagccaagttgagtggggaaaaacaggagaaaaacatgctaatacggggaaaaaaacataaagagaggatttttgcaactcagaaatgaacttatatacaatgaagagcctattttattcctaaaataataatctaaaattttattttaaaaatgagaaagcttgagaggtatttattagattatatactgatttcctttttttaatctctatttttaatgtagactcaggggtacatgtgttggtttgttacaagggtatactgcgtgatgctgaggtttgggcttctgttgattccatcacccagatagtgaacatagtacccaacaggaagttttgcagcacttgctcccctccctcccctcctcctttcggagtgcctaattcgtgttggaaatttgctttaatcttaggggaacattcatagaaaaaactgtacaaagggtttctttacgcattctcaatgatgaaaatcatgttgacattgttctgtcattagaagacatgtacaaaaatagtttttgataaactagcgcttaatgtcttcataacgtaagtggaagcgatgaaaatatactgcaagaaactatttttcaaagtcttcgacatttttactttttttcaactaaacacttcagtccttttgggtgagctctttatattatttaaaaggttcttttcctagatagtttatgtaaatgccttttcctggagtaacctttaaggcattatttggaaataacatagtttctcctaaagtatgtctgtttttatccacaacagtagagtagtaggaaagtgtgtgctaagaaagtacaatattctctttgtcactgtacattattgtagttaccatatgagctaagagactatgctagtgttaaggttgcctttatagtatgattatacctgttattttccttgctctaagtttgttggcatttcacaagaaataatacgtacaaccacaaagttaacttgagctgtgattatgagaaaatggtacaataagttaagcaacacatttaaaacaaatagttcaattactcaatttcatgcggtacagttttaacattgctagtacatcctcagattaaatatacgaaaacattaataactcacgtaagcaaggtgtaaggcagttacacatcctaccacgtgtaaagtatgctactaaatctgaattaaaataaatataagattaaactattactttctagtaggttaacactccgtgaggaaacaagatgtaagcatataaaaagtcaaataaagttttaattaatgttcaagacaatagaagacatgtcatatttcaatacctgatgaatttccaaattgattatacagacaaaatattgtagttcagagagagatcttcaaagatgacaaacaaaaggtctacaaaagaataatttatgagttttcctgaaaaccaatacaggttttgagagttgataagacatggttgatgagatgtataagaaataaaaagtgcaagaacacagggggatttatgacgcataatattgagattatattaaaacaggcattgaatatcaggaagggtgattttataccagatcttgtaaatagaggggatctactacaggttttaaggagacaaacgatatgataaatgttatttttatggctgatcacagtattataaatggattggaatggataatgtgattacaaatggaaaggaaagcaggcagaaagaccagaccagtggcaattacaacgtaaggtactatgacttttatctaagaacttggaaaaaaaagaggtactgagaaggaaaagtgtagcctgcaaaggaggagcaaaagtgggtttgaaccttaataggttggaaggaacaggaagtcaattgtggggatgactttggaggggagagcagggatgaatttgcaaagtcatatggaaactgcggtcatacggagatatccacatgtcatgtccaggtagtagggctagaaatacaggttggaacagagataaaaaacaggatagccaaagccagaagatgagatgtaaacaaaggtgaggtcagagtgagaaagagaaaacaataagcctcaactgatgattttgacacatgagaggaataaaaaactaggaatattacagaagctaaagggttacagactttaaaaaaaaaaaaaaaggaaggggaatatcgcagtggtattgaacaagataaaatggcagagaagccaatggatttggcaaatacattattgttgattttgaaagtttattctacagctatttaaggaatgcccattatgttccaagcactgttccatgttctaaagatacggcagtgagctctcatggaatttatgaaggcaacataaaataaacaactaagaaaaccgatgcatgatacaaggtgataaagaatatgaagagacttaaaacgcagtgtaaggaagtggagagtgagaacagcaggggattactatattactgtggtcactgtaatgggagctaatagacactcctgagggaagttagagggtaagacgtgtggatagctgaagaaagaaggttgaatttcagcaggaggaatcaaaaccaaatctatagagagaggatagtgaaggatttatgttggaatgacttacggttttgtgtagctagtttttcttaaagaataaactggcttatcctcttgataaggaattagtggtgaaagaagctttgaagacatttaatgttaggaagcaagaaatcagagttgtgaagagatatgttaaaattagggcattgcctccatgagcaggccattaaaactatctggaaatgttgaaaggactatgaaagcactagatgatgatgctacgtttctgaagttatccctcatcattggctccaaatatgcattgcacttaaaattttattttataatattttaaagtatatacacaaacaatttaaaatagctgcaaaaatatgatcacgtatggtccctcgtttttcttggctcactcctctcctcctccacccacaacaaaccttcctccactaaaataacctaattatttatttctgtaattttgcacttgatatttttttcaatttatatagtcatatatacttttgtagagcagagggtgagaagagatggatataaatgaaaatgaaactagaaataaattaaaattctttaccaaggtaaaaataaatcttattggtcttatgataatgcattgtcctctgtgatcaccaaaaatctacaatacaaagccagccaatctcttgggagagtgtagaaagtttagggaaatgtaattatattttatttgcagaaggaatcaatatggcggtacttttcaagttcaattcaatcacaaatgtaaagaacagatttgcatttacatctaagcagaagcgtggtggattaaaaagatttcaataacatttagtcatctctttgtcaaaatagggcattcattgaacataatgacactcaaggccatccttccaataaattaccctataaaacttccattcaaaatttaatatggtacaggttggggaatataggtaattaaatgtgtcgtagaggtagaaagaagaccctgggtaaaggaaaagatggtaattaagatttgaaagaataatactgaaataaataggttattctaggaaaatcttatcagtatgctaatcactttaggtcccttatcataggaaagaatcttaaacaggtgcttgggacaatggtggtcaaccccttagcggtttcaaatgctaggagtctcatgacacacaggctctaaaccttgattacctttctacaagaacattgttgcttgttgatctccaatctttttaatacgctaatgtcagatggaaacaaattcgactcctggatggcaagcaagctgcactgggattgggtaaggctagaagccatcatctgcaacacagagataagcgaggctgaattctctgtggccttttgagactgtattatgtgaaatgaagaatttacaagcagaaacagtagctaaaaatctcattattaatgacttttgagcagccacggtttctggtttttcatgtgaatctgtaagagacttaacaaagacaaaaatgtgggcacaaaaaatgtagcaaataaacagaatctgggactaaaatagaaaaatgtaactgtgtctcaaaagtgtttacatactggctgaaagagtgaactgtacagggtttgtttaaacaaaagttatgtaaatctttgctcagctggttgctcaggaaagtaaatggaagcaaacagaggaaaacagaccacgggctggaagagtttgtcaagaatgataacgggcattgaagcatcaggatttaaaatgatagcccagcctctgtaaataatgcaagctcttcaggatgcactagagacccaactcgacagcatgataattttagctaaaaacctgctattccctccacaagactccataaactaaagaagaaagctgagggattgtatacacccaaaacgccaactgttagaagcgtgggaaacctggcacctttaaatctctgattttatcccttagttgcccatgacattgcctgggagattttgcagcacttaaactgggataagttagacaattaaagcatctcagtttttgtctaaccatgctaaaaataagagtgacaggtctgaagcaaacattttgtgcctttgtatgcaaacaaaattcagttgacaaaacacaaagtacaatgactacgaatgagctaaagatacaaaattaagttaggcaaaattcccatgaacgctgtcccttccccgctaaatattttacttccgccactgaaaccctctaacaccaatgaaataaacataagttggtaggacaggtgagaaaaatcttcttaaggagctcaaactaataaccctacgtatcatctggaaaacagtctggcaagaggccttcttttcgcattaaccttctgtgggctccgcacctgacaaagcatggggctgctccccgagaaatgggactcccagtgacacagactaactggagaaaaattggcctgaagttatacatcagtcatttgcagaacaagacttgaggatcatcagcctttggaaatggttttattccaagttatacaggagtaggcacctgctttatatctgcccttagcactccggattaatcgcacatatatagggaaatgaatttctccctgttgatctcttcattgcaatcttgtgcccacaaaatctcaatggaactgcgctaacaggtttaaaagaccaagtcaggaaattcacttgtcacttggttctcaaagtgaacgcgaaagaaactgaagaattcaaaggggtcatggatatttcttcaaagctccaaatagttgtttggtagagatgacgaattttgagccatctgggcaatacgagaaggctcccctgattatccttccttacgtgcttatcaactcacttgcggccctagggagaggatggcatttccgaagttccaaattctctctgtgtgtatctgtgtgcttgagcgcataagttattacatttgtatttacttacttaaatatttattcatttactgaaaaagggcaagaggtagtaaagtaagtccacagagtgaaaaatgagtaggcaaatttgaaagtcaccagtgattactctattggttgaaaagatgcattatcataatgaatgcattagagataacaaacatatgtacaagtgtcaataggtttgtaggattatggctgattttattcgtcttccgtgcaacttcctatatttttcaaattctataatgagcacttattacctttataataagaaaaaagaaaatgcaaaccaaaattgaaaagttttacattttgtggataatttatggcacatctttggaaattttatgttagaggctttcactggctaatcagaaattgctttatctatttttctttgttgaatggaaagggaggagggagggagaggggaataagcaagggagaaataatagggcaaataactggttccactcaagagcaaattaactttccctcatgggtagtcagtacatgttaattgatgataattaagaaaaatgagttttcttttttgtgagcaccaccacacaattccatattttcatattagctaaaggttaaagtcaaactgatccagtacaactttgcagttggatgttaactacttttcatagaaggggccacattcatggtgaatctcaagacctcgtttatttgttaaatgcatctttgcaactattttctatttctccctataccattaatgacacccacaatagtacacaggacatttgatcactatttcttgcatgtctgcatttcctttgctgagaaatagagaaatacataaagaacaaaaaagggctctaagtcccattcaaaaatctacaaacgtgactgctgaacgccttaacaaaagcacccatgaatcggccatggctttatagctgcgaagggacaacacataggcatggagagaaattggaaaaaaagaaaataacgtgaattagaattctgccaatagtattagtgctaatgtaatcaacatgacataagtatgaatctttgaaataccaaaacttcgagtaggtaaagtggttctcaacaatatctttcttctcagggtaatcatagtgaatatgaggatacatcgacagggaaaagaacagtaggtaatttgagggaattttgcagcactaatttagtctccaaacactgattattcagtggtcattattccaaactgcgagggacagtaatgaatccaaacactattcgaaaggcaaactattacagagaatgttacacccttcctaagttgtgagtggcacagatttatgtaatggcaactgggaacaaaaacagccaaggtcagtggaaacctaattgtagtactttatctagttgaataaaaatccacatttttttagcactgaattttcagtaattgaaaacaaaaaaagtggggcttcaattttatatcagctatgataaaagacagtaactcaaaggcttgataccttaaacttcagggttgtttcctgttcattgtaatatcctcagccttacgtagcgttgcaggcatataaccggtccaaaacaataaaaaccatgttgaattaattagtgagtgagtgaacaatgaatgtagaagtagataataagccaggataataagtgatgaactgtgtcagaaccaagatcaacaacaagaaaccaccaacctaactacaccaatgcaatgatgtcatctatgggaagggaagaggaaagggcagtatgctttcatgaatattaatcatttataacgtgtaaactgtatatcttccattccacaatgtgggttcagctcttttcaattaagctttttctttttgcccatataatgatccaatcagaagaaccttagtcaagtgctgctgcaaagaggtgcctgaactgggtgaaccctaaagaaaattctgctgcctgcattggcaagaatccacaagccactctgtatactgcatcttatgtgaatcttctatcatttgtatattcaatcttgaataaatcaatttgccctcttgggtcttatgatcttcgtctataaaatcaggataggtgattgctaggttctgcataatatgaggtttaccttaaggcaacctaggtggcacactagaatcactagggaagctttaaaaaaattcctattctcaggtctcgcaccagaaaaatcaaatcagaatttctgcaggtgggaactaggcatctctatttttttttgttttttgtttttttagagcttccagagtaattccaacttgtagctaagattgaaaactaactctttaaacactaattgttgtcacctgagtaaattaaggatactttcagagccataaaataatttactttttgtacttttttaggcctaaagttatatatttctagaataaagatttgtgcacgtatttttaaagggcatgtggcttgtatttttttttctttgcaacttaatgtgatgattaatattccaaatttgctaccagttttcattattactcagtattttcaggcatggatggctccatagttcaggatttctgcctatttaaaagcagtcgccttaagcacattttcgtctgtcagtagatgtatattcttcctgcttttaataatgaaaatttcattttaagtgataatccctaaaaaggatttcctggcagaatggtttatatcataagagcgtatgggagttaagaataattatgcagcgagtatctttctccaaagagcttaaagcactttatggaattcatctaattaatgttcacactatatccatgagaaggcagtggacagtgaagcatggctgggtctgaagtgagctcccattccatgccttgagagggtaagattaaacccagcaaacgcagagttagtgtagtctaccactgtttgtcagcccatgacaaaaactacattttatcacattaaaataaagaggaagaaacgtataaatcagctgagtttctttaccctttggatttcaagtatcctaacagttaaaaacacaaaaactatcagttcctttaacaattccagatgctctggcattttagaaatacggtcaaagtttgattaaaatgtggagcttccctagtagaacaaacaatatttacactgcttttcattcacacaataaatggtaagcattgtcagtatgtgtgggcatatttacatcaactcaaatgttacccagatctgactgtgtacttttagcccagacggcctgacagatgaagttaattttaatattatctcaagaaaagcattaattatatgcatgcctgttaatacgttctggtggagaaaaagatagaaggatgggagtacataatagttagaaaggctgatttgtaaacaaaaataaaaacaacacttcagtacctcttccctattttaaatcacagtccacagttcagcttttccactgggatcacgtcgtaacctgacctgatttccctaacctggtcagattttcttcagaataaaattaataaaagaattcacagaaggcttacaatttcattaaaatagataaaatagttccaacttcataaaaattgtattggcacattcaaagacataaaagaatacttataaattctacaatgcataatctgtgaaatctttttatttgaaaaacaaagtatttagcaaatagcactgtctctccacatagtcacaccatgctgacagaagataaacataaggtcagtaggtcttcctcaaagacatccatccatacactggagacatgatcaattcatctcatcactttcatagtaggggaataactagcggatactttttgcctaaaagcagatttgactctgatgattatcagtacaaatttaaaacgtcaagtcaatttggagaagtgcaagcaaaggcaccaacaaatcaatagtaagattctttgatgttcatcttttaagattctcctttgtactaactcttgactcatactttcccatttaaagtaactgtttattaattgaacattgaattacttgaaatttataataccagctaataactggataagctcttaagggtgtttccttacctgtacccaacgtacagttgaaaattgtggattatttcacgggaaatttatcctgactgaaattgatagcaatgccatacgaaactttcatgaaatttaaatacatagcattgcataaaattaaagcaaaataataccatttgaatttagttttagccttttgagtttggctaatcttaatcactggatgaccactggcttcaacatagaagaaccatataaaaggaaaagtgtacaaattattttaaagtaaatgactgataatttcttacatatcttataaggactattaccttactgttgttgactctacctttctagacatgcctagggactaattggattactttgaaacaatctcttttactgcaaaaggaaagaatttacaaaggcaaagctctatagccaatgagttaagaagttacttactgaattccagagggtgttccatattatactgtggtagtgaacgtggcagtggttgaagtgggttcttagtggatgaaaagtggttctgaagtcgtttagggatcatatgggctaaaattaccatgatagcttcattagcaacaccacctgaagtagaaactgtctctgtataatttcactcagaaccaagttacttttcaactggtctctccccaggatgtgttcctattagctgcaaattcttacaacaaccttatggctaatgaggattcagaatccagaaatggagaatttgttcctctgaagaaagttagaattttaaataaatactgcaacttctggagacttctcaatttaatgtgactccatagtgatcatagtgaccacatgggtgaaacctcttcaaattgataaataaaatggaatttccaattgtgtatcttggacaatccatgcacaattagaaacagatgtaacaatggctttagatgcatgacggataaactataagggccacagttgcatagtactctgactctataagtgtacattttaaacaccttcaatgccttctaaaacataagaacaaaaattgttctggtaactttgatgacttctacttaatcgttgtctttctcagaacaaataggttgaacataaatgcaatgctgtttgataattttgttaaaatgttcaaataaaaaacagtgatttattaggtcccatcgaaaattgcctatttatgtatacaataagcatgagaaatccaaaggaaagcttcatgaaattaccttaaatgctagtttttaacctcctttgaatgagccaatgtgtgttcccttgagaaggaaactttctcaggtctgtgactatttaaaggatttatttttctattgtaagttttcttttcacataacaccagtgaccctggtgatagtaaagctttagcacttggttaaactcctgcgttataatgtatcatattatcatattgtatagaagctgtactttccagtgggatagtcattagccacatgtggctatataaatttaaattaattgaaattaaataaagttaaaacttcagttcttcattcccactaagcacatttcaagttctcaatggccacattatactgcatttctaacattgaagaatgttctataagataggggtgatagagagacggcttctttgtctatctctgccactagtttatccctggtgaggagggcaggggttgagcataatgggttgcatacaacgggcacatataagtgctcaaaaatacagtgaaccaatgaataaatcttgttattattaccactgacactgccatacattaaatacctttcagattaaaagtgcttttacctatcagtggtttccaggggctggggtggggcaggagactgactgcaacgggagtacaaggaaactttttgaagtgataaaaatatttcctattctgatcacggacgtggttgtaggactgcatatgtttgtcaaaactcatcaaactgtacactttaaaaaggcgatttttttgtgcatgtaaattatacctcaataaaacaaaaaggaattggaaagagagaaagtaggcacttttatttgcattttaaaatttcatccttgacttttagagtgactaaaccagatgattactaccgagaaacaacaataaaaatatttagaaatgtaggatgcatcaagtgtgctttggatgtcaagcaacttaggggcacagatttctaaaattgtcttgggttaacatactgctcagggaagacgctagcgggtctcactgggaagacctctcccctccaatctcacccccaccccactgattctctaatcacttttgattttaccatctgttcctcctggcacaacaaaggttcagcaagaaaagtgacagcttcaacaaccttgtcttcaatgatatttttgaaattattggaggtaaaaatcaaatcggtcgatttaatccactatttattgagtgcctattcatgaagtataaattcatggctataccagtctgacatgatttcactaatattatatgaatctaaaacagtggccggaaaaacgtgtgaccaattctgatttccacattgcacaaaagttgacagtgatgcactgactgttctgagaaactttgagggttaactaggaattaggatcatgatttcttgatcacattccctggaaagtaaaccttgtgatagaatatgccaagcaatttggtatgtgcaaagaaatgtaagatttctgtaagccgttcctttctgggtgcagcaggaacttgattggggatttccattagaaaaatctcctgctcatcatgatggtcaaagcctgacccagcttgttaatcttcagagcagaatgcaacgcacaactgtttgcactatccttttactttcacaaattccagtcgctgttgcctctatggtgtcttttaattcaatgtcattacttcgtgtttgttctctatggtgatgtttattacaaagagcacaaagggaacaatttatgcactaaaggtatgtctctgcttatcagaataaattacccgtataagtgtctgcaaaaataatcccatctacttttcttggtgaatattgagtaaaccgttaacagggcagtgaagcatttgattatcttctcaagagaatgaagaccttcatggtcatcctccttctaggactgagagaaatgctaatttctcctcaccaaggttatgaaggtagcatatcatctttacacctagcattagctaagtttctcaatctcaaaattgaagaagtgtttcagtttgttaagcccatgatgaaagcttgtctttttctctcacattctagtctataagtagcacagctatgtctggggtcttagtttttttttagaataaggatgatagctctgtctgtcttcgatgagggcctgagctctaggcctctggatagaaacagaagaggtaatctgtcctacatgtgaattaatgtgaggaaggaatgagaaagcagatataaagtacctagtcactatgatcataatatacaatttataagtgagagctccgatatcagtaatattgttactagtataactcgctgtctttcaactggtttattcatttagctttctccatatatatggtaagccccaaagcatttttttgttctcctctttctcaagcctttctggtcctatggaaagtgttggagtttattgctacagaaattatttctttagtttattgtgatccatagtttggaagttaagtctatttttatagctgtttttctccttcagagcatattttcaatttaacttagcaaacaggcactgtttttaattccaaaacaaagtaatgcataaacaaaaactctaaccccaagaggttcttgatttagctctgctactgtgtatcctcaaccagatagttaaatttaagaaatggaacttaatgtctttgtctgctaggtgaagcagttgaactgcatgacacctaatgtctctgccatctctaatgctactgtttactattcagtgattttagttagccaaataacaaagtttttaagcaattttagcaccctaggcaaatacacccacagagtgaggattttggcaaactattttaatgttacaatggacagtgctggaaaatacgggctcctcaaaacaaaatcttaccttgcctattttagacccagctttttgagagcaaacaatcaagttttgtttttgttagtttcttctcaagacttatcccagggcttttcttataataagtgggtggtaaataattgctgaataaattatggggactcttagagctataaaagatagaatttgggattacctgtgttgcttattagaaaagtttttaaattaactaaatcattttgtgaggatatatatgaactcagttggcctcacatttgccttgaagttttatgttcctgcacttaaatcaacagtgctttttctcattattttcatttcttcagacttttttcccctaacatagttgataaaattccttctgcccacactgaatctttaaaaacacagagtagttggaaaaaacttgtgttttgctatatgtgtataattagtattctgtataaagaaatgaccgtagttctcttgaatccagatgctgcgtgggggttaaattttacagattcagccatttgctaagaaaaataaggtcaaaattttagggtaagaaaataatgagaatgatttaaacttgtatagtacatttcagtttataaatttctttctaaaagtttctttctaatatagtattttatttaattttgacaacaaaactgtgatgtggataggtgtgccactttatagaaaaaagctaaacaaactaagattcaggaagctaagtaacttatttaaggtcacacacctagtttttggcagagacatatgttctggcttcaagttcaaaatcctttccactatactacaattacccctactttacatctaaaaacacttcctagaaatgcgtaagataaaggtagtttttgttttattcctaaaatagattaatcatgtatatcagagatattacaagttgagaattagcaggatgaaattttgacagaaccaacaagatgcaaactgagatagttttataataacagtatgtcttttaataaattacagagtgaatagtttaccaaatgttgggttaaagcaaactttcagccacaagattgaatctgctgttttatccacagatatgtggtttttattgatcttatacttccattttattttaaaatgtacattttatgttaccatcctgggatcaaagtaacttgaaataataggaccttaggtaaataaatccttctgttgggataaggatgaacatgtccatcagagttgtctctttttcctttgctttttaacttgtgttaggcaagtgacagaatatgtttttgttgttctctgatcccagttttattctttgtcactttttttttctgccaaacagatgcagtatgtttcaacagaaagagtgctccaaatctttaatcattatgaaaaacacagtaccttgaccttgtattttaaagttaaatggagtggcattataaaaattaaattggttcttgctcatttccataatatcctctaaaaagccttgcctaacctagagtggatgtcctatttctttatctttcttgatgatctctcatgcctgcaagtcagctcgtttttctttgctgaagactgcaccccactgctgcatgcactctaaaagttccattaaaatctagggcatcatcactcattcttatctgcagcaggctgctgagcagtgccataccagcaactgcatgcaaactagcctcaaaggacaatattagctatatacattgtcattctgtaaagagaagattccacctggatcttaccttatctcccagagcatatctagcctttccaacatggctcccagtgtcagcgctatgaatgggtctcttgcaacagcaaggattacttaaaaagcaatttaccagcaagaaattagctttttataggacaccctttattaaacttggtgtgagatgagctagcatcctgaatttcccccttgagcccactgagaccacgcgggccaaaagctgtttcattttaaatactgtactataaaaaattatacgtattcctctctgatcttgatgaattctttcttgggatggatgtgttattaggataataaggcttgagagttgaacaatgggctaggatttggcactgttcctgttgtcctgaaatgtgaagaaatgttgatgtaacttactcaatgagatgttccctaaccactgggaatagttcactgcctggggacaccagaggagaactacagagatgggggagattggtgaaagagctggggtataaagatacaaaaaataaagaatattaccaccttttccttctttattatatcaaatatcatttttctaaaccaataacagagtacttctgtgggaacgaataaaaaagataatgataatatcaaatatcattattgtcaaacttgatgacttatttctccattttatataacttgtagtaccatcattaagtagtattaaataagatacccatatacatggtactataaataatttcctgacaagtattttacttcttgtctaatgaagtgaagtgaagcactttaatgaagtggtgggtgtaccagtctcagaaacattccgaagactgatttcctaagtcttccaataaactttagctttagacggtgggtggggtgcaggtggttagattgtcagtaaaagcacctaagccctgggtaaattctccagacataataagactgactctgaaagatctttgttgaaaggtgctggataccactctgccatatctatgtaatagtatccattcttccaacagctatatatctagaatcaactctgcaatatttcacatgaaagactctttttcttagagatttagtttccattgttatttcctgtagctgtctggatggtgtcaaccaaggtgaactttggtctaaatgatttttcctcagttattaagtagtgtgaagacaaaaaataataaaataaatgttgggaaattgagaggtatgctgcttcagttatggaatctatttcacataaaatagttattccaagtctaaaaataataataaatccaaaaccaaaatatcggatgtgtagttttaatcaagcaaataaatgttttatagggccttttgattaagagctcacagtgagactttttagtaatttataaccgtgaatactttccacactaatttatcagaagcctttattactacattttccagaattttcaagggggatgtggtgggatgaatagtttcccctgaatagtcacatgtccctgaaaccttgaatgtcaccagatttggaaatagggtctttgaagatgtaattagttaagaatttcaaaatgacatcaccatgaatttagggtgggctctaaatccaaagactggtgtccttttgcggcactattcacaatagcaaagacttggaaccaacccaaatgtccaacaatgatagactggattaagaaaatgtggcacatatacaccatggaatactatgcagccataaaaaaatgatgagttcatgttctttgtagagacatggatgaaattggaaatcatcattctcagtaaactatcgcaagaacaaaaaaccaaacactgcatactctcactcacaggtgggaattgaacaatgagaacacatggacacaggaatgggaacatcacactctggggactgttgtggggtggggggagggggggagggatagcattaggagatatacctaatgctaaatgatgagctaatgggtgcagcacaccagcatggcacatgcatacatatgtaactaacctgcacattgtgcacatgtaccctaaaacttaaagtataataataataataataataataataataataataaagaaaagagtggacacagaaagacacacaaagaagagggttatgtgaggtcaggagcagatgttgaacttgtgctgcttgaaatcaaggaacacctggggctaccagaagctggaagaggcaaggaagaattcttccccagagccttcagagggataattgaccttgattttggacacctagcttccagatttgtgagagaataaatgtctattaagccacccagcttgtggtaatttgttacatctgtgttaggaaacaattgcagggagtatggttgttattatcctatattgccaagtgcatacgaaatttggtttagcatctattggtctcccagagacacgtcaatcttaaaggatgctaaaagctggtaggctttaggtccaaagattgactagaagtaaagatttcaggccaaatacacagcagcacaggtttggggggacgtggtggggagaaatcttgtaaagtcaacaatccattttctagttactgtctagtcacgcattataaatgacacaaacagctcacccttgaagtcttaacattatgaacctcataaattttaaaaatcagaataaagtctctgaatattcagctaacagtaaagtctttaatctaaatggatgatgaaaatggagagaatttatgttagctagaaaattaagactactgaataatttttctttcagctagtgttccatataatggtgatattttggcatatatgtaagataacacttactaaaaaagaaattatctgatgcatgtgaaaatttagagacaggtcattactaccgatcaagatgatttgctactgcccatttgagagtataaggggacagtgggctccggtgtgactatgaacatatgccctcagtaagcagggcagcttgcatccctgagaagtaaatgagtatagatgtgctctcctcaaaagctttcccttcccaccaggagtgtttgtaaatgttgaggctaggtggaaagagttggaataggatacatttttgcaaatgatataaagagggtgatatgaatacagaattgtggagctttgaagagaaagggaataatgattagcatttactgagtaccgattttgtgccaaatcttgttgagcatttttaatacactcatttatttaattccaacaagagttctgcagtatgagtagtacctattttacaggtgaggtaattgaggatcataggattaaaaaaaattacctgaatttacacagtatgtgtggatgtaaacaacgtgctttgccattctcttgtattcttggacctaaaagacctaacggtgtggttgtataagcaaaatggatagacttgaaagttttagtatgaataagagactgtggtagaaaaacattttttaaaactgtagatttaattaagtctcaaaaatgctgcatgaaaaataagtgctataggaggtaagaggtgggagaatcatttaactgttcacagaggagtgtggctgtgagctgaagatggaggattaaaagagaagcaggatatcatagtctatgtggagtctacatagaggaagaggcaggagaacttctggcttgaaacatgagcatgatggaacctgagggtcctcctaagtaggtataagagggaaagttgaaaagtttgcatgaacccagaatatgaaagtcagaatatgcagattaacttgagcctgtgaggactagaaagccactgatacgttttgagctggtaactaatgtaatgaacctgatatatttctcaggaagattaataacatagcggtatagtgagagattggtaatggggagatgggaaggaagctaatcctatattcaaacatgattatttttagaaacaaatagaaacagaggaaatagaaaataacaagaggaaggaagagatatccacaagattgcacatgactagaaaggcacaggaagaggtcaaaagtgtctgaaggataactgaaaataaagggagtcagtcaatcttttagctgctattgctgggggtctctgtaaataagttgctttccaagttcatggcctttgaagcacccttcattacaatcagtgcgtttttctgtaacacacaacgttatcataattttgttttatgaggcatagggcaaagaggcaatatgcatttttaagttcttgaaatctatgcatgtctttaagttagtagacataaataatttttaaaatccttcacgattgaattgaagtaattatgttgactacatattcaatgaaaattacttcattattctctaaagaaaatggacagagattactatttttatttggagaaagaaacacttaagtctatgggcctgaaagggttaatacaattaatgcatttttaaaagtctatattactctcagatgataactaattcacttgaagaacttagtttgatacatttagaggctccttggagttcttcaaaagaggttgctacagagttccagggtattataatcattattaattgcagtattttaaagttcacaccagatgagcttccaagaaaaatgacccaaatttatttgaaaggtcacatatatttattttacttatccaaccacatggtgataaaaatagggaaaccatgataaaatccagctcaactaggtaggtagtatggtatagcagaaacgagtccctggatttaaaatctgagagctgatttcctctttgattccttcatgtaccaattgtgtgattttaactatactgcttaatcctcatatgtcttaatttctcagctgtaaaatgggcataataatgtttgtcttacctcagtgaggacaaattttttttttcagtgctgtaattccagcagctagaactgcgtttggcacagagcagaggctcagaaatgtttgttaaattaacacgtgaatgaatggataatgaatgttgtgcgcattcagtaacatgaagcacatgaatgtacatatatttaaattttgcatccatatctattaaataccatctggatattttatctattatatctgggtaatgaaaataactatacaatgctgtgctactgcccgtttctttccaattctgcattcaatgacgtcacactggtagcttgaaattggctatgctggagcatttgtgcaacaaaatttgccaaatgctgcaaatcagacactctctctccccgccaagagcctcttgttaaacatttaccagcaaaccactgttccaggtcctcattatctggcctctgcttatactttgttgtcttctatcttctctacaacttttgctgaagtcattctgaaatactagcagtcaccaaaataatccaggctctgggcgtcactgcacaatctccaccttgccttgaaaatttccctcctagaaatacgtatcatgtcttagctaacacttactcggatatccttgaaagcagtctctgactaccccaagttagacttgggtacctcttccatgtgtttggctatcactcagtggttatcaccatgacggtattatcctaacgtatgataataattgcttgtttacttgtgtgcctcccctgagagctctttgaagtacagggactgtcttattcctaattagagtttctgtatcttgcttctacaggagctacccaataaatgatagttccatgaacaactaaaaaaccccaatctggttttgtacatgttggcaattcaggaaggctaagtgtgttattagtccaagaaatgtagtgaatagacacaaccactcttacataggcactctgtgcttgacatgatttcctgaatgttagtgggggaatccgttacactaatccacacaagtagtcgtaatgctgctggcaatttcccagacattaacaatgaagatcgttggcttaatgcaaatcattgacgcctgtgacagatcaagtcaatattaattcctgtctgatacttttcttgtgacatttgaagtcatctctgttttgtctaaaaatcttattcgtaggacagccacctacagggccacccagaatggctcattaagccaacacatttcttttgcatctttgtgcatgaagggatctagagaaaaactatattattcctgttttttccctcctgcctcacacaggtcagttgttgcaccagtcattgtctatttcccttaagatcatgtccccctgggaactacatttcccagactcatatgccaatggacttctctggatggaatacgtcaatgtgtggcaatagcagggaactaaatggcagggaaaatacggaattcagggtatttctccttctctctgctctggaaggtattttgtggcttatggctgaatcccctcttgtgttccaactttctgcttgacgcatcctcctcctgtggttgcaggtcctgccgaacaggacaggccccacctgatcctagctgcctccagacgacttcaaattctgaaatctcatgtcaccttgtgcttaaagccccagccataagtgagaacagcttcctgcgactgccaatccctgggttgttttgatcttttctcgtttggcttctcaggactctcatcacctacggaattaatttcctctattaaactccctcccttggtactatttggaggagttctctttattattattgttttttaaccattttttcttcatagtactactatcttatttggtgatgaaaatcaaaatcaaaatattctgaattatctttggcttcctattttatctgactcctcaagtctaaacagttgtcaagcccccccagtcctttcaactttcattatcttctttcatttctattctcattcctgggacaacaatgtgatggccattgccttttccctgaaatattgcaatagcctactaattggggcctttgccttcagtctctttcccttctctgtttactaggaatatggatcatagactttacttaagccagcttggatggatagaaagatagaagggattattgtaaggtttgaggtgagacgataagggagtctctggggaattcaataacagcatctgtcataactctgagcatgacaaagaatgaacatataggtggtcctggattcaaggcaacagtagaaatctcatcagtaagagttcaagcaatttcactgcacttctcttccattattgtgcctcagtcaccccctaggtgtctccctcatttgtttctgcatttacccggctgctactgtttcttcaatttcttctccctcataattctgaattgtacatagctttcaaggctacaactctgtcatgttattaaagctatacagcttctgtatctattctgaaattcttgggttttccaagaatagaaatctgattgttcagctaacttcttaatgccaagctctggtttcaatcaaccatgtagtggaggcagttacgaagggcccgaatgcacccttttactgggataggacacagggcagttcatttaggaacagagtgataatctattatccaaacaaggatatttttgagagcaaaaggaggcccaataaatgattacataggataaacaagtagaaagtgggattgttctgagtaaactgcaacttacagtcaacgtatagagtactccaggcaggcaagtattgtaaattgagtctatttccacttgttagtttctctactgctcttcatatatatactgaatatctctttctcagtgtagaatgtcattcattcttccctaacatcagcctgatcccactgctacgtcaagtgtgtgttgaaatatttttttctccatgaagccttccttgatttagctaacaggaaattaatcttttcttttctttcctttttttttttttgagatggaatcttgctgttgcccaggctggagtgcaatggccagatcttggctcactgcaacctccacctcccaggttcaaacaattctcctgcctcagcctgctaagtagctgggattacaggtgcataccaccaaacccggctaatttttgtatatttagtagagatagagtttcaccatgttggccaggatggtctcgaactcctgacctcgtgatctgcccaccttggcctcccaaagtgctgggattacaggcgtgagccaccgtgcccagccaattcatctttctttttataataaatgcaaatcgtacttcaactgtgcattctagggcttgtatttattttctattatacattataatttttatgcatgtactttgtctaataggtgtaagttcttagggagaatgagccatatttaatacatttttgtataccccacatggcctagccaatactttgcttatagttggtaggcaatgaatatttattaaacgaatgattgctgagttttctgaaaacatcattcttgccattgttgttttgagctcactcaattattctggatcctgatgtctatgaaatgcaaaaagataagatattgatcacgtctaaattagaagagtggtgagataaacagaaataagaggattggaagttaacttatttacataatctgaagaatgtttaactggaaataaaacggacagaagacattttgcttctgaagagataaacaaggaatcctagataattgaaagaaaaggaatacatttatttctcaatgagtatttgttcaatccatacatgatttatttagacaaatatctaatttgaacatccccttggtttctataatttataacatcatttacaagttcaatttaatgtatatggaaatcatagtgcatatcagttttgctatttttaaaagtgcttcctaatgaaaagttctgatatttcagaaaacatttacattcttacataagaagcagttaaatagtaaacttccattagtagttaattaagaagcattatatcactcttctatatttgttagtgtatgtaacatgaatcaaagccacctgaagtaattcatggggtcataacgtgcacttttagtgtatgatgcatgttatttaatttcaattaaaatgaagtttcagttgttcttcacacaggcctttttcccttaataatacagattcatttccataatactttaggtgatatgtatgattgtatgatacataataggtttttagcatttttaatacaactctacatatccaggaatccaagcattggaaattgaccccttgggcctcgaccaaatcaagtacgtgagacaaatatgagccttcggtacaactagagtagatttattttattccaaccattatgctccctttagctgtcacatattatgacctgggaaaagttgctaacttctctatagtacagttttctcacctgataagcaaggaggatccctaccttctacctcccagagctgatgtgattattaaaagccagttagaatcttcacatagtaagtgttcaataaacacttgccattactattactagtaacacacgaagaaccctgaaagaacataagtgaaggtcagaagacaaggtggagactattatgaaaatgtttagaaaagttctagttgggtcagagattaaagattaaaacgtttagacccacttaattaaaagacaaattttaacatattagtaataagcctcatattagtactactaagcatactcaaaataggtaagactactgaaggtaaaatcaaagcagtaccagaatatctgaggcacattctccttttgcgaagatggtagttcttaacacccttgtgatttgcctaagatcttaacatactctcaaacacattaatcctttaatcctagaacagtgtttctcaaccttagctacactctgggatcattcaagaaatattttaaaatactgatgtctgggtcctgcctccatagattctgattcaattggtctagatgtgatctgggcccggaatagctcaactgtctccccaggtgattcagatacgcaatcaaagctgagaaccaacagttcgatcgacgcttttcaaattttgacatgaataagaatcacttggagaccttgttaacccacagttttcttggccctactcccaaaaactctgatttagtaggcttggggtggggccaagactttctagttctaacaagctttcaggtgatgccgagcatgatggcctgtgagtagcgttctgaaacttgaacatttggagtgtcagaaccccctggagagctggtcacaacaaagactgccgggctacaccccctagagttttcaagtgagatctggaatggggcccatgcaggtctaagttcccaagtgatgctaacgctgctgatcccgggacctccctttgagaactactactctagataaaaagtacttactctccatctgcatttttaaaaacatcactttaataatctactggctttcaagacattttcaccactaaacaccttatcatagcagcttccacggattgctgtgcctttggattagagaaacaagtacataaggcaaaggacatatatattctccctgtctacttggatgcacagctgcccagcacccagaaaccatctgataccattcaccaagctgatggattgtgtgttgttcattctgctccttatctaatagttcttttatttaactaatgactgtaattctcattagatgctgatagaacactaagttttttttgtggaacttggcaaaactactcatggcaggacatcagttggtgagcattacctaggcagcaacacccaaccctcccgctggcctgagcagcaggtgctggtgctgttagtaatgtcgacataaggaggcaatggtttctctggccatggaagatatgttgtgatttaattcaagaattccttcagtttagaggtctattaaatgaccttctgttatgcaatctgcagtcatgaaatcttaaagaagagaaaacacctttgttttagcctaatggagaacaatcccaaggatctgggaatactattatactctatttcaccttaatgtcctcgcacttgttgttctgaaagcccctccctttccctcctgcttccgggtcacccttactcatctatcacatctattttagcacccagactaagatagtaccacccgagtgaagtctttctcaaatgtcctatctctggtcatgctgcctagttcttggagtgcatttccgtcatggtactcattacactgcatgagaactgggattatcctactcacctccccacaaagcacaagcacataggacagaggcggtatctagcacatctttttctctccagcacttcctagcagtgcctggcacagagaaggtacatacgtaacatcttccacaagaagttctttgaagcaccaatcccaccatctgctatacttgctagtgtttccaagatacttctggatccctcggtatttcttccaaatgtagtgtttatgcctttgatcatcagtgatcatttcacaagtgtgtgtgctagccctgaccataagcaccatgagaatctattgtgttcacagttttatcatcagcatttttagaatatatggcacttgcaagttctcagtaaatatctgcctgatgaaacaaataagtttctgtaaaatgggctgttaaacacagatgaaaagtttttaaaaacatcagggcttcagttaagtaaatatttgggataagaagctgtaaatactaacgtcgagtgcaacaaatatgtcaacacaagaagtcattgagtagaagtattgtcataaaatgtgttgggagctttttatgctcccataaaatgcttggggagcaatccttttgcatttagagaccatttagtatttcttttggaaacggctttgtttgaattcccattccatttacgggcttcttccaaagaatttcttctcagatatgtctggaatctcctttttaccttttgattggttattgtttgggcaaacactcattgtcaactagcaactgataagtaaagggaaaaatacaattaccagtttttcaataattttgaagcatcaatagaaacggattaaatatcacattgccttcaaaaaggggccaaggtaagggagataaaagaggcaaatgggagtttggaagctctgctcaaagtattatgaatgttttacaatgtatttcaggtcaacaaacattggcatcgtcgttgcatttttcagaaaagaatgtaagctgggaaaaaagtttagaggcaaattaagacttgagagacagttctaagtggaaataagggggatgggaaaagaaccctgtattgaaacatcattgatttccttctcacccataaacctacactctgctaaaatgtgttaactgcagcaaaatgattaactcggtgagtctagcatgtgggaagtaaatgacatatgtaacgaggaactggcctggaggtagcgccagaagtatatccaagatggcaagatgaagcaagagtacaacaacttcctggtgtagtgcctttcagaaaatctccctctgttttgttgcacatgacttctttatcttactcaactcattgtgtaataaggtagaagtagaaagaacatccttcaaaattattggaaagtgacagaatgtttgagtggatggctttgcaaactgttgaaaatgtttcatcctcaataccaaatgacatttctgctagcataatgccatgcttttttcccccttctaatactatacaatattagattttgcatggaaatcactccatgcatccatttgacaatttatcgagtacctgtttcaagtgctatgtactgagaatgcgcccacgaacatgacagataatatatctgcacataatttacagtccagtaagaattacagcttagcttcttcctgtcttactccagataaagacccttttccctcattccaccctctcaaggtgcataacttaataagtcagcatgcttaatactgttcgatctaattgtcttgagaatgtcattttcttcccatcccacctttttcaaaagtatttaatgactcctttttgcacagaggttcacattcaagctcctcaggctaacaactcatcccactgtaaatttgtattaatcatattctaattgtcctcttttgtccctcaacatgggcctgccactctggtcactccttggctgctcaatataccacccgtgttctttgcgggggagctcaagtcatttgttttttcctttcatctgaagacacatttgggtgagacttggggatttgtatgtttaagcacccagagtgactctgacataccactactctatctataaactctgcttacaacctaaggccaattcagatcctactctttctagaaaacattcattaactgttacttctcatcatgatttcttcattctttatagtacaataacacttactgtctcatttatttcggcatatatagttccagagctatgtaattacgcctgtttcatagacacaggtcttatccctccaatgagaagacatgttctataggagaagcagctattatcttggacctgtattgaacttctcaaccgcacctagcatggctctaagtatacttgcagcatacattgtgtacttattttattttaacatcatgactcttctagcaacttttgtgagttgcatttaactttttcagtctctgtagggcttacttcacaataggtctcagtgaatgaattaacccttagagtgtccgtttcatctaaaggaggattgcctgtttttgcaagttccagcatctaatgtttcaccttgaaaaatattaaccctgatgtaggtcaaatatatgtaaagctgtattaactttgtttttcaaagacatcatcatttttttcttttttctctgtgagggcttttttttttcttttataaagtaaaaataatttcaaaaatcatattgttctcttgtgatgagaaagcacatacaaaattttatttaagcaacttgaacacgcatcaaattgttccctttgacaaaaagagaaaactacttgtctgggctcactagattaccatgtactatgtcacgacgaatatatttctaaagccaaacatgaaaatttaattatcttgagctacataattgttcttctttggcttcttgccgaattttataattttttcaatagatcgaactgaatttacaagataatctttgaatttaaaacaaagtacattactttttaagccagtaagttaaaattccaattctaaaatattacagtgcactcccaaagcattgtggtttaaaatattcaaaattatataatgataatctcagtgcttttcagttttaaggtattcatgttttagtcaaatgtgattatacttttattcgtatctttcttacacatgtttcaaagctcgtaaaataattatcttatttgttctaaaacttccttacgtatgctgtactttgtcccatctcaatgaaattacatgcagcaaatttgttcctaagtcttgtgttcaacactgagactgtaattcctgacgctgtcattctactttttgaaaattttacattcaaatagaatatctcaactctttctatttgtctgtcttcagataacttattttagtttgttaaatctcagaattttcaccctattcatggggctaagttgaattaattcttaaattgtgaggatttggagaaattatagatattaaagccctagcacaaattctgaaacatagcggcttttttgcaaatgttcattttgcctatggatccacctgcaaggtgggcaaggaaagggtttgtagttctattgcataaggctttgaaattcactagtagatcacgatcagtggattgaatctgctgccttactatctacgttaaagccagttatcagtcttgctggcacatcaacaaagcctgtctttctttcaattaaaagttgcaattacaacttgctttcttttaaacctctcgtagtgattcaacctacttgtccccaaagcgtatttgattgaaaatcatgctgggccggcccaacaaatttcacacttatgagaaattcaccaacccttctcatatcatcagcttattcccccatccaaaagacattcccagtaaagtaacattaactgtttagttaattaaagaccatcttcagaatatagaaactgttatggactgaagtaggtctcctcaaccccattcatatgttgaagttttaacccctgcaagtggaggtagggcctttaaaggggtaattaaggttaaatgagttcatatgggtaggaccttaatccaataagtctaatgtcctcataaaaggaagaacagctacaagggatgcacatacacagaggaaaggtcatgaaggagaaggcggctatctgcaagccaatgggggaggactcaccagaaaccaaccctgtcatcaccttaatcttagacgttcaacttccggaactgcaagaaatacatttctgttgcttaagccacccagtgggtgtttaccttgcttaagtcatggatattttgaaatttttatatacaaacaaaagtaatgccaattaataattatatctatttaacaactagctatatattttatatatccaaagttaatcaaccgaattgacccagtaagtgtaatctttgcttatgtaaacaatacaaacccttagctcatttagattggctccaataaaatattttttaaattcagttaaagtcttaaacatggatcacttacatagcaaatatgtgtgcactacaaattgcagctaatcaatcatttctatttatgtgtgcataccctatgacctgacaatactactagcgaatactgttgagaaatttttaaacatgcactataaaacatatacaagaacacatgtgtgttgtggtttgtgatgaacaaaaacataaaaacaacccaaatgtccatacgcatgtaaaatatatacattgtgttatatacatacaatgagttgcacattgatgaacgtaaatatgtaaaacatagtattgagagaaaagaattcacagagaagattagagatggggtggttcccttaatataaagttcaaatccaggcaaactaaaactagctactctttaaagatacaaatacaggtgttgaacatacgttttttaaaaaatgagcattgtttactagaaattcaagataatggttacttttggctctggggggaaggaaggtgattagcaaggggtaacatagggagcttctcccaaaatactgatggtgttcttcttatttgaaactcagaatgttggaacacagatgttcatattattctttaaacctgtgctgtccaacacggtagccattagccacctgtggctattgaacaattcaaatgtgactaatgcaaattgcaatgtgccataaatgtaaaatatacactagatttcagagacttactaaagaaaaaggttaaatacataattagtaatttttatattgattacatatttaaataattgtgatttggatatactaggctaaataaagtatcctattacattaatttctctgtttctttttctaatatggctagtagaaaattgaaaactacgtatttgactcacattatatttccattggacaacaccactttaaacactccctgtaaacgtttatattgtgatatatttcataataaaaaataaatatgtgttaattgtataataaaatccaggttttcacccttaaggataaaaggagtagttttcctttctaaatacaatataaaccagttcaatggaacttataaaactatggacaccttctaagtaagtcattttttttaaagtagtaggtatacattacctcaatcattcaaaagcaatgagatgtggttaatttcaacacatatacagaatcacttttttaaaatctgctctaaaaatccagaaaaggggcctggattttcccaaaggcaaatctgagtggtgagttgatatattgaattatcactgagaaagaaaccaaaattcaatgaaatcttaatatagcctacgtggacaagtatacaaaatttgagcatagcaacgatacaatttaaggattttgctctaaactaattcaataattagggaagctacagaatgcctatattaaaaattatctctcctttgtggaactcaatctgaccatacaatttgcaaagcagataaattacataatttagcattgaatacttcatctgaatagtaaggtatgaatatctaatggcctctctgttttctaaaatctgctagagtcagaatgtcatgtacaagttctaaagaatttttaagagaaaaagggaattaaaggttattgagactttgaaatctatttttatcagttgacactggaagagaaacgtgggtatacacacatacatatatcttctgtctttatagtttatatagattcaatggaaaataaattcagaatctgaaaatgaattttgatcaggccacaggatgtgtgatacacagaatggggaatgcaaacagggaaacaatgtcatatattgcaaaaaaggatttgtttgggcttggaatcaaagagaactcggtataatcctctttttttttttttttttttcttctgagacggagttttgctcttgtcgcccaggctggagtgcaatggcacgatctcggctcactgcaaactccgcctcccgggttcaagtgattctcctacctcagcctcccgagtagctgagattacaggtgcgtgccaccacgcccagctaattttactatttttagtaaagacggggtctcaccatgttggccaggatggtctcaatctcttgacctcatgatccgcccgcctcggcctcctgaagcgctgagattacaggcatgagctactgcgcccggccagaacttggtataattcttccattcactttctttgcaacttcggaaaaatttctaacttatgaacatcagttttctcaattactgtataataactatgctatcactttgaaggattcctaggagcattaaatgtagggtgcctgtcctactgcaggtatctaagacctggggggtattatcatcttagtttatcatcaaataatgctagagaaggaaaccagcattagttctgctgttctaccctcttcactaacagaatttgataatctacatttgagtgagacctctaaataatagaagacatgcagctagtcacaatatcgacgtgtatgtctcactctgtcaataaaactgcacttacaaaaacagaaaagcaaaaaatattttatttataatgttaaaggaagagaatggtgctcctaaaaagaaaagggacataaatatgttaaattgacataaatatgtcaagaggaaaatagcatttctctttgaatataccaaaaagtacatataacatcacagcactattcacaatggcaaagacatgcaatcaacctaggtgcccattaatggtggacaggataaagaatgtggcgcgtatacaccatggaatactacacagccataaaaactaacaaaatcatggcctgtgcaacaacatggatgcaattggaggccactatcctaagcacgttaacgcaggaacagacaacgagtactgcatgttctcgcttaaaagtgggagctaaacattgagtgcacatggacataaagacaggaacaatagacactggggactacagaggaaggagggaggaagggaacaggcaagggttgaagaactagtggttaccatgctcgctacctgggtggtgggatcattcatatagcaaacctcatcatcatgcactatatccagggaacatgtacccgctgaatctaaaataaaagttgaaattataaaaagaaaaaaagaaaacctcatactaacattctttggaaacagttaaatgaaattattaaaagtatgatgatcatgcatgtgtacttcgcttaaaatatttatgtatgggccgggtgtagtggctcatgcatgtaatcccagcactgtgggaggccaaggcgggcggactgccagagctgaggaactcgagaccagcctggtcaacatggtgaagccctgtctctactgaaaacacaaaaattagccaggcatggtggtgggcacctattatcccaggtacttcggaggctgaggcaggggaatcactcgaacctggtgggggcagaggttacagtcagctgagattgcgccacctcactccagcctgggcgaaagagcgaaactccctctcaaaaaaaaaaaaaaaaaaaaaagtatgaaacaaacaaagaatatattattttactattttagaagagaaaagctctaggataggcagcataacatatggtcagaagcagggacactagagccactgtcttggcagtatgaccttgggcaagtaacttaacctagttatatcatttgctagctaaataagtataataataaaacctgtcctgtgggattgttgtgatgattgcctgaattaatgtagagaaagtaatttgactaacgtctggctcagaagaagcattactacaacacttaggcatcatcatgattattatcatcatcgccatcatcattattactattgctgaaatgaatatgaacagaaattaagtctctgaaaagcaggaagccccactttatgagggatcatgtgtccaagaagaacagttgctttcaaatatctttttggttgcaaagtttttttcttcttcaataaatgcaacaggggatcccaatactacaattaaatcagagtgcatttagttgaacctggttggtagcctcaagtcctcatgtgtgtgtttctttccactatacttggtgttctctgaagcaagtcaatatcaagtagaacagaggcatttaatgttaaaataaaactagaataaggcaacaaagaacatgtataaggatgcatgaagattgtctctgggttgagagtactattaaaacagaaatcttgcatttgacttcgtatcacttaaaagcacttagaactattttaatttaaaaatcctactattaaaaataggtttagtatttaaagaggtaaattctaattttctataactgcagtatctgatgacaaccactagccgcatgcggcttttgaaatttaaacgttatttaatattaaataaaaatttagttccttagtgtccctggccatattaccattgctcagtagtcatgtgtatctagtggctgttgtattggacagcacagagacagaacatttttatcatcacacaaagttatattggacattgctgatttaggacattttgttacatggaaaattatgctgacaatattaggtgtgcagaatattaccataagcaatagcaaaatactacatgggtttgggaacacttttcctttctttatgcactgcagttaatgaaacaacttaaatgtaattctctggaggaatttattttcttaagtacttctcttaaagtgtctgcaatatgatttttacctgagaagtgtggcacagtaggaataaaaacacggtcagagttagcaccttcatgaccttgagaagtcaagaagtctccctaagacccaggggctccaggtaacagggataatgacagttgtccaccaaaccagtttacatgaagaacaagtgagaaagtgaatagaaaaacccttcgtaaactctgaaatcctaaacaaatgttacttattatgatcatttctacatgtatttttttcatctggatgaatgtgaatgaagtgtataatttctgtagaagtagtcgagctagtctaaagcaaaatgtcacagttaaagcatttgagataaggcacatttgtggtccaaagactccagggctactgattagagaaaaatgcatgtctggttaaatacatttatatgataattactagataatctggactttataattcagatataaaatattttgttaaatttgataaaatgttgcctcatctccatttcatcaactgagacatttattttgactttagctttagagataataagctaagagctgccacttagaagcatattaaaacttcacgaagttttacaacatgctaatttaatgctttattagcttatttcatttaagattacaaagaactaaaatgatcttggtgaagtgttgatccaatctcattccacaatgggacttaatttctgcctagaaggcaaacttagacatttaaatttggaaattaaaagaaagaaactgttatatatcagtgttactaaaccctgaagacaaaaacatatatagagaattgaaaattaatgtagttcagctgcctgagatttaatatgctgccaaaacaaaatattattcataaaacacttttcaattgtagagactaaattattttcctcctaaatatgtttctttctcccctttcaacgattaaaaaatgtatctattcctctttgtagcacatagctgtatgtatacgtaagaggttaatgccagtagctataacaaagagatcccacaattttagtggcttaagaaaagaaagaatactacaaaatgggcattcccatctgcaaacagcttttctctacccagtaattcagggactctgagtccttccattttaggctttttcatctcctaggtctttgggactcttttccataaggttagcaaatgggaagtaagaagatggaaaaggtatgcctgcaacataactcccactcacattcaattggtcacaactagtcacatggctctaactagatgccagtggggctgggaaatgtagttgctggcttgcagctggatcctagcaagaactctatactatgaaagagggaccacgaattttgatgtacacttgtctctgccacaacatatgcttgaaagaaaagaaaggttgagtattatgacacacacacacacgcacgtgcacacacacacacacacacagagagagagagagagagagagaagcgggggaaggctggggagagagagagagagagactttcatatttttcatacctttcatcctgttctctagcatctaagtaaatagaaatgctgtacctccccttctgttaactcatttttctcccttaaacatgtagaagacaaagtaagtcctggcagagaaaaaaagcttggtgtaaagaagaaaggaattcttgaagttggggacactagagattatcagttgtttttatttttccctgcatcaaacctggattctttcctaataccccttggtttgtagttctcattatcagcatgaaatgaaagaggatgtaattcagggttatagccccaccataggaaccctgaactacagtcttaagaaagtttaagactgaaccctttagcctgttaccttacacaaagcactgtggagtcccttgaacttgagagatccctcagattaccgtggcagcctcttatttcacaaaagttatgtcatttgaaatacagaatcaatacatccatcttctcttgaggaataatgcgagtgctgtcaaatgcctactaaaggactgatgtagctatcctgactgcaaaatgtccttcttgacacaacaaagagcacatcagaccattcagtatttatacaacttgttctttcatctaccacagatttactgagcacctgctatgcgttaagccctaggccggaagttatggatacaaagacaaacatgagtgggtctttaagcaagggagttataaggtcatatttgcattaataaaagtcactatgaagagtagagaataaattgaaggagcaagaagagaggcaggagagggagggagagccagtggtgaagagactgctgaatcaatgcaggtagaaggtgcaggctacccaggtaaagaaatgactgttcaaatgaaaacaagtggataaattcaagagagtttattgtagatttggtaggacctgataaatgaacgtgccttactcgagtatggtggtgccattgtctgaaacaaagaagcaaaagaagaaccccgctcgatggtaggggaaagcttgtgagctgagtttttgatcttatagaaattaaaaggttggtcaagtgtatgaatggaagcagttgcatatacaagtctggaagaaagaagatgccaggatggagggaaaatgtagttggaatcacggaatggatgaggatgaccaaaggaaagtctgtaatatgaaaagtccaggaaaaatccaactttttgaggaatattaaagggagagatgccagaaaatgggctcaaaaaggagggattactaagacttaggcagtacatgttcattcaacaaggagattctggtactacagaagctaaattcccttaagaaggaaggcattttcacccacagcattttgctacagaatgctcgagtataatcagcactaaaaaacatttgtcaggtttggcaacaagaaagttgctgccgtccttcttgaagtgaactgaaggaaaggaggaaattgaaatttattgaacacaaaggaagtgtctgaggaagtgtcttattaatgagatcccaatgcggcatcataagcaagtgatggaagtctctgcatataccattttttttttgtgcagtgttataatgctatattatcaaacaaaacactttctttttcttcatcctcacatacacattttcattttagaaagtcaacgtgcttttacttagtactagtaaatatgtcttgccaaaaagctaaaattgtgtaaatcatcaaaagtctataataatattaatgctctgttttgaacatactgaagcccaggaattgccttatttcccccaacaaccctgcagcttttctgaagagaaacctgaggttcacggatagtaaattatatgccagagatcaagcaggtgggaagatgatagagatgaattttatcccagctctgctggttctttcctcctcatttaacgttccaccaccttattcctttaagctccaagtaccaatctagagatttttataattaattcctaatgtctgatgaaacctgaccgacctcatgcaaaaatattaaagaatacttattgaataaatcaatccaagatacaattgaaaatgtaatttaattaggtagaggtcaaacttcacaaaacagaatataacataaataatcaacaccataggcaataagatagacatcttattgcctcaatttctgcaggggataaattgggaaataaggaacacctaagaatcagaaatgaggtagaaatattgaaataaaaacttgatctagaagatcacagtaagttcttaaaacgcggtcctcctaggacccagcacaacacgtaataaatgctgcctggtttgaattgaacttaaggtagcattaacaagaacttgggaagtgctgacacaaaatggattctcttattctagacaattcttgtactgaatgaacttaatttctttcagttctggcatagtttggatgaatcttcctcataaccatctggttgtcttccttcaattctgtgctgctaaacaaacttctgtttttaatttgttttgctaagtaaacttagtcatgaggaaaatgttagtctatgtggatggtcgtgtaatattctccggtaacctttcccccattacaaataatcacattgacattgtgctcattatccactagtttgaacctatggggttcaatgaagaaatgcatttctatgtctacatgcttagcaaccagatcctggtctcagagataaaatgccaggaagaaatcactcgacgataaatccacgtctcagaatttgctctaagcctgagaggagatgacggagttatgaagtgctagatgttgaaactcttatgtgcagacttcttgagaatggagttaaaaaataaaaacagagaaaatcaaagtcaaagatataaaatgttgagaaatcaaacacctgacattagctatgagaaatgtttatggcaaacactgatcctcgctttctcccaacaagctgttatctaattgttatttgttgtgtgatctatatccaccatttcaatcaaagcatgagcaagacttatttcaatagccatagcattgctcccagacaaacttattcattcctcctccattcattatatttagctctgttacagcatcaactgtggaatcctgaaataattctcttacatgtctgcctccttcaccagattgtggagtctgtgaaggaaattatgtactctacaaatatttattgaacacctaatatggaccagagactgttttagatgataaggagatagcagtgatcaaacagtcaaaaatttctgtccatgtgaatcttacacttcaagtaatgggggatgatgtaaatttggcattgaagaggtttggcttgtaacttggaatcattattttctagctctatgaccttggtaaagtcacttgaccaaaacttgagctgtcttatttataaattgaggatcataataccttatagcatggctataagattttaatgaaatgatatcatatggcctaataaaaaagtagctaagctttactgtatacctgttttatagtagcactgttgtgctttaaatcttacaacaagtcttcaagataggtatgattataggaaggttaaattacttagatagtcacaagttagctagtggaagagctagaatttaaacaggcagtttaattgcaacatctgccctgttattcactgggctctactctgtatactgctttctttagtatcacaaagtgcctgccgtatagagggcagttgtgacagtgaggatgctattagttgctcataacataaagctgcactcaaattaatcaaaaacagtaaacaaagggattctactggttcacgtcattgaaaactgcagaagggggctgcaagtgaagttcaatcagggggtcctgctccatatctctcagtactcttaggtctccctcttgtgtctgtcagccttatttcaggttatcttctgtcatggtattacaaaggctgcagctctaactatcacatatgtatattacttagttcaacgcaagagaaaaagaatttcccagaaacctttgcagtaggtctccttgatttttattagtccacagtaggtcatgaggtcatctttgaacctgttactgtagattgcactggttcatctgggcctgaggtatatgctttattcctagagcaataccatttgcgctccagaggagagttcttaccaccgcaaaaatccacatattcaccaagggaatctctctcacacagtcaatatagtttagttgaattaattaatgtctcaaaaataaattaagcagttctcacatatttgtagacagtattttctaactactaaatgaaataacgaaagtaaaaagaaggcaaaagaagaaatactctttaagcaatctcatgtagtaatattcattcacgtaatcattcctggcatatttctgtttgaaattcagtcatctacatggaaacagcggaaggggagctcaggacaatatgccattaatatttcatacacaatctgtttaacactaaacaattcatttttataggagttttactcatctcccacaaattcaaatgtttgtcttgctaatttttcatatttaaaatttgcttttcagctagcattcattcactaaaaggtctttgtacacctaatacttcgagttcaagctcatgcagaactattttattattttctagtaggaagaacagataaacatttcgttgcaaatgtggtagagttctgtttttaacgccaatattatctgtgttcaatgcattatctcttatgagctacatatttttgggggggattatattttttagatgtacctatttagtgttccaattaggttaatgctgaccgaaagattttatacaactaaaataaaattaaattgattgaagatatattttattgtttatttgaaacaatacttcataagtgatatgattttagatttatactgtctccatttcacattttcatttttagagtactttattgttatttagtcactgaatcttttccacatccctcgtaagttcaatctggaatgtatatgctagtgatttgttaaacatgtaaaattaaagtattgatttttaaatataatgtgtatatatttatttatagtgatatataacagttgtatgtatatgggggctacatgtgatattttgatactttttagattgctcaatgatcaaatcagggtaattgagatgctgattttttattttgtaagaagtaacagaaatgggaaaagaagcacatggaaagcgcttagatgtaaactacttgagtgtcactgcctctgggttagcccaatttaggccatctacacataaaagctcgatgtggttatttcagaaaaaaaatttagaccttaacaagtagggtccttgcccttgggccccatgctttcaaaggcaaagctctgattaggagtctgtaggaccaagccaacatgctcactagaagccccgctcccatgatctggcattcagaatccctcaactccctgggcaaatgtttcaaagtcagttactgggtatggctaaggggtaaatctttgcatgaggtgagtgggaaaaacttgaacatgtgggtgggaaatggggcgaccagatctatgtgcacagagttcctcacagtgcaggatggagtaaaggaggtagggaaaaaaggcaacagattcacaatagctaagatgcagaaacaacctaaatgcccattggcagatgaatagataaatgtggtatatatacacaatggaatactattcagcctttataaaaggaaattctgcaatatgaaacaatatggatggaccttaagattacgctaagtgaaacaagacagacacagacaaatactgcatgattccacttacttgaaataaggtatctaaaacagtcaaactcataaaatcaaagactggactggtggttgccaggggctggggatagggcgaaataggaagttactaatcaacagacattacatttcagttaagtaggatgaattagctctagagatctgctgtccaacattctacctagagtcaataataatgtattgtgcatgtagtatttattaagatgatagatctcatgttaaatgtcattaacacagtaaaattttttttaagcttaagaaaagccaatgtatcctaaataacaggcttagggttagctctaaccaagctgcctcattccagtacaaaactctaaggaatttattttattgtatcaagtggtttgctatttgagttttttccaaattccttgccagggaataaactgcttgcactatttaaaaaaacaagacagacagacagacagaaagaaagaaagaaagaaagaaagaaagaaagaaagaaagaaagaaagaagaaagaaagaaagaaaggaaggaaagaaagaaagagaaagaaagaaagaagaaaaagaaaatgagagagagagaattctaaatcgaatctagatgtccatatcattatgattgtataattgtcaaggaaagcagataggatatatttaatagtctgttgactttataccttataaatattaaatatgtggcatgcaggcaaccatttgcacacttactataggccctgcaaaagttatggggcagttctaacctcatatgactatgcagaagactatgtgatacagattatcaaaagatgacaattttttaaattcccagaccaggatggtatgaggagtgagaagcttttttagacaccaatgcatagctcttacagctgggatgctctccgaaggcattattattcctttttcttaagggaatgaagccagacataacacaagttataagttacgagttagaagccatgacttgaacacattcaaaagcatttccctggcatacatttctaatgtgtgaatcttttgggatccatttgtttctttatttctggcaatataattaagtttctaactctaagctcaacaattaaattgatagttcattagcattttagaagaaacacttcaaacaacaaatttagctttagaaaagaacaggtaaaatttgttacattgatcacattttctaaattaattattttaaatgtaattgaataacctatgtcctataaacataaacttgactatagagtcataatttttaaacactgagtctcttcataaattaccacactatatttttcactgagaaattaaaactatgatattttagctaaaatgtatcattttgaaacccaaaatatagatttcacttttcatgttcttgagattatttttcctgtagaaaacgtatatgctgaaagtggtcattaaaataattatggctctaaaactgcaaaacattgctaacatactaagatctaatacagtttcatggtgtcaaaaatagagtatttcaaagaagatttaaaatggaaatgtaatgcattgaaatcaactcaaacataaatttcacacatattttgcttttttaacaaaagccagcgttactgcccaaaatgtaaatgttctggtaaaggaagatatgtacgctattttcaccaattaattttcataaaaagaagcctagtaaatagaacataaaataaatatttaacatccttaaatactaaaaaattaattatcttcctaaggaactgtgacaaaaagaaaaatgtgatttcttgctttgtaggtcaaaatactttatttgctacttaaattttcaattccattcaacaactatttactgacttgttcttatatgccagaccctgtgttagaactgtgtacacaaattaatgtgatattgtccatgttcatatccatagtccaacccatcttagggagtttaagaagcacttcatcttaagactaaagctattattttaggtgtgtttataatatctaaatcaaaattctgaaatacaattattttgcaaaagacgacaaaagcatcattttactcaactgatcctgaagttttaaggcatatttgatttaaaaaatttaaaaaagaaagaattggggttgggaaaggggagtataaactgatgatataaaaatcactcaatttagactctagtaaggacacaagaattaccaaaacagttacttctcatttaatcattttggtttgtttaaactctttagttatttgggaaagaaatgtattgagtacctgctgtgtgttagatatggtgctaggtcctatatgtggatgtgtgatatgactgatccagttcttatcctaccgtaacttacattctagtaggcaattgcatgagagttccttaagagctataatagcagaaatacaggcttctaaaaaacagaaagaaatacaccttctcctctactagagtgttagaaaaacacatatagtaatattaaatatatacagatacctaatcagacttattggtttggacagtgggataataaggctagtaatgatttcctggtagaaaaaaaatatgtaagtcttcaagagtatggataagctcagataaagtaggaatgggagagataggcaggggtggtgatgtttagagccactgtgaatgaattcatgtcccaacgaaaaaaacaacagggaacgttaggatcgctgattccgggaattgtacagacctttttccttgcgtaagctaagtagtttttagagttacaaggaaaagagatgtaagagactggaggaagaaacatttaagaatctgaaaggacttaagtccatctgggaaggaaaagggaaagggaggaatggcaaaggttagggcgaagtgtgttagggggagtagacaagtgagagagtcctttgtggttaaagaactagctaataaactaggtctgaaagttgttactctatccctggaagaacaaataagaattactgaaggcttttaggcagaaaatgaacacattcagatttttgttttttaaaaaattactctagcttttgtgtagaaatagattggagaggagcaagactgaaattccagagtctagggtgtagaaatagattggagaggagcaagactgaaattccagagtctaggcaagagatagtgttttgaaatctaagcaggagatcagggtcatctgacttttggttttgggtgtaaagatggggaaaataagacattctagagagaaaatgtaagaacgtatttaacaacaaaacttagtgattaattggaggtatagatggtgtccaggcttctgctttattcaactaagtggatggtggtcatattaaataaatcagggagccagggaggagaagcagaatttatagatgaggtgatgagctcaggtgagtattttaagcttgaagcacctgagggacatctaaatagagatctattagacatttgtgtattcttgtagcttcctcagaaaaatgatttgggctggaattatagcttaagggtcatcaacataagaatggtaattgcgttcaaagacaagattacccacataatgtcaagtaagaggaaaagaggtcctagatcaaaactatgaaggatgtcgtcaatacttaatggaagggcagatgaggaattcacaaaggagttaagagtgtagagtcatataagcaaggaacagagtgttttaagcagaacagagttgacagtggtccataataaggtgaactaggataaagactgtagaggacccaccaaatttagcaacatgaggaccatcagtgtccttgatgagagtacctcccatgagcctttgctgctagaagtcaatgtgcagtgtgttaaagcagggctggcaacatgatgtggagacaacaaatatagataggttgtttatgatagagggttatctgtaaaggaaagtcaagagggaaataaccagtgtagcacatagacttcaagggttgttttaatgattaaacaaaaatactagagaatgttcaaatgctcatagaatatgggatcaatctctttctcaaaatactgataggatgatgtgaaaaatcatgtcttcatgagcaagcaatgtggaggcagtatattcccacagaacatattcatggaagtgttaacacaaaatattttaccaagtaatgaccatctctaaaatcacatttgtaaaaactagcgtgctttattaaatcttcatgggcaagattaactgatagacacagagcatttatttgttcaaatgttgagaattacaaattgaggaataattatttctaatgatagattcttaaaactcttattattaaagatataatacactaaaacaataattttcagttatagcctccttccattgattcaaacgaaagacacacaaagtgtaaccgtgcataaatactgtcaagctttgaggaatatcgatttctggaaatcctccgttttattggtaccgagattttccacagaaactcactaagcaccactttttgtaactatcccatgatactcattatacgtgccatgcacacggtcaatttctagtaaattagaaagtaactagcataatcctattatttatttaatttcaatgatgttatcattgaatctccagtattctagaaattctttgtttccagtgtatattcatatatggaataaaccactatttattttaaattatagcaattttagaaataacctcattattccaatttttcatgttctgcagacatctcacaactgaacttcccaggctacaactttaatgtggcaaacacataaccaaaccaaagtagaactgaccggactgtggcagagcacatggtcatttgttcaatcacttggtcattcaacaaacgtcttctaatcagctagaatatgtgccaaggtctggccttaacataagagatacaaagaggaataaactgtaaatagtcattgctctctagggcaaatctagggaggaattcagacaaaaataaatcctcatataataatagtagaaaactcaaaagggacattaagacggatctatcgactgccttaagccatgatgttggactagggagattatacactaggttcgtctgggaaaggtctggtgtacagctttgtcccgtgacctttcctacactttttattctcaaaataaatacattagcaatgatcttgtaaggtgaaacaaaagtccatcaggaaaacaggagttggcgggtgggaaatggtaccttatgaagagaacaaaggaaacaatagcatgggatatcagagaaactctagcaacacagtatagctggggtgaagagtatctctgggcgaggtcatcagggacaaagtcaattagagggatagacagagttccaagtgtcagggaccttgttggtcagactaagcaatctgaactatttggaaagcaaacaaggtaaccctggaggattcctgaatttcaatctagaatcacacactatacttttttttttttcaattttgcatgacgacttcagggaaacatgccaatgaaaaaatcaagttaaatcattacattaataaatttacttagtctaggatttggaatatttattgcaagtcaaactaacctgttagtcattgcatataaacaggttggctaaaatcaaattttaaaatgtagatatcaataggtagtctctgctctcaaagggcttacaatttccctgtaatcgtgtcacttggatcagcttacacagattataatcagaagcagagacagcagagataactcctgaatagagaaactaggttaagaataatgggcatagatatgtctgtgtgtgtatgtgtgtgttttagataagttactgatcttctctgagcctaagttttctcagatgaaaatgagaaccatgaagccttccttacagggtgaataatggcaatccaatgtaaaggagggggggatatttattccaggaaaaacgaacaagagaagtagaaacaacacatacagtgcttgcaaagtgtataataggccttcaagaaatgagaattattatgctatgtcacagtctgatctcattagatactctcaatggcctcatgagaaggatgagaaaggaatacatttctcccattttacaggcgagggcacaaagagaacaaaaaatcaattatttgcttcaaattatacagctatttattggaaacacttgggctcaaaaatatcccgtttccaagtctttaccctttctaaaatgcacactgtccgtgaaacatgccaaattgattttatcatcactaagatgaacttatccatagatccttgtgcccccaaatctcactgtctcagttcttgggtgcctcaagtccaagttcccagggcatctgtctatgagtaggatattcacagtgagtaaaaaggtaatgccataaaaatctaggtgtgggttagtagaatccaaataaacgatatagaacatcacaactcatattcaaatatgttaactaaagtaatgatttcctattacttagagtgagggtctcaaaatgttcctgaaatagatctcaaaatgtattccctctgtctagttgaaactttgtaatctttgaacagtaactctctattccctcactccacctcccaagcctctgttaaccatgattctactctacatctctatgaattcaacttttcttacattgcacatttaagtgacatcatgtggtatttgtctttctgtgcctgggggaaaaatgttcatgtacctcagaagtaaacacattttaagcatgtaccctatataaatatatattcacagacatatgtaattttaaattacattgacactagttttgtagacacaacttacacatcacatacactataaaatatacaatcaaaatattaatttctagagaacaagataaataaaaagtattttttctcactaccccaactgtttagcacgcatattattgggcatgtacattccactttggtaacaactgacctagataatcaaattcaaggtcgttggagtgacaaaatccttcataacttcactggtgtgtgtgtgtaagcgtgtgtgtgtatatgtgtgtgtgcttacaatccccactagattttaaactcaaaagagaaccaacaatgccttcatattttttcttctctctcttcaatctgtgttccctgagatccttttctatttggttcactggccctttaaccccaaagcagtttccactctgtggaagaaggaaatagtttcattatattttggctctgggttgtttcttcatttaaaaccgtagctaaagtccagaccagagaatgatttgaaaaccataccttaagaatgagtttttcctagtacagtagacataagaactctctggatgggggggagtcaaaaagaaagttggggaggaagcaagaaaattagatgcttgtaggtttccgaagagggggcctgatgtggcagtatttcatcagcaagaagggcaaaggcagattcactaaatttcttgaggcctcagagtgcagccagcaagtggctacatttttcctgtccctgaaaagagtgtgggagttgactgaggaaaagagttggtcatagcaagagatgcttaactgaaaagctgcatgggccatgcagtgttaaactcaagaaattgaggccttgagaaggggacccatgggcagatgctcaagagtaaagacattcagaaccaaggtgcagacaaaaccgtgcatccataagataacaatgtatacagacacatcccctgaaggccatacgtgcttcatgaacacttgggaactgggatgcctacacagaaagaagatggggaggaacaatcctaaatggaaaccaatgaagaaaacctgaaatcaatatggttatgttttctgtcttcaagtagaaaggggtcatgtccatccattcaaaagaatggctaagatgagattaatcttgcatttcccggatgcattttccccaagttggagtgtaagccagctctttggagctttagaactaagcatcatctcttcttccttgctgacatatgttctattgaacatcttttctcaaaatagacctgtttcgcccacattgaaaatctgtcaaggcaggtctctccccccttcctggtgatctccacaagtgttggaagggatgtcctggcagtcgtggacctgcccacttactgccaggtggtgccgattcaactgggcgcagagcccatatggcatctgtggcttgagacataagtatcatcagccacagtattccccaaattcttaaaaaccttctgctttctgagttaacattgggcttattgtcatctagtactgttgcttttattctagctgtatactcatatgtttgagtgttttgtttactgatacttcctcagtttttgtttctttcctgtacatcactgtaacagcagcacattctccacacattgaaagactcattgtctgtccttgagcatcatctctactgtcaaatgatagccctcgtacatgcatccactacattcatcattgtctcactatttatgttttgtaactctcattattattataggtcttcagtttctaacactttcaaattagcactgtcgttgaattaggcataattagatttaaaattttgctaaagtactccacaactaaggaagaacagggctccaagtggttaacattaactttggtgggggtatgataggagagtgttgacgaacctgtacttggagctagttttatttctatttaggctattactctctctttctccatgcttccctccctctctcccttcctccctctctctctctctctctgttcatatatatatatatatatatatatatatatatatatatatgtacacatatatacacacacacatatgtatacatatatacatacatatacacacatatgtatacatatatacatacatatatacatacatatacacacatatgtatacatatatacatacatatacacacacacacacatacacatacacacacatatatgtgcaataaagaactgcctgagactgggtaatttataaaggaaagggatttaattgactcatagttcagcatggctggggagacctcaggaaacttacaatcatagtagaaggtgaagggcatagtagaaagggcatagtagaaagcaaggcacctcctttacaaggtggcaagaaggagaatgagtgaggagggaagggggaagagccctttataaaaccatctgatctcatgattcactatcaggagaacagcatgggcaaaaccaccctcaagatccaattgcctccacctggtctctcccttgacacacggggattataattcaaaatgagatttgagtggggacagaaagcctaaccatatcaatgtgtgtgtataatttatttctggtagatgaacatgttcatcaaaatcaactatataatcacaatattaactgaaatatctgacttttaagaactttaaatattttagaggttgcctacggctgtacaagtaaataaattgatagagcacattcttttaaatataaaatgagaggaaatagtcttaattagattactacattttccccatggatgtgtcatagtacattctagaggaaaaaagtaattgattatatgaagattagaataggtatatttaacaagcaggtagtgtttgtggaaatgttctaagatgttagaaaaataagaataagatctactgtttcatagcacaatagggttgctatagtcagtaataacttaatggtacattttaaaataactaacagagtataattagaatgtttgtaatacaaagcacaaatgcttgaagggatagataacccattctccatgatgtgactatttcatattgaatgcttgtgttaaaacctctcttgtaccccatcaatatatacaccttcctcatgtaccccgttgacatatacacctaccatgtactcacaaagataaaaaacccattgaaagaaaaaacttaaaagaaaaatggaaatgctctaagagatgacgacaggtaatatacgtcttagtgcatttatgtatgtgtttatttttgcaagagatagacataactgtcagcccctggacacagctcagtggatagtgacttttgctaacacttaatggattccatatgttcaataaaaaatcattatgagaaagttcactgaaccttttatacaaactaaccatgcaaagctcaattcaaaaaggcacctaggaagtgaatgcaatacttgcatatttcctttgacatgaataaatacaaaggcattttattttaattgagttaaagcataatagtttctcttgcataaataattaaaatagaaagaaaaatagcatataaggagacttactgatatcaggcactgtcctaagtatattatatacactgaaatatctatcaaaacaagcctatgagagacgattattagatcaatttgagagaaaaattaactgaggcttacgtaggttaactcccataggttatactaatagtgatgcaataaaccaggagtttcacctaggcagtatgcccaaagcccatgtattttaatcattataatcagactcctacattacataccactgattttaatttggaaagataatttttttctagaaatgtttctcaatagtattttgttctaatacaaatgtgaacacctttaaaatcctaaaagtgttaaacaagttggggggtaataatctgacattctcccaggtaaggggatttcgaataaggtcttcctatggcatggcaacattaaagtcctcactaagcaacatgttatttaacttcatgacactgggaagagagtatttgccagctttagaaagcaaatgttaagaatctaaacattatcaaggggactattttgcttaattttgagctttcaacactaaagaagtatataaaggaacatgggtatacttcaatgattatgtaagggtccaggctaatcaaatcatcactgaggtggctattacacacaccaaacatataatcagaaaattgtggctcatgagaagtttaacttaagcccttcctattcaataggggatgtcttaggaccaggatgtttgatgatatccctgaaatcacaatgcctattaatgttaacagcctattaaaaaaaaaacctacacatatccttttatcgttattatttatttatttatttatttaattttttttttgagatgaagtctcgctctgtcgcccaggttggagtgcagtggcacgatctcggctcactgcaagctctgcatcccaggttcacgccattctcctgcctcagcctcccaagtagctgagactacaggtgcctgccaccatgcccagctaatttttttgtatttttagtagagacggggtttcactgtgttagccaggatggtctcgatctcctgacatcatgatccgcccgccttggcctcccaaagtgctgggattacaggcgtgagcctccgcacccagcctatatcattgttattactatcgttattactactattattccaatgttaatatggtgcccactgttttaaagtagaaatgctattatttaatcttcttgtgttcgtattcaataaagaaaaatataagtattatgacaaggcagtgatttggacaggatgtttcgaatgcaggcatgttgacatataactggacatgagccctgatatagtttggatatttgccgccactcaaatctcaagtggaaatataattcccaatgttggtggtggggcctggcgggaggtttttgggtcatggggacagatccctcatggttttgtattgtcctcagtgtagtgagtgagttttcatgagatctggtttttttttaaagtgtgtgggcatcaccttctgccatgagcaaaaactccctgaggcctccccaggagccaagcaaatgcctgtgccacacttcctgtacagcctgcagaaccatcagccaattaaactttttttcttgttgaaatataatgccaagtgttggacttggggcctggtgtgagatgtttgagtcacggaggtggatccctcacagcttgatgctgtcctcatgatagcagctgagttcttgagcgatctgttttgttttttttttttttaaatgtgtggcaacctccccctggcttctgctctggccatgtgacatgcttactcctgtttcatcttccactatgagtaaaagctcccggaggcctccccagaagctgagtagatgctggtgtcctgcttcctgtacaacctgcagaatcatgaatcgattaaagctctttttaaaaatacattacccagtctcggctatttcttcatagcaatacatgctaacacagacccaccctccccgtctgtccttgatactcttgtttttctgccgattttattcctattgtatctactctttgtttgatgttaagaaaatgatctttgcttcaaaaattcaaattataatcctgcaagctctttgatataagtgttcaatttaaattaaaaaggcaaaaccaaaataagactaagcataagaaaataatacactttcccttagttaccagagtgatatatttgaacattttaaatgctttcaaaaaatcaaatttctaaactgttacctctacttaatcccacagaggtgataaaattattggcaattgatgatcatgtggataaattgactgacaatttcattcatttattcattaatagctcctcattgatgtatgtatcccaaatgtctcctttccttctctcaaaggggcaagcaaaggaaatggaaactgtaacagtaaaagccatatactctaaggtggacattagaaagtctcttggtctacaggtcgtttttaatcctaaagacagaataatctacctatatagaaatcattaaacaaatagaaattttgccttataaatagtaggaaaatacatacctacatttatggcctgaaaaccagcatcagctatgttatagttgtccacatagaactaatataatgtactgggtagaaagtgaccatttttctccattttgacccttgtcatcactggaagaacatggattccattaaggttcccacattcattacccttctcctcacacagaaatgcaaacattgaaaagtttcttcgtggagagttctattttgttttgttctttttgcattaaaagttcaatactatttattcaagtttatcaagctgaatgaacaaatggcctattataattgcatttcatattttgggcccttaaatttcgaaatctacgtttccaaagagaaagttaaaaacaggggaaaatgctgctaaattatttgatgagcttcatatttgtgatgctctcattttagttacattaaggcaaaaagccaaaataaaatcccaaggcttggagtttgaaacaagtggtgaaagggaagggagcattgataagagaggcaggaaagatagatttaatggcattttttttgttttaaataatgcttaagaagaaaaattatgtttattacactcagtttatttccctgtggaagaacaaccttttcctctcctcagtctggaactcatactctttgccacatgacctgtgggaaattgacttgaacagatgttttggtttcacattaaatctacaaattattttgcgtaattccctagtgcccatctactataatttttatgatgtctctactctttgttttttacatactatgacaaaagagtcataagacatagtgcctagtcagtaattggctcactgaaatgcttagagtttatatatttgtaagaccacacaaaatttcaagcaggaacctttcagttatcacaatctttattaatactctcttgaaattgacactttttaggcttcatatgccaaaaaacatgagagtaataattgaccttatgctttaggacatgtttcttcttaaatacttcttattttaatattagtaacaattctactactaataatatctatggttcattgaatgctagtctacataggtgcatagatacctggatatagatgataaatagatgacagagaaagagaaagatagaaacagagaaatatttttactttgaatgaaatacattatctctcccatcctaataaccaccttccaagataagttcacatcttattattagagatgagaagatttagttttaacaatagtgtttgactgaacttgaaatacacaggtgtgtaaatattaaaacattaaaacattcctaaaatctttgcagataattagaaagagtctagcaaacattatctgtaataaaaacatatatatttaatttggaatgtgctttaattttgtggtattttgtgaccactctgttccttgtcccttgcctgtgattagtgaatatagagtgttcatttattgacacttttatccactatctctggaggacaaatgtgaagtagttgccaagactctactttaggcagtttcacatatcattaaaacaaaaatttacagattatgtatttccatgaaatatgacaataacaaattggaaggctgagggctaattttacacataattttgcaaatctgtttgttaagaatgagtatgcaattcatacattgacattctggtagttcatcagtttataaaactagtgaaatggaagaatgcattgaaatttaattgttggtatcttcacacttttgctgactatattaaaacagatacattgaactgagtggtcccgcctcctaataatttataacatcttcagtttctgccactaatatttatcattatcttatgaacaggtctgtgcattgaaataataataaaaacgataaggaaataaatagacataactattatttattcagtgtattattaagtgtatgatataatgccaggcatcctagatatatcatctcatttactcctcacaatgaacctattaagtagatgtccttgtgcctattttaaaaatgaggaagataaaacgtacagaaatttaacattttgcccaagattgcaaagcaaactaaatgcatgaacaaggatttgaactgtgtttttttttttcatctggaggcctccgttcccaagcatgcttttaaattttttttttctcttgacacatatcataaggtttcttctcatttttcacatcatatcaaccagtctctttgctgttcctggaacagcatattcacatctctgggcctcggctcttactagttccttatcctgactcatttctttagatagtagcatgtttcattccttgacttgatttaggtctctgctcagatgtcacactctcagcctcctctcttcaccactcttgctaaaatactgcttccctttttcctttaccctgatgatttttttcatcgtacttttaatctgatattttatcatatttattgggttctttgcctcccctgctaaaatgtaaattccacaacaaagggacgttgttttctttatggatggatacctggtacctgcaacaaaacctggcacaggctgattgactagtattggttgaataagagcaaaaatgaatgactactgagatttaccctaaaattttcaaatattttgatgtataaaaatagtctatgaatgtaaccaaactgtgtggacagaggctgatggggtctcaagtggtgtgtgtatgtgaagggtaagacattttagaagaagtacctatgctggattttgaaactctgaaaggacaaacgaatggagggaagaaacagtagactgcgggatacttgagaacgagaagaaacaaacaaacaaacaaaatgaatgaaagccactgtcagttcttggaacacagagttgggaaaatgtattatctatatctggagaaatactcaagtcaggggaaggagaacagatgactggcaatgaagggacctcaaagcaaggtctaattgagatttgagacaacagcatgcatccacttggagttcttacaaagaggaatactatgttcaactgactcgtacatttgtaatacgtccgttaaaaaaaccctattgctattggaaatgagtatggaaagctttcagaatggaagttttattccattgttggtaaggggtgcaataaattattcatgcataaccgcaactacaaggaaatgggcataaagaggtgaggtaagtaggaataagtgctagtgcatatataattactaaatggaaatggtttgacaagtctgatacaaaaaggctctctggaccccaatttcaaataaaagacctgaagtgatacatttattccttatcccttcagagtctccattttctataagcgagccccctccacaaacgcaccattaaacctgtacaatctatgacaacaatgggaatttatccaagatgtagacgtagaagtgatgggtcaaagtgatccacagttcacatcagataccattaagtgtttttatagctctttacctcctctagtataaggactcaaaaatacagcttgaatgatccagaaaattgaaggtatcaggctttagtgatacctaacaattagttggatgaggttctgcacttgaagggcacttggtttttcaggaaggaagattttttttcagtaatttttgtattcttactggggtgttccttacactgtattccatccctaagaaaatgctactttttcattatcagttgtattgtatcttgacatctaattggcaatacaccacatttctctataaattatctcgtttaaacagttactttcctagttaagtatatttaacaacttagattctgacagttttttaataaacgtattttggtatttttaattaaaatcagtagagtataaacaaatagaaacacactaaagacaattatgcattttaataaaacaaatgtgcaggtccggaaatgttcatagactcttgattttatttacctttagtattataccaaatgtgaccagtcatttttcaaatttgagcatggattatgttttttttctgcctatatcaaatagtataggggtccaaaacaggtttttagggagttattaagtctatagaaaattatgcttttaggaagtgttgtgcttatgccaagtgggagaagcataataataaaatacaaagtttacaaattatactgcctaggttatacaattactacataattgaaaataaaatttaactgctgtgtacatcatttatctatatcaaagttacctatgcttaatttgaaatcactgtaataatgctgataaatgaaagaattgaattgatttctacattaaaatgtacaattaaacctgctaaatatgcaactgtactttttatatgtgcctttattgtagtaaggatagaaattgttgattgtaaatgtaaaccttatgttctataaggaatgatttcttaaaaagggagtctattacaatcagtaatatcataaaattttaaagataatagatgtttttcatccagttcaaaatgcttcaccatgtgggctttttgatcctatctttaaaaacttttgtgtccatgagaagtataagttaggtaagttttctaagttaactgaaataaaaacacattgaatttcttaaaatcctagcaaaatagtgtaaaataacgtacctatagtcttctctggcacatctttatatgaataacgtgaatcatgtataaatatccttgaaatatgtatttcatttacattgcctcaggctaacttcctctttttttttttttccccctaatagagacaggctctcactgtgttgcccaggctggttttgaactcctgggctcaatcgataatcccaccttggcctccaaaaatgctgggattacaggtgtgagtcacatcacccgactttcaggctgccctcttgatcacacccacaattactgattttttttcaaatggaaatgtattttctaacataaagtataggttagacaaatgcacaccaaatgttaaattcccttctgtgtctagtcatctctgtaattatgaagagacaaagtttaataatatgaaagctgatgaagaaaaaataaccccataatttataaatgtgcattccccagagtgaaaatggctcttggtaacttcatttttaatttcaattatgtattttatataaggaaaaatcacaaaataggctgcttactgtagtgttgaaatatagtgtaatgatagaatgtaattttaaagaaatgtttaaataaataatttagaaaactaaaaatggcctactttttatgatgttaagtatatggaatgctgaattaagagagtaaatttttcttggcaaatagtagacacactagatataggtgaagtgaatgaatatgtagaaaatcagttccttaagaacggctcaatgatgatatttagaatctagtgataattgaaacttagtttaaaagtgaactaagataactaaaatattttcatgtgcttattcacataatcaaggcataggagttaagggtctcctgtcatcgacagccctagagaagttacgaaagacaaatatgagacttttaatgatatcagatattttggggcactgcactgtcatccttttaagcaaactagattctctctccaccacaagcaaaccctaagtgggagatgcaagtacaccttgttctttaaactctggatctttgtattcacaggacaacattcaataaggccacctgtccattgtaatggagatcatgaaataacctaagtttactttttgaagtaatttgggaaatgtagaaaaatatgttcccaggaattttcgtattgggtagaaatatatgcttttctgcaagtgcagtataaaagtatgaaaaataggatggagtaacaggaaaataagttttcttagttgggcagaccatctaggcatagaacctgagtaagtaaattcccccaataattaatcttaaggttcacttttcacatagaagttaagtcacataaagatacactcttgctcctctagctattaaaccaaggtccataatttttttttttacttagtttccactcccagggatatgaaatttagattcttgaccccaaatgaatcttaacacatggatgaaacacttcaaaaagtatagtttctttcctgtttcaccagtcacctgaccaaatcaccttatcaccccttaattcaaaattgattgtgctctctattctagacttcgagtgacccatattttttgccatttgtatttttctttaatttcctagcccactttaccggtcttctcattgtatgttcagaataaaagaaaaggaccacgagaagaatatcctttatggtactatatgaaaacgtggcatgaatatgacttgactaatcatacaaaaatcagtaacatcacactactgtccacagatattgggttagtcagatttcattagtttagtcaggtaatcgagaaacctgcttgaaattaagtgggaaggtgggcacaacgataatcaaattttataacatagcatactgaaggaaatctaaagctgacattaattggaaatgaatgagagtagtagatccaaatatctgcagtaccttgagcagcaggagatgaactgtaattgtcataggccctttaattacgcactgaggaacaactccaccaaaacatcactgctccagaataaaaacaaactataaaaggagagttgcaatgcctctttcttgatgaaagactttgggaagacttgggcaataaagaatactcataaattgtgagtttagtttcctgaagagtctttccccttctctcttgtctattcccacaccactgctagatttatcttcctaaaatagttttagaaacttgcacaattgaaaatacaaaattgacaatcagactaaaagaaggtgtaatagttaggtcacgcattcatggatcttagaatgggacatagtggtcaatgaatctaagaagctctcaaatgtagaattctcatctaagcatccctaacagatgacaagtcaattttggcttagacagtttcagctcattgctttgtgatgctcaaaatactatggagaatagctacaaggaagttatctcgtaaagtatgctgaaacattctttcctatacttctttttatcatttggtcctgtagtagtttactagatcaacacagaatgaatttccccctcaagaagtatatgaataagggaatgatacacatcagaaaaggtacatttcttcactttgttagctcttgttcactacttttagcacagctggcaaagctcttaatgtcatgcctctgtctactttcctattacagaggcattgttgttttttctcgcccactctcaagccacacataccactctccagtcctaaatatgcccttgacttttgtcactatgcctttgttccctctgtcagagatcttccatgttctaaatgtcttcaaagacttctcacccgttaaggttggttctaatgacatctccctgtgcaatctcctaattgcatctttgttggcacacacacatacgcacaaataatatatgctttgttcataaatcacattttattctgcttaaaatagttctttaaatcttgtccatgttcctctccctagttctgtaaaccttttgaaagtaggatctataccttaaggtcacctaattttttttctcttttttaaaaaaagactatatacctaaatcaaaggggggaattaaatgcacataggaaaatattgattttgtccattagacttctaaatctatacacaagaagctttcattattcacatatatccttaatcatattgtatatgtggggtatgtgtgtgtgtgtgtgtgagagagagagagagagagagagagagagagagagagagagagagagaagaggactgaggaaccaaaaagaaaataagtcaggagcataaggaggtattttcttcttttttttttttattatactttaagttttagggtacatgtgcacaacgtgcaggtttgttacatatgtatacatgtgccatgttggtgtcctgcacccattaactggtcatttagcattaagtatatctcctaatgctatccctccaccctccccccaccccacaacaggccccggtgtgtgatgttccccttcctgtgtccatgtgttctcattgttcaattcccacctatgagtgagaacatgcggtgtttggttttttgtccttgcaatagtttgctgagaacgatggtttccagattcatccatgtccctacaaagtattttccttttctacaaaaaaattctaattgacctgtgcacattattttcactttggagaagtgacttctcctcaagtaagccataacaagtgtttgccaaagctagaattagctaaccacttgctcatttgcttacatatccccgaggcaccatacaggacattgctgatactatggaaatgacctacagaagtttggacatttggtgaggaccatttttcactttttttcattcctttctctatgtgaaggaaatttaatagtattatgtattctttaataccttaactctttctctaatgtgtgagagaggggagggaagggaagggaagggaaggagaggggagggaagggaaggggaggggaggggaggggaggggaggagagagagatcaaaggacaaagaaaataaccagagatacaaggatgcaaagagaatttcctttttctacttccaaaatctagttattctgtgcaaaaacgttaagaacgaactttggaagaaaactatgcatggtgaaaatgctgctgtttaaaaactacaacaaaacagcccatcatagagtagaagaaacaccggcctgggaggacaagtgcctgtgttctatcacagagctaatgttaacaagctgctcattgacgaaaatctcgtcccttatatcagactcaatctcctcattcataagatgagaaatttgcactagattatcactgaaatttgctccacctctaaaatgactagggttccatattctggtaaattaaacagagtaatgttttaaattaaagatattatcacaggtgtgtaatcttgcctgttgagcataaattaagaatattttcaaaacgatgtgacattcaatttatagtaacagattcaaaaagcatatttaaaaataaattatagctagataggagaaataagttctagtgctctatacgactgaatggtgactatagttagcaataatatagaagtttcaaatggctagaaggagaacgttgaatgttcccaacacaaataaatgaccaatgtttgagataatggatatgctaattaccctgatctgatcactatacattacatatataaaaacatcactaggttctccatgaatatgtacaattattatttgtcaattaaaaaaattcttcaaaagtaaacaatgtaaaatagtagacgtgatgtgaggtataaggagaacttcccaatcaattttggaacataaaacttcatttctgaggcaaaggaagaacttgacattttatataacttctttgccagaatccagtggctctactatttttctgaagaatgcataaaatcacagtatcatgatactttggaatttaggaggctgctatactgagtttagtcctgtctgtttgtatctaacaaagaaatctttctttttctccaaccctcagtttctccatcttggaaataagaaagttagatgtaatgataacatgaatgtccttacctcttaatctttcagttttatgtgatcatatgagtatcttctctctgatcaagcagtctgcttagtgatttgataaattaaatgataaactttcatttgctttgaagtgttttttattttgtttttgtcactataaaaataattaatttttgagtatttacagcattgtccttccaactgctaaagaaagtcatgtccttgccattttcttcctcaaagacttagaaaaagaaggacaaactaagcccaaagttagcagagggaaggaaatattaagattagatcagaaaaaagccaaaattgaaatagaaaacaatagaaaaatcaacaaagctaagagtttttttaaaaacaaatcaataaaattgacaaatctttaggtagattaagtaaaaaaaaaaaaaaaaaaaggaaaattcaaataagtaaaatcagaaatgaaagaggagacattacaactggtatccaaaaagaatgcaaatgattataagacactgctgtaaacaactgtatgttaacctagaaaaaaatgaacaaattccttgaaacatgcaatctaccaatattgaatcttgaagaaatagaaaatctgagtaggccgaaactagtaaggagattgaatcagtagtccaaaaccttccaacaaagaaaagcccaggaccaaatgtcatcactggtgaaatctaatgaacagttaaagaagaattaacaccaatccttctcaaattcttcagaaaaattaaagagaagagaacacttccaagctcattctacaaggggcatcagtatcctgatatcaaagtcaataaaagacactaggagaaaagtacagaacaataccgctgataaatatagaagcaaaataactcattaaaatactagcaaactgaactcaacagtatattgaaaggattatacacgagagccatataggatttattcttggaatgcaaaaatggttcaatttatgaaaactaatcagtgtgatacacaacattaacagaacaaaggctaaaaatctatggtcatctcaatagctgcagaaaaagcgcttaacaagtttcaacactttcatgataaaaacacacaacaaactaggaatagaacgaaattaccgcaacataataaaaaccgtatatgaaaaacccacagtgaatatcacatttaatggcaaaagactgaaaatcttttcccttaagatcagaaacaagacaagaatgcacacttttgccacttcttttcaaaatcgtaccagaagtactagccagaacaattagataagaaagagaaataaaatacatcaaatttggaaaggaagatgtaaaattatatctgtttgcaaattagatgatctgatacgtagaaaatcttaagagtgacgccacacagagacatggttagaaccaataaacaaattcagcaaagttgcaggatacaaagtcatcattcaacagttgcgtttctatacgctagcaacataaaaacaggaaatttagaaaacaatctcatttacaatagcaataaaaagaataaataacttagtaaatacccaaccaagaaggtaaaagatgtgtgtgctgaaagctatgaaatattgttgaaagaaattgaagatgacaaaaataaatggaaatacatctgatgtgtcatttaaaagtctatatatccaaaccatctacagatacagtgtaattcctatcataatcccaatcgcattttttacagaaataaggtaaatttcctaaaattcatatgaaaccacaaacgactccaaatagccaaaacagtcttgaggaagaagaataaactggaggcatcacacttgctagtttcaaaatgaattaccaaagctacctcagtcaagagcgcacgatagtgtcataaaggcagacatatagaccaatggaacagaatagagatcccagaaataaacctagcatcaccttcaataggggtgccaagaatacacaactgggaaaggatatcctcttcaaccaatggtgctgggaaaactggatatacacattgcaaagaatggaattggacctttaacttaaactatacataaaaatcaactcaaaatgaaatggagtaaagacttaaaaataagatctgaaactatgaaactcatagaagaaaacataagggaaaaatttcctgacattggtcttcacaataattttttttggatatgacgctaaaaggacagccaacaaaaacaaaactagataagcagaaatatatcaaactaaaaagcttctacaaagcaagggaaacaatcaacagaattaaaagcaacctatagaatgagagaaaaggtttgcaaaccatatatctgataaggtgtcaatatctaaaatacatgaggaacgtaataacaacaacaacaaaaattcgaacaacccaatttttaaagtgaacaaaggaattgaatagatatttctccaaagaagacattaaaatgaccaacagttatatgaaaagatgttcaacatcactaactaccagggaaatgcaaatcaaatccacaatgatatactacctcacggattaggataaccattattaaaaaaaaaaaaaaaaaaagcccaagatcattacatgtgttggtgaaggtgtaggaaaattggagatgtagactgctggtggaaatataaaattgtgcagcttttgtggaaaacaatatggagtttcctcaaaaaaataaaaaatataactaccataagatctagcaatcccgcatctggatatttatctaaacgaattcaatttaggatcttgaagagatatctgcattcccatgtttattgtagcatttttacagtagccaagaggtgtgaacaaactaaatgtctattgacaggggaatgtataaagctatgttatatacatacaatggaatatcattctgccacaaaaaggaaatcttaccatatgctacaatgtggatgaatcttgtagccattttgctaaataaaataagcaagtcgtaaaaggacaaatactgcacgcatccacttacatgaggtatctaaagtagtcaaaattatagaaacagaaagtacaatggtggttgctaagggctggaggagggaagaaatggtgagatgctgtgcaatgggtatagactatcaggcatgtagggttaaaaaaattataaagatctgctatgcaacattttgcttatatttaacaatactgtattgtgcacttaaaatttattaagagggtggatttcattaaaaaaataaaaacaagtgcttcattaagaaaaaaacatctttttcaacacatacaattctttgttaatgaacttaatcattgaatgccaactggttgggaaatggtatacctgacaacatagaaagccatcagacagctaacatggtatttgcaacttctcgtgagggtgggagcaccataaacacatatatgaagagataataaaagtccaaggcaacaatataagatgtagcataagtgacctcgtaatgaactgaaatagatattaagttgatattaaatgttgtgtatcaacggcagtgtgagatcattgtgaactagaatagtgtagcatatcttttggactaaggtagattattccaggctttaaattccgaaatatttagagagtaagaaggacatagagagaccattcagacaacagttgcaacggaagtagacttgaaggccagaaagagctcagcatgcacagggataaaacaggaagagcccagtgctaaggattcactcaggggaagggtgggtgataatactggatgcttaagttggtataagatagtaagatacctgaaatatgaatctgatgttttagttttttaaagaattttacaaaacagatttttaaatagctgtagagattcaaaagagaaacgaagcagttgtacccaaaagtaggataataaagatctcttgattgtgttaaattataaatgcatactccatccatagggtgatgccaaagaaggaggaaacaagtagtttgttatttgtcttcaatttatgctatgcttcttctctgtttgaagaagttgacctgtctgctcgaaagccatatccagcagacccaccgattacttgcacagtgacagaatttaagggtcaattatattcatgaactaatttatttccactgagtttactgatgaccctagaaaatttaagcggtgacacaggactgtaaattctttgttgcattataaagctccttcaagaaattaaaatgcttaagtgaaaataatgatctatccaactttgagtggtttccctacactttttagtgatcactttctggtaagagacctagaaaaaaactgctgaatgaatcctcaatttgtcaattttttggaaaaccaataccttctacagctattgaaaattcagagggcagtttgcaagaaacttaatctatatcatccttcctgcaaccttaccacagccatgattttatcttcatttaaagcacgagattgaaagatgcattgtgagagaagttccggtttgctacttccttcattgttatttttaatctttgagatatacaataaagcatcattaacctgaaagaaagaacacccctccagaacacacagtaatcaatggcaaagttaattggaattgagttcttttaacaattccaccttagcaattctacaatgttcctagtgatagacagttttaatcaaagcttggagtatttgaaaaagagacaaataatgtaaggaaggagataatttgtgactaaaacctagtctttccactaaggatttccttttctttaaagtttcaggtttggagctgaaacactttttgagtagagaagacacaggatgggacagtggttgaaaagaagttggtctgggtgcaaatcccaactgcagcatgttagctgagccatcctggacaactcacttagcctctctgtgctccagcttctttgcctggaaaatgggaacgataataaaacgcactttggcctggcacatagtaagccttcaataaaactatcactatcatttttatgaagcaagataaagcattcttcttgaaccacttctctacattttttttctgaaaggttagagctcaatgagaaccataaccccaggccagggcagagtaaagaaagatatacaattcttcagatctaagcagttgtttatggatacctcaaaatgattgtaatattaccaacatacctaaaagaaaagacaggtgggtcaggctagtacatgtttacttcctacactgaaagcattttgattgatgctattctgactcttccaaattttaatggctcctgttaaccaatttcacctgcacactgggctcgtattcctcatctcagctggtaagaaattaaagtgtctcagtacgatgacaagaaactactgagcaggccattcatcgttctgaaaacagtatgaaacagctatcatcatacctctataaattaaaatgttattttctttctacagttgtgctctgactacaagcatatcggccattcctggtggggtccagttcattatttcagtagacgtaaataatttttagcacaggtatttgaaattagaaggcgattcagcattggaattgagaattgtccacaccactgcttataaccttggaattaagaaatgtggaggtgccattgttccctggggtcatttccatcattctgtaataggtcttttgtttttgttgggactgttgtatttgccacctttggtcaaatgaatctgaaacaattctatagctagagcaacaccacgaaagattgttttgtcactaaaatgatgagctagaaaggaaacgcataggaaaaacatgctcagccttcctatagctaagaaaccaatgtacggaggccagaagagtagttcaagttcttcagaagcacatgaactctttattctaataaattacagagtccacatgtgggagatgcttcactatttagtgaaatcatttcacggaataatatagatcaatgtttctcatgctgatttctccaggtcttagaaatctgaggtgtcagttttaaaatctcctggaaaatatgtgtacacatattcagggtcattcagctcaactgaaactgatagctgattacagtgttcctgctttgttgatatttataaggtctggcttcgtatcaagcagttatgtaaagtgtaaagaattggtgagaatgaacattatgcaccctccatgaaagaagaccaaatgacaaccaattgtatgaagaaatgttaaacacaattagaatggaagaaaacaagtagatgaggagttagtgaatgctacctaagaatacagatattaacctagaaatatgttcttgaataattacgtgacaagagctagacacagaataaatatatcatataatttcatttctattttaaaaggaaagtttatataaaattctatatatgttatatatattaaaacacgttcatatgaatacagataaatgtcttgatgtgaatggatgattcacatgaacacttaagaaagttaaatggggcaaggcagaaatgtatcagctctttatacaatactatttttaatttgttttaatgagcatgtgttacttttgtatatcgggaatacgtttcttaaaaagtataagtaaaaaggattttagaataaatggaagttttaaaacaagcagcttgccatatgaagaattcatactagtctttttggatgaatgttttaaataggttaacacgctcagtaaaatttaatctgcacaaatggctttgtcttacacagagaggatctatgtggaaaacagaaccaaaagccagtccaaacaagtaaaacagaaactgaatgtagagttggaactgatattcaattttggattagaaactgattattgaaaggaaaaaaaaacacagtaatttcagatctgctgtttcagtaaacctgacactaatctgagttttttaaaaaaattaattctgacaaagcttgagataatgttttaatagtgagtcactacaaagtaactattaagtattcaacattcaattaagtcaattcagcttttgatgtttcagccaggtaaatgctcaacatgtgtggatataacacatgttatacttttccatttgtgcagaattttctactcaaataatgttttaagtatgtctaacacacacacacacacacacacacacatgattatatatccatatccttcaacaaaatctgaatatgccttcactataaatcttttgattaggttagaaaagacaatctatcctttggagtgatcaattgcctatgagttttgtccccctcaactgctgcttagtccataaacggaacctcagaagttctgctggaagctacagttgaagtctttctataatgttctcgttgctaagactttagagctagccatagaaacaaactgcaaatgttatttatgctttatgtagtaaaatgataacctgaatataagactgggtctcgattatttgtttcatttatttccacactccaaaaagtctagatccacaaaatgcaaacctaggattccacgcacaaaagggtgcaaacacgaacttttatgattctcatatctttcaaatatacttatgaatagtttattactatgggacaggtatggataagtgtcgatttctttactttttattattttttgtaggtacatagtatgtatatatatttgtgggttacttattgagaatccattcaacgagtatacaaagatcgcggatattaaaactgaaaagaaagacaacctggaagttaaaatgtttgacattaagatttactaaacagaaagtttgcaaaatttcacaaactatataagttcatctgatatgatggatgcttccaattgtagaatacagaaattatattcttgagtttacattttaaacttgtgagatgtttggactgaatatataaatagaaatgacttaaaaattttcatgaatattttcagtggatactattacaaagctcaaagtggaggttaaaagttttgactcattcgatttattctcaacgaatgaattatctaatatttcaatgtatatgagataaacatgtttatattagaatgtcaccaattgactctttaatatataaagccttaattatgtttaatctataaaaccactaatgttagagactattcatcacatattcactataagataaacactatggagaaattatgcataaatgtgttacattaaaatactattaaaaagacaatttctatgtgtgtgtgcatgtgtgaagaatcattcgtttctctatccacttgactacttgtcatttctctgttatatctaagtgtaaaatgcagacataccagaatttttgcatgctgggtttctgggctttctaggtgataaaagtgcctaattattccaaactgttagatcattaatcctagccacaaaaacatctacattaatttaaaccttggcaaacgttaaacaagtaaattacgaaagtatgagccatcatgtcctacttctcttccattgtttctcagcatcttaaaggattttatttacaaaaacttagtaatcccttaaatacatttcttcagtatatctgaatttcctgtttgttgtgtgtattgtatgtgtctgtctgtatgcatgcatgcccatgtgtgtgggtatatggtgagctaaagaggcaaacagtatatacattagctaactacaagttttctacccaaattttcccacaggccacactcaacccattcttaaaatgttgcttaggcattcatcttctccttcaggataatgggggaaaatgcttatgctttttatttgcttcttgtagataatgaaaattttattattcaccctagcatgctatcgatgcttcagctgatcctttaaacatctggcctactgtttaaaatgcatggagtgaactgatgtcagcccgtgctgataatcagaggaccttcaattaagtacctacgaagcaaccaatgataaaagagaaaagacagtgcaagtttgccaaagaattctttcatagtctgattctcaaaagcaattagaatcacttcttttggccttggaattaatgaattttcattaaaatttaaatttcaaatgattccaaggatatcaaacttgagaagttgagctgattgtctacgtaataaatcacaccacaggaacatgtcaaaaagactaatgcaagttctttgccgtccaaagttttgtttctccttgtcagtgctatgtgaacatatataattgctttcttttcctggaagcagcttacccaaagacctaccattattacactccgtatttctctctgtttagaatttttgaaatgataactccaagattaattgaaactagttcaagtctacaaaacaagtttgctctcataattgaatgtgatatgatttttataaattgctgcagttacattcttcacactgtaatttgcttaaatgaggaaataaagttgaacattctaatatcaacatatcctgtatttgaaagtgacatttaacttaataacacagacattgtctttacttgacagaaaacaaaatacattggatgtttgtgtatgtgtaaagtaagtgttgtattttggactgtacagaagtataaccatgaaaagtgctaaacatctttggccatagaaagcaacacgggtgttttgaaatggtaataaaattgagcaataaagcagaaaaataatattcatataaaagtggtcttgtctgtggacgttaaatattttaatcttgaattaaaacagcacaacacgtaagtaataggcacattttgttcactctttaactcattctgacaaaagtatgtgcatgttttcaataacaaatttcacagtacctctttctttcctcgacagtgaatcttctttgtcaggaaaaaaaatctcaacagtctaaagaagaattttcttaaacatgacatatccatatcaagcagccatgaaggaatgtttctagttcttactgtaatatttttcttgccatgtccctcttcacaggtgtactttgaatcagattgattaacttatcagtggtttaattgttcaatatttgttccatgtattaatattttataaaggattttgaacctggggcaaaacctctgcactaaatttcccccatccatcgatcttttccaactcagcatttcaacagaacttaaatcacaggggtgctggcttataaataaatgtataacaataaataaaaatagatgattgtggctttaagatatgttcagagactggaagaaagagcagaagtccccaactgaccatcgaactgttctaatgtccattttatttgccccacatagtgtttaaatatttcagtatatagtcagcttggaacctcttgcatagatagcccttactacttcatgcttttctgttacctgactacccatgtgtacattttgttttgcaacacctgcattagatgctgacatgttgattatattgtattatactgacactgcatgcctagcctcatctcgtccctactttcacagctgagatctagagccctgttgcaaaaacattttaacctctgtagagagcagggcgtttttgtcttccgtttttacttgtaggtatcattaagtcccctatatatttgggtgctgaagagataataataatgaacacacttacgaaataaataaatcagctcatcatatggtgactggaattacttctgtgcgcacaaactaatgctaacatttttcggatgcacaaaacatgtcagtacatagttaccaacgatggatggatagaaatattgttttagaaagtctgagttttaatataaaaatggatgagagaaggaagttcctaaattcatacaaatcacctatagtggaaatggggatatgtagaaataaaataaattaagcttaatatttagtaatacagttaaaagcaattcaatatataacccatggattgggatgatttttcagtctactgcttacaatttcagtattaacatgctcttctcacttaaaacattagaaaaataggttaaaaattttcagacacatggacaaagaatgtttttatctttctgacagattatcagaatatgtaattattagttcaataaataaagaagtgactggtaacaaaaatgcaaaagaattcacactgtgatcaaagcagaataggatctccgacatgacttgatacaaagaatacacttccaattcacccaatttttatttttatgtataatacattagatacttttagtgaccacgaatatttatatgacatctttttttttcaacttttaagatccagagggtacatgttcaggtttgttacctggatatatggcgtgatgctgaggtttgggatacaaatgatcccattaaccaggtagtaagcatagtacacaataggcagcttttcaacccttgtctccccctttcctttccccttctattagtccctagtttctactgttgccatcttcaattctataagtacctaacatttagctccaactcataactgagtacatatagtatttggttttctgttcttatgttaatttgcttaggataatggcctctagctgcatctatgttgctgcaaaggatatgattttcttcttttcgtggctgtatagtattttatggtgtatgtgtacaacatttactttatccaatccaacgttgacggacacctatgttgatcccattactttgctattgtgcatagtgctgtgacaaacatgtgagtgcatgtgtctttttggtagaaccatttgttttcttttggatatctactcagtaatgggattgatgggtcaaatgatagttctattttaagttctttgagaaatgtccaaactgctttctacagtggctgaactaattaacattcccaacaacagtgtataagcatccccttgtctctgcggccttgccagcattgggtgtcttttgactttttaacaaagccagtctgacgggtgtgagatggtatctccttgcggttttgatttgcatttctctgatgatgagtgatgtgacgcatttttcatgtttattggctgcgtgtatatcttcttttgagaaatgtctgttcatgtcttttgcccattttttaaatgatgttttatgatttttgtttgttcaattgtttaggttcctcatagattctggatattacaccaccgtcagatgcataacttgcaaaagttttctcccatttggtgtttgtctgtttactctgttgatcatttattttgccatgcagaagctctttattttagtaagtccttgcttgtcattttttttttttttttttttttgcaattgcttttaaggacttagtcaaaaattctttcccaagccaatgtccagaatggtatttcccagattttattctaggattcttatagcttgaagtcttacatttaaatctttaatccatttcccaatgcttatttttttgttgactttgtcgacgaacagttggctgtagctgtgcagttttatttatgtgttctctattctgttctattggtctatgtgtacatgacatcttggtaggatttcaaacctgttcaatgccctaaaaaaatataacttttaagtgatttgaaaaaaactgcctgctaaatctaaacttggaaactgcctacttaattctataatgagaagggtaatctcagcataaatttcaaaagttaggctaaactccatatctacttgacaagtaaccatgagcttaaatataatctgagatcacccaccataatatggaagtgaggtaggtgagattggatggtttgggagtagagatacaatgttataaattccgaattggaacatattgacctgacaactgggtagaatatttgcaatcaatattgttcagagacattttagtcatttggcccttctgtaacagagtcatagcccaatccttatcatgaaatacctgggacaaagtatctgaaatgttaaaagtttgggggacgtaattatggtttgtggtggaatcgtaggcatgtatgtaaaatcatggctgtccttatatttgaaattctatttacttccttttggtatgatggcattgaaaagaagaaatgataagtgtttcagatggtggatatcccaattaccctgatttgatcattacacattatacgcttgtatcaaaatatcactagaatcttagaaatatgtacaatctctatgtatcaacacaaaaataaaataaaagctaaatctaaatatgtttctttagaaaaaaggaagaatgtcagatttttaaaaggtaataataattattttataggtaaaaatatttttctcatatacataattatggtagaattgagtgttgaatacaataaaatattctaatagcaatagatttgtgggcactgtaactttctcgaagcagcagagaaagttctgtaagtctccaaccaagttttatctatgttatgtaagggttttgaatgcttttctataacatagtttgatcttttttcatttgaagcagtaaaagaaatttcaatgaagcattttaagtatggtgatagattaatgactgcatacaatttcactcatttaattttatttcaccaaattaggcttcaaatcctccagaccatctgtgaatatctggttgacttgtcagagtgcattttgcctgagttcaggggcgctgtgaatttctcactccaatttaaatttaggacctctgaacactgttcttctatatttgacatctgatgggaagacttggataagcaaaaacacattcattacctgcattccagaaattaaaccatcagcaacgtgttgctacattttcaccctaaattgacaaggaggacattataccacgatggaaaaaacacatgagcaaataggctaattaggtgctattggtttagattatctgtcagcagcaggactgtaggtagccacagggagtacaggcaggggaggaaagcaggcttgatctagattcaagcatgaaaccagcactctagaacatgatgggtgtaatctggagcagataaacagaacctgtttcatgatagcatttttgatgattcaggccaatcggatggctaggaagcaggcgctctccccaccccgctcaaactgctgaggaaggtgaaccatgcagttcatcagagggctacaaagaggtatcaacacttcagttttccatatgggcatctggggctcacaaaaccaaacagatttttggtatcaaaaatagtattgcagcctctgtggaaaccacccatggggtttctcatctatgtaacactgacatagtagaaactcaggctgcctagagcacattcagagaacaagtgaatgagtgcagtctacaaagtaagtctctgtcacttacatcatgcttcctgagaatatcacttgcaattgtgaattatgctgctataaacatgtgtgtgcaagtatcaacccaaatgcccatcaatcgacaagtagataaagaaactgcggtatatatacatatgtatgtacgtgtgtctatatatatatatatgaatactactcagccataaaaaggaatgaattaacagcatttgcaatgacctggatgcgattggagactatcattgtaagtgaagtaactcaggaatggaaaaccaaacagcatatgttctcactgatacgtgggagctaagctatgaggatgcaaaggcataagaatgatacaatgggctttggagacttggggggtagaaaaggggtgccgagggacaaaagataacatatatggtgcagtgtatactactcgtgtgatgggtgcaccaggatctcacaaattaccactaaagaacttactcattgcaatagtttgctgagaatgatggtttccagcttcatccatgtccctacaaaggacgtgaactcatccttttttatggctgcacagtattccatggtgtatatgtgccacattttcttaatccagtctatcattgtcggacatttgggttggttccaagtctttgctattgtgaatagtgccgcaataaacatacatgtgcatgtgtctttacagcagcatgatttataatcctttgggtatatacccagtaatgggatggctgggtcaaatggtaattctagttctagatgcctgaggaatcgccacactgacttccacaatggttgaactagtttacagtcccaccaacagtgtaaaagtgttcctgtttctccacatcctcaccagcacctgttgtttcctgatttttaatgatcgccattctaactggcgtgagatggtacctcgtggttttctcagcaaactatcgcaaggacaaaaaaccaaacaccgcatgttctcgctcataggtgggaattgaacaatgagaacacatggacacaggaaggggaacatcacacaccggggcctgttgtggggtggggggaggggggagggatagcattaggagatatacctaatgctaaatgacgagttaatgggtgcagcacaccaacatggcacatgtatacatacgtaacaaacctgcacgttgtgcacatgtaccctaaaacttaaagtagaataaaaaaaaaatctcagaaatatcaaaaaaaagaacttactcatgtaaccaaataccacctgtaccccaataatttacagaaaaataaaataataaaaactaaaataaaaaagaatatcatttgctaggagtaaaaaataaaacttcatcttgaagatcataacaaccctagatgagaaagcaaatatattacctgatctttttattttccatcctcattttctcttcaatgatatgtatgaagagaaatattaatgttagaaaggtaatgcaacgtgttagtaattgctctggaattgatttctctattctgttggcatttatcagaattatttaaatttcaaagcacagtctaagaattccatgagataaatcttattgtaaatgaattatattaccatgggcttgctcattatttgtgaaagtgactttatctgcctggcttattattaaatatagtttatgaacaaggtggcacatttccttctgtttgatttttgtaaagaactctgtatcttgagcggttgggtgctgatatacgtgccacgatatgtaatattaaaaaccctttgctctccaatgacattcttatcatttgaagtcatttcttaatgtttctacattatttttaaaacactgctcttttgagattttaaaattgttatttatattgcaatattttatataaattaatttactccttaggaggaaactatatagtgaacaaagattttttatttaaccttttcaaaaataatatcttctatttgggaaaaaaaaaaatgctttacaaaagaggttccaaaacccagaggggcccacagtcattgtgttctttcttgactaacgaattccttgagtgcagtttcaagtacagattgtagtatctatcaatgtcttacccaattttccctgtcagtgtttcaaatatattttaattcctgtaaaataatctgggatgtggtaacaaattatcatatatacattaagaaaatttggttcaggacaggtccactgataaagtttcctggtgtgcccgatattctagtaattccttaatagaaacctaagagaaattagctcttttttgatcatcttaggtagcctggggaaaaaaaatcactccaggtacagcatcctttcctattttctcatttcctttaacatctagttttattttcttaatgctttgtcattttgttagtattttcttaatttttttttagtgtttaatactcggcaaaggacagacatagcctgcgatgcaggcagggctgcttctcttaatgttcttttgacagtaaagattcaaaattagcccattatcaaccaacaaataaaggagagggttggaaataagtgtaatggttccggccaaaaataaacacaaggccagtctgctaaattcgtatgttgcaaaaacgtacttactacttcacttagcctttaagaaagacatgggatgaattgggatttttaaagtaagaaggggaaaaaaagcaacactcttagctcctttatccagtactcctgactctgcaaggtagattgtttcctcctctaattggcaaaatgctgcaggttttcagtccctcggtgaaagtgacttaggacggggcattaattctttcagttcactagggcgtcatttggcaaattactatatgtgagcaataaatcaaagagttcgaagatgccttgagaaattctccaggattattctcttgccttctggtaaattagaaacatactacattcaataacaagagtatacatattttatattataaacattatggctaaaaaatcatggaagaactattattattttacaaccccctctttttaaatgttttcctaaacatacatggtatgtatgtatatttcaaactgtcaaaaatccctggattgcaagtaaaattcaactatcccacttgcaaaatgaatgggttaattgttcttactttagactcataagttttcaaagaataatttaaactgttaaatatttaaaacaaatatactttatttggtgacttaatagataagagaatagaattagttgtgaacatttatactaatcaaaataatgaactactgtcattttgaattgacacctatataaattctgatttaaacatatttttacatctcagaagaaagagcatagcgttaagtataagaacccatttcaaccatagattggcatagcaattatctgatcttataaggttaaaaatatgagaacattttcataatgatattaaagtattaattagtaaaatagttgctcgattatattccataaaaatagatagacaaagaaaattttaagataaattcctatgtagtaggtaaatacttttccctcaaataagggaatacattaaggagatgaaaaattctcaaactttttcattttataaataagaaaaaaataatcaaccatataaaaaccacatgacatcaaaagctatagttctaaatgctagccatagaaatgcatgattatattatgatactatttatctgttcataaacatgacctgcctccccagtgcaattttaggaccaatgaaaaggagatcctacatccttttaaatttccccgaaccctagtgcatgggaacaatatacagtattttctcagaataaaaatcaggatgatgaagaaacggcgtttactatgcaagggctgaatacaaagggagattagtggactgtttggaaaaagagaatgattattactgtttactttaagacataaagtcagaaactatagcctgtgtgacaactcgcatttgctgcctgtgtgcgtatggcacacaagctaagaatgggatttacatattaaatggttggggagaaatcaaaagaataatacaactttgcaacacataaaaattatacgatatccaaatttctctgtgcgtaaagtttgctaggaacaaaaccatgctcattcaggtatgtattgtctgctttcatactacaacagcgtagttgagtaattgcgacaaagacgacaagcctaaaatatttactaactagcccttcaaagaaaaaaggcttctgactcctgctttaggagaaagcacgtacaaggaggtaaaaataaacttttttttttttaattgcaatcagattccagatggaccctaagagctcagttacggaagtggaaggggaaaaacagcagcagcagcagcaacaacaacaacgacaacaacaacaacgacaacaacaaaccgaagaggaaaagagagctgagtggaaaaagtctttgaaaatttagtcctaaaacttatatttacattctcatgctctcctgaagtcacagaaagaggttcggaacttctgctttaagaggacatttgaatcgactggagaggaacaaagcattgaagagagaggaagtgaactcctcagataaagctctaatatgagaaacatagttccagagagaagttaatgttacttcatttttctgtctcatttccttcaagctcaaagcatgagtaagtgataatggtaagtaaatatgtattctctctgccatcctaaaaacagaaggagggggaccacttgtaaaattaaacactggctgtaaaaataatttatccatatgtaggatttttttcagttggagaaagcacccaagcctacagagtgcgtgcctaggttctgcaataacaatgcaatagaaacagtcacaattaacatacaggcacacaaacacagaaacacattttcgtgctttcactatagttacttatgggaaaaaatcaaataaaatgagggcattggaaggcaaacaaaacatgcagatacttattttttgacaaaactttaatgtgaagttattacaactgtctgaaaatttaactctccaacaaggtctttcttgtgaaaccgttgtttatcttgcaagttcctacagattctcaattctgtacccataattttcctatcccttgaggcctggtaaagttttcatggaaaaaaatgaatgtttttgagattctacatttaatctcttaattattctaaggcaataacatctttccagtgttacagatttcatgccaaaaaaaaaaaagtttatttagggatgcgcgcagcagctgacgcctgtaatctcagcactttgggaggccgagtagggcagactgcttgagaccaggagttcgagaccagcctgggcaacatggtgaaaccccgtctccactaaagatacaaaaattagccaggcgtggtggcagacacttataatcccagctactggaagacagaggcaggagaatcatttgagcccacgatggggaggttgcagtgagctgtgaccatgccattgcactgcactccagcctgggtgacagaacgagactctgtctcaaaaaaaaaaaaaaaaaaaaaaaaaaaaaaaaaaagagagagagagagagagagaagttatttagaactaacagtatgcaaggcactgtgctggctgctaatgggagacacaaaggaatgcaaagtcatgaccctccagaggattataacctcagcggaaagacagacaggtgtacaagcagctatgatacaaggcaaatggaggtaatgctttaaaagagctagacaggggaaggagatgttacctctagtgggaaattttagatgacttcatgacaatgttgtgctctggccataaaggaaacataagacttctttttttctttctttcttttttttttttttgagacagagtctcgctctgtcacccaggctggagtggagtgtcgtgatctcagctcactgcaagctccacctcccgggttcacaccattttcctgcctcagcctcccgagtagctgggactacaggcgcctgccagcacgcccggctaattttttatatttttagtagagatggggtttcaccgtgttagccaggatggtctcgatctcttgaccatgtgatccgcccgcctcaggctcccaaagtgctgggattacaggcgtgagccaccctgcccggcccataagatttctttaataagagatgcagcaaagaacattctaggaagacattattacattatagaggcatgagagggtatagtcttgtctgcctcactctcagattcataaaccatgggaggggcctaggaatctgcattattaacaagctccctaggagattctgatggaggggttctgcaaactgcactctaagactgatatagaatatctaccaagaaatagagtagggaagagcaggaacaaggtatagtgtgaaagctataggcttgatgataataaaatgagaaagcaagtctaagcttgtggcaaagagtcaatgtaattttcagtgtaaggcaatgagtgccttgctatgacaatgttatatatttacaattaggtgaaatagatccatttgcataaaattcaaaaactggcaaaattaatctatggtattagaaatcacgataatgcttatccatgggggtagcacggagagactgaaaaggggcagaagggggcctctgaggtatcatcaaggttctgtttttaatctaagtgctggttaaagggatgtgttcagtttgtgcaaattcatctagctgcacctttatattaggcatgcttttctactgaagtatattatacttcagtaagaagttataaaaattaggctgagtaggtgtatttcaactaaaagaaaacatcctataattgttatcttattaatctcagaaaatttcataataacttaatacctctttcaattctctgaaagttatataaatgtgataaaatagaatataagaggaatgttctaaaacatttttcagatcattctaatggggaaaataacttcttaaagcttccttgctaacacttaaatcccatcagattgaaatttcttattctaaagttaccatccttgagtctattatttatcctcactgtctcagcttgctgtgccccttcacagtaaaacttcttgaaaaagttgtctataatctttgtatctattttcccaccttatattatttactcagcctactcctctggaccttccatatccatcattctgttcaaattgctcttgtccagatcaccaaaaaattatatgttgccaaatccaatagtcacttatcttttcattatactgagcccctcataacatgctggttattaattactccctcccttcaacactctttttgtatctttcatattgccacactctcttgattcccctcctaattcttggtattctatattggatgtccctcttctgttccacttctaaacatctgagtgtctcagggcttgatcttgagactatttatgttctcctggaggtctctagcgccatggctctagacagatccttaatgtgcatctgccagccctaagctcttctctaaaatccacatttatattcagtttcctagggtctctaataagcatccccaaactagcatgtccaaataaagattcttgatactttttgaacaaatctgctcttactttataatattctacatctcaataaatggtaataccctcatcataattattcaagttaaacattaaagagttaacactgatttatttttttctcctaccaattaagccttgttgactacaaatctgaaatcagtcgcttcaatctctccagtacaatcgtccttgtccaagccactatcatctctcacacggactactcaattaatgactggtctttttattccactttcaccccctacattccgttttcgataagccagtcaaagtgaagctaatactctccaatcacttgccaccataattacaataaaatctaaacaatttataaaaacgaacaagtctttatatgagctggccattgcctacttctccaactcactcatcctcaatgtcttagccatattggcttattgttgttgttgccccatgaatatgttaacttgtctttacaccaaacactatgcattagtggtactcctgcctagaatactgttccttttgattgttattataggagatcaatatataccactccaaaatatggcactttgacataaagattacttttagttagaggcaagtaagaatcaatataagcaaaaagaagccttcccagtgcttcccttgtctaaataaaagcagaaacttctgagaaatgataactgctataagccctctctcctgggaaattgttatggccatgaagaatacgaaaagttgatctcaagatagacttggcataaacaaactatactccatgtttctcccatatatttaccttcctacagtttggcaaccctaaatacctaaaccccttttttctttgttttgtcatttctctacaagtttactgttctttgttcagatgctatataaacccaacattctaaccacccctttgagttactcatcactgagtttctaccaggtgtatgtgcactgaatattttaataaacttctaggcttttcctcttgttaatctgtcttttgtcactctaactttgtaggactccagctgggcagcctagaagggtagaaggaacatatttttcttcccctacatcacagagctggccccttcttgtcattcagatctctgtttaaataacatggctcagaaaaaaatgtccttgcttgggcctggtgggtcacgcctgtaaatcccagcactttgggaggctgaggcgggtggatcgcttgaggtcagaagtttgagaccagcctgggcaacatggtcaaaccccatctctactaaaaatacaaaaatcagctgggcctggtggtgcatgcctctagtcccagttatttgggaggcggaggcacacgaaaagcttgaacatgggaggcagaggttgcagtgagctgagattgcaccactgcgctccagcctgggcaacagagcaagactccgaaaggcagaaagaaaaagaaagaaaagaaagaaaaagaaaaagaaaaaaaagaaagagggagggaggggaaaaaaaaagaaaaaaatgtcctagatattctgaaccaaagtggtcatcctgtcacaatctgtaattttaccccattttaaagtctctttatgtatattttctagttattttgttttctgtctcctgtgagagaatgtaatatccatgtcgatacaaatcatatcttgattgttaattgctgaaatcccagtgcgcccaaaattgcacgtcctgtaataggtgtttgataaacttttgttgaattctgaatgttaaaccctttgacaagtgacctgacatgatgaataaaaacttatagggtttaaggattaaaaaatttccataaagaattgtttacttaattcacaatggctaggacttgccaatgggtatagaggccaccagaaactggtgaactattttttaaaatctcataatataagaggaatcatattattaactggccactattctgagttttgaaaaacattttacaactttaaaaaatgattcaaataaagcaaggagacgagtaatgcaagtaatgccaagtatgacttgtgtttatctaataatggactttgttacttatagccacatggaattttagggctgcaaacaacaaggagaggcacctccttctgtaatcacagtgttgctataattacagacaaaggtttgtcagcatttccattaaaagaacttaactaagctgttaaatgtccattagcctaatatatggcttataatatcttagctaactgcatattaaaaacagctaattaaaaatggatggatttttaaataaagttatgtaaatacccagaagaaatcagctctttaagtgtgcacatttctataacaatataagtgcaagctttttttccccagtatttgaattgtctatttatatgcattatttttaaaacttaacctaaaatgttctggaaagggattacataacaataagcacaatgttgtcataagaaggaagaatgaacggcttgactactgtgatggacgctgatgaactactcagatttcccttcaataaagaacttgtcccagcaggtggaagggctggtggcagacagccttcagctctcagttttaggggtggtcccagccatgaagagcccccttgcacaaggtcatgacttatttctgagaaggctatcatccaatgactgattaatgcaggagtagtaaggctcactgttctcaggactactctgaagggtcattcgaagctctgaagcttcccatatgtttggtcaattgggaaacagctctatggaggtgcccaatgatattataagtatccacataggccacatacacaaagttcaactgcagattgacccacgtcttgacaaatgctctgtgatccttccaacatgggaagataggcagtcttgagaggaagtctaccaaggcaatattccacccacctctgtatctttagggaagtcccttaccttgtgggaggtggcgatagaacatttctcatctgcctttctggttatggtgagacatatgatgttccatctcagctccccttaaagtacagctgcagagtataaaactgcttaattgcatgacgaaattggcttctcaacaacagagtgcacactgcttgtgttgcatgtcatctggtctctttaattttggtatcatactgtgggacaagtgacacaggaaactgacaccatgctgatcatacttttgatgcctataaaactgtttgggttgactgtctcattaactgctgaatctctcagcctgcttaacactaaggctgttattgggcctgcattacagctcaacttctctttctgtccaatcctgcttctaagccctctcttgaatatgtattggtccagtgggcattccctgataagtattctgcatattaaactttattttagagtctggccgggcgtagtggctcacgcctgtaatcccagcactttgggaggcagaagtgggtggatcacctgaggtcgggtgtttgagaccagcctgaccaacatgatgaaaccccgtctctactaaaaatacaaaattagccaggcgtggtagtacttgcctgtaatcccagatacttgggagtttgaggcagaagaatcacttgaacccataaggcggaaattacagtgagacgagattgtgccattacactccaacatggacaacgagagcaaaattctgtctaaaataataataataataataataacaacaaataaagtaaaaataaaaatgttttagagtctgtttcccagagaacccaacctgtaacacctacttagtatgtcaaagcaaccaaggaagtcaagggctgtattatttctctttttatttggctgtcaggagttgtgtttattactctatctgaggagcccagagtgattttacgtacacgatctctttttgcagtttcatattacatgttcttagttgctttaactagatgactgctgagcaggcatctaggccatctccactgaagtcgtgcaacctcttccaatacaactccagcaggcagccaggtttggaagtactctattccattacatctaaaaagtatgccttttgttttcgagacaggatctcactctgtcacccaggctggagtgcagtggcaggagggagcacagctcaccatagacttgacctcatgggctcaaacgattctcccatctcagcctcctgagtagctggggctacaggggcacactacctcgcccggctatctatctatctatctatctatctatctatctatctatctatctattttgtagagatgaggcctattttactcaggctggtcttgaactgctagcctcaagcgatccttacaccacagccccccagtgttgggattactagtgtgaggcactgcacctggccattatttccttttgttatttccactcatttgttttattgctccctttctgagcaaagatgatgctttaacatcctttgtaaaaaacagcctttgaggttaacatacatctacttctcagttttcctacaactagatttttctaccccatggagaaatagtctcaattacaactagtcctaagatcagctctttggggctatttgattattcaaaagtcctatgtaaattgaagacctaaaggataaaaagatccctcccaaccatacctcccctacatgtgtgatgaaagcttcagctgagctagatggcccctttaatggtgtttttaatttatacctgctcttgatggaagagaaaataaaggagttctccaaagggatttaggcgtgggagtcaatattagatccaaagcaagggtcattctgttcctatgtttctaagggctttctcatttactcaatctaataatttttaagcacctcttattgtcctagctaacaccctggatgaaatggtcagaaagcactacatgtatttgacctcagacaagtaatagaaagcctattctgactttttaaataacatttcaagaagtcctgcataactcctttctattattttatgaacatagtccatggaggcttccaactagcaacccgtgaacttaacctaaggcttctatttaatgagtctgatagccacctgaataaaaaatcttttttttttttctttttttgagatggagtctggctctgtcgcccaggctggagtggagtggcaggatctcggctaccgggttcaagtgattctcctgcctcagcctcccgagtagctgggactaccggcacatgccactacgcccggctgattttttgtatttgtagtagaggtgggttttcaccgtgttagccaggatggtctctatctcctgacctcatgatccgcctgcctcggcctcccaaagtgctgggattacaggcgtgagccaccatgcctggccctgaatcaaaaatcttttgcgtagataaggaaaaaaaaatcaacagtgttgtataaggggctcatagccacttcatggattgaggtagcttacaaagcaaaataacagggaagtgccacaaaacaattcaatacactactggattctttgaaccaaaaccttgaaaacagcacaaatctgttccagtacttgggagatcaaccattgaaaattaacatttcatttacaacttctgcctgctcttctgttctagcctcctcttctgttctagcctgctcttctgtggctgttcatcgcagccacatttgtaggtttaaatgttcagattgcctagaaagctttgcatatgcaaatatatgcataatcatctggttatgctttctatcagactcataaacctgctttattctctccagcatttttcttctaatatttcataaatagggctgtaacctcaaccttaaattccaaatattctgaattttctttttgtctataattgtattttgtcaagatttttttttactaatatttaaaatgaactttaaatgtttctgaattttaatattgaaacctcaaatcctcacacactcaccttaggtaagtaaaaaagctttagagcttgagttagtaagaaggacttagtcaaggaaagagacaatacagtgagtgagtgagtgtgtgtttgtgtatgtgcctgtgtgtgtgttgaggggtcatttgtgtattgcacatgacatcgagaagtgagggatgtgaaaaccaagatgtttccttcctgaggccgtgtgacctgattcagagctgcatctcattcacctcttaggtccctggttggagtgcctttttcaaatgtctctgcccaaagtgagggacatcttttattaaaccatcaagtcaaaacgagtgatctttctaatacatacaaagactcaggatatgccatatacagacatgcaaatgaccaaggcctattttcaagcattattactaaaataattatttgggataaaacttaataaacacaagtagtatctgctttatagatagatgatggtgccaaattgaatatgaatatcagttgtttgcaatagggaacatattttccacataagcattggatacttagtagctcagttgccaattacactgccgactctaacttaagctatctaatgaggacaacagacctgctattgggattacggaattcaggaaacagtaaattcactctgagagcaattgagatcctctgaaatggggtctcggaaggcggggaattaataacagggcctttgagtatggcctcacaagttgtaaattgcttccagaggcactgagctgagaggcgcagagaagctgaaatcttcaagccacgaaacctggccccgggctctatctgcccagtaaaaggaccactgttttccttctctcaagggatccacatgggttagcacgtgtcttaagtgtttgggttatcatgctgactgtacactcttgaaaggcaagccaaattattccttcctagacaaaagcaagaaatatatgaagaaaaaagaaaacaacttgagaggtgagatacttgccacaagtttggatggacaacccttgtaaattgagcattcattgcagcatccatgcttattttaagtgtaagttatatacacacacacaaacacatatgtatatgcatatgtatgtatgcatacatatacacatatttatttttatttaaataattttttatttgtatgaatgtaaggggtacaagtgcaattttattatgtgagtatgttggatagtggtgaactttggatttttagtgtatccatcacccaaattatgtacattgtagccattaatttatcactgattcccttgcacacccccacacttcagtctccaatgcttatcactacacactctatgtccatgtgtacatgtttatacattatttgtctttcacttataagtgagaacatggggtatctttctgcttctgagttgtttcatatatatatatacacacacacatatatgtatatatgtgtatatatatacgtatatatatacacatatatacgtatatatatgtgtgtatatatacgtatatatacacacgcgtatatatatacgtatatatacacacgcgtatatatatacacatacactgatattgatggcttttctctagaaaaagtataaatctctatatttatcaaactgtgcatttacgatatctggcaatatcttatctactaaatcaaaatgtatacaatgtgccccaatatttagcaatctcagttctgggtatacacccatgtgaaatgtgtaaattcttataccaaaagacatgtaatagaatatatgtctgcaacagcactatttgtaatagctaagttatcaataaaactgttatatttaccctatggaatattatgcagcccataaaatgattgtttaataactacacacaagagaatagctgatacacaaatacaatgcactaagaagccagacattaaagagcatatattgtataattcagcaaaaatatagtagggcaaaaccaatctatgctgtcacagatcagatcggtgattactcttgggagactaatgattgcaaagaggaaccaggggtactgttttgttttctttcttgaagtggatgctgattacatgactggctttagattttgaggcatatacttgtgatacgtgcactttttattgtatatgcacttttataaaattatttaaaatagagtacagatctctaaaatgttagcataccatagttttcatctttttgctactgctatgaaccacatccagagtaaggtgtttcacgcatattatctttaattcacacaatatggattgtatggcctgtctggtcaggatgattaccctcattgcacaagtgatccagcctttgacgcaaaaaactgaatacattaattggcattcatcctttgttgttgggtgggggggaagaagcacaatcatcatcactgtggatgtgttcatgatatgaattgtcactccaagtttccttgatgctttaggagtataaagatgatgtagctgcttgaggccactcatcctagaagcagtctggagaggcatgtgacagtagatgctaattgacattcttatttgtctgtgtcaacaatctaattaaggttttttcctgcctagtagattggtctcattttaattcacagtaccaaaaaagaaacacttccaggtaaatagaacaaaaaaagtcttccgaagaaaaagaaaaagtacaaaaaccaacttaaatggcctggagctccaaaagtactttgttgacaaagaattctgtgaacacgtcatatatattattgactaaaaaacctgcaaagttcagcacaatgctctgatccctagatattttattttatagtctacacactgttaaggtttttgatgttaagaattgaaacgagagtagtatccttataaagcattcttgcctatcttaaccaccactccctttctaatgactaggaaagagtataatgtaaaataaaaaattgattcaaaattttcgagcatgaaaaaattatcatgagggaattcttctccttaacttatccactgatgtagaaacgtacatgtaattgagaaaaataataaaatggatgttgacggtatttcccagaagaattaacaaatttgaaattaagtgagtaaagctgttattcagtcattatttcagggtcttttctcaagcctctgaagtacatgtgggaaaatgctacataaacgtagcagaaatgttaatttctgcagcttattaagttagttattagcctataattcaagatctttgagtatcattaaaggacccgcacaggtacatcattttaatgacttatgtgagaaaatagatatataaaaataggaacatgatctggacgttaagaaataattttgaggttctccttactgatacatcgtgttgtgcgttggaatttttgccctgatattgacccgctagtccgagtcaatcagacctggaattctcctgatgactggttctagactaagagcagtctcatgtcctaaattggctcaaatggattgaagagacatattccaacgaggtggaagaggttttctctctcttcagcttgtagcttaaaagccaatctatgactacaggaggaataaaacttaggaattcacgagcataaagagtaaggccagtaatcaaggcatccctatacttggcaaacctggccactctgaggcttctctttggaggattccacctctgctacatctagacaatgactcagtgttatttctggatataaggcactgctgggaacacacagatgaatctgacatgaattctataatgagtttctcaggagaataatgaattttggtaatgggaaatgaaagtggggaaatgtactgtatgttatggacttgaccttcgtctataatatgggtgtctgccactcgttcaacaatccattagcaaatcatttaacttaaaaatattttatccatatgttaaattgggctactaaaacatataatgaaagggcatatagagctatgggcttctttaaggaaatacaataacagctaatattcctaggagctttatgcatatcaggcactgtgctaaacactgaataagcaatttcttaaccttcacatgaaccccatgagatagacatggttttcccccattttacagttgacgaaatagaagagatttcagccacttgttcgaggtcatttgttcaaggtcagacaggttccacggtggaacctggaaagtaatctcagatagtttctcaaattgaagctctcaaccaggaactctttttacctccagcatatattcagacatggcataagcagaggacagaggctgttctatgaagcgatgactaaaaaaaaaaaaaaaagtacaaatatttatttttgccatcataagctaaataagtgggctttcctaagtagtttcgtaataggagaaaagctgatgaataatgagatagaagggttggtgttgaggcagaggggctttggagactaaagcaaatatttaaatgaaaatagctctgaagtgtgtgtgtgtgtgtgtgtgtgtgtgtgtgtgaaaacagaagttccataattaataatctactatgtgccaaatactgccatgcacaatcactacaaaagtgaatggccttgatcctttccttttactacagagaatgacacatataaataaaccatgtcaatctgctacgacaagcgctaagattgaagttcattgagtgttcagtccgagccctaaaagaaactactgattgccacatgtatgtaaaggcaagcaagacaaggtttcctggatgagatgaggcctaggctgaaacatgaactgaaaaatgtgtttttctggagatccattcaatacgctatatttaggtatccctttgcttaaagacaaagtatttgttattggaattgatgtgtagtaaaatccgctccttttgaagtaaagttctgtgagttctgacaagggcttagtcgtgtagccatcatcgcaggcaagacacagaacagcttcatcaccccccaaaatgctcttgtgctgtccttacccccatctcacctcctcagaagcaatctcttttaacccttctactctgtggtgtattgtactgaaaataagatacgtttattttataacttttaaattaggttcaggggtacacgtgcaggtttgctatacaggtgaactgcattttgcgggggtttggtgtaaagattattttctcacgcaggtactaaacatagtacccaataattatttttcctgatcttctccctccacttgtgttccaccctccagtaggccccagtgtgtgttattcccctctttgtgtccatatgttctcatcatttagcttccatttataagtgagaacacgcagtatttggttttctgtttccatataagtttgctaaggataatggccactggctccatccatgtcgctgcaaaggacatgatctcattctttttcatggccacatagtattccatggtgtatatgtaccacattttctttattcagtctgttcattgataggcatttaagttgaatccatgtctttgctattgtgagtagtgttgcaatgaacatacacaacgtgcatatgtctttatggtagaatgatttctattcctctgggtatatgcccaataatgggattgctgggtcaaatggtaattcttttgtaagttatttgagaaatcaccacactgctttcaacgaccgaactaatttacgttcccaccagcagtgtgttaagtgttcctattaagagattattaaatccctatccttctaggaagttatttgaagtagtcaagaactacacagagatcactgagacaaagatttgaagaacaattggaatcttacagctagctactatcagaaataacaacccgtagtaaatattatgtagttaataattttctacttacattatgtttaatgagtcctcatcaagaaaccatgagtaacataaagttaataaacagagatgacatgatagaatctccaagaagttgaatcagagattaccttcaaagtttaccagaacaaatcaacagaaattgcatagaattagaaagctctagaagtccattaggaggggagttagaataccttcagagaaaaacaaacaggaaaagtgaaatttaactatctaaggaaaatgtgtgaaagacatatttaaatccctgtcactaacaaagctgaaggaagagtgtcttcagattacaggtgtttcttctacctacatgaaaacctgggaaatgggcaagtgaagagcacagatttatctctgaagaaagaaccctcccaccttacagctactagagtggtcaacccacttttaaggtggggattattcgtcagcgttatccacagcctcagggaaatactcctcaaagacatctcattccttgctccattgcttctgatcatgaagtccgtttcatgatcatcgctctctaattctaaaacttctaaccatgagataagtttctaagttaccctcacacactcaggtatccagtttctgaaaaggtagtacaagtaatgtgaatgaaagagtattccggtttggatatgattctgaattttgggttttttttttctgctgggacaatccaatctaggtgagccaacccaatgctgagggacagaccctggttaaaggagatgcttcaacacaggccatcctatgaggtgctgtctgagaggccagtcaacctctctgaaagctctgctcatgtgtttaattttcagcaacggatattgcaagagaaaagcatgctctgtcattttcctatgattagacaactaataaataagccagctctggcttaaatgtagcacttttaactcaggccatgcccatttttttatgccacacatcttctcaggcacagcgggaacacacttgcggcgtagcagcagcagatgatttttttcaaagaagagaagagaagacacctttggcaaaacagtgctgataaactaatagtcaggagctttgacagaatgttaaagaaaagctgattttcttcgatttttttcaggacaacatctctgttatccttgaattgaattcttattccacacatcaaaatccatatctaagaaacaccagagaattcttccagatacatagaaacttatatatttttttcagtgataagcagtttgattataaaagatataaaacatgactgataaaaaagcatggcttagatgttgagtaaatattgtagctaaatcctgaaagctcaacatcaataaataatggaagctttagaaaccaatgctctggataacatccctattttagaatactcaaagggctgctacagctatttttttttttggcagttccattctccacaggtgatctatagcttgaactaaacctaaagccatcagattttccaggtttaaaacattttaaaatggtcccatctaatccacaggtttttaaagttacagttaataatcatgttactgaaaacatacactagaagaaatgttatcaagacattaattaaaagtcatgttgttaaaatatatacaagacatacactagaatttttaaaaatattattcacatactaataaaatgaaagtaaggaaataatacaataattacaagaacttcaagaatttctcatagctagtagtgaacatactgatcagtataagggcttgggggtttattaatatttctgaggcataactgtcttaaaaagagccaaaagtgagatctgataatttatcagattgtctaagaaaatgttaatattcatcatctataaaatgactaacttttctttggtgtacatggttttcaagaaaacatgattcattatttcaacatttaaaatttgcctagagagcagcagcatccctgacagactggctcatgctatgattcggtgtcaggatgaaaaggctggcttagagacatgttctgggttcaatttccagtggtttaaaagatttcttggagttaggttgtgcatgataatgtgcctcaatctagaagaggcatgggcaactcccagcatgcaagcagagctcctggttaacatctgaaagtattcacccacaccgtaatccgctggtttattccacctttatgaaactcctattacatttgtccaccctgtgcttaaagcagcaacagcttaaaagagggacacttcagacaaggccccttctgggtctctttctctttcagtaccgcagagaaaaagatacaatggaagcaacagcagtagatggaatttttatttgaaacaccaccactaaatagctttcagatgaggaatacaattctttggtatttctattttaaatagtgcaggggctgggctatgagattttcatatgctatctcatttatttcatttatctatacatgtttaatttagagtgatgatgtaacattggatgtggagactccaaagctgaataatgtaatatatcaatacaatacctgcagaaacagctatgcagtggagtattttggttttatacttcctcaaaaatgttcatcacgttattttcactttttttttttttttttttttttttttttttttatagaaacacaggactggctttggagttatttaggggaagagtgcctttggtctttagagaaatcttcctggacaattcttgtaacaaataaaacatcaaggtgtaattatataaaatcactattaaaacgcaacttatttgtactatattttagctgttttaacactaagtgaccttacactcattcattgtttctattgctccctgttattgttcctttctaaaagaatgttctcccttatatactgtactatcaccactacttaattagtttttgtattcaatagtcttgctcattggcgctaacattaaagtatgaaataagttaaatataatggaaaaaataatttcttactttaatagtcactttagtcttcacaatagaattctttaaatctataactcaatacttaacagctgagaagaatatgagtgtgtttaatataaattaaagcagcaatttctgtttcataccacattttcttttcaattcatccactgatggacgtttaggttgattccatatcatggctagtatgaaaagtgctgcagtaaacatgggaacaaagctatctcttcaaagatactgatttccttttctttggataaatgcccagtagtgggattgctggatcatctggtagcaattcatgttttattaagaaagtgtttacaacacagaagctcaaaagccttcagctatctctatacaatgccattttaaacacctttggaagattattaaaatatgttaattattttgtcgaaaaactaaaaatttaaaaagcaagacaggtcaacaaaggccagattagaaattaccataaattattaaagtcataaaacatactgaaatctttgggatgtaatttaacacatgagatttacgactactcaagaagcatactatgtagtatgtcacttttgtgctttgagcaaggaacatactttgattcctctatttcagtgggatgaaaacagcttgtgcctctagaattaagacaatggcccacagaattaataatatgataatgaattaaattctctatatttcacagaaaataacaaattttttatgactgtcaataaaaccctcagatagttcaactctgtataactaacaagaaaaattagtttaaaatgtcattttaaccctcctttaaaaaaaaaagcttatctaaatttactggagatatcaatgaggttacggagaattattttaagaaatgtaaaaaggaaccacaatggttctttgctcattaacaaaatgctacataactacaagagatggtttataattacaagaggttaatcatgctttgcaagttgtaaaatttactctcttaggaaataatttcaagagtcctactgattgttaacaggttaaaaaaccttcaacgtttgttaacacattaaaaagtcttcacatatttggcctttaccaaagtaggcagtagtgaccatggtcacctatactttaatagtttttagaacaacttatacatagttcttgaaatggcaataagaattagtggcaataataaataaaacatttatgaacacacaatattgttaaaactccagtgttcacttagatatgtaatctatgtaacaatattgcataattgaagagtttgccaagataattactgatgtatatatatttttcttcatttacaaatattcatggcaaatatgtaatatcaataatgccaaaatgtttagttatttttgtgagatatctcaatacacaaaacagataatagaaatataaattaatgtttgttagagtctatttattttagatacacatctcttccttcaacagcattaagaaatacacaatctccagtgtaggacctccttatagaaaaacattctatcactttgcatagggttattcagatgtgcaggaaagaaccaagaaataattattggttatctattatactaaaattcataggcctgaagggtacatcaaaataggaagatagccaagaaatggtgttcattttcaagtatctttactcaagctaagtctgtaagtcatgtattcacaaaacgatgcttagtggcttgtggcagtacactgtaaataccaaatgagctgtataggactttcaggaaatgatggtttttgagagagtaggtgtggcaggtcttcaagggggcaatgggacttgagcaagtgtcttgtgatgatgggtgtaatttgtaccttgcatgagggtaaatggcgaacaggagagcatggggctagaaaaacatgagacaaatcagaggacagttaatgctggcatttagaagatgtgctggaggtgaattaccaaaagagtctgaaagggcttggagattattcctccttccagaggtgaagaaacaggcccagagtcgttgcataacttgatcaaataatagggccctgtctttttgaatcatcgtccactgcctcgagctacttccatttcctctattctttcactagttaaaatgtaccttttcactttgtgaaaatgacgtgagtgagagtaatagaaaatatctcgttatccatagtttcaagcctagatttgtggaagtcagaatgacagtttcttttaatataacaagttttcattgataaaattattttcagaaaattctctaagtactcttgagttggttaaagtccttatttccctccccaaagaaaatcttaaattcctcgagaccaggtctgtgtatgaatcatctgaaatcctccccaaagggatggataatgcctttgtctaaatgtaggtgcttagtaaattatggataaaagttgaacagcactggcaacaataattcacatcaaagtacattctagttctttatatcacatagaaataaagaattttcttataaattttgtaaatgtgaaagaaaatagaaccaatttagaaaataaatgtcaatcttgcattttaattgttgctcctttcacattaattttacaaaaacttgtttctgatttgattttctatggattaaaagcattctgtgcagttggaagctcattattaatcatgacaactgtagtggctgctagtatgaattaagcacatataccatgtgcctagctaaatggcaagccattcagatctctttctactacagttgattataagtttttttttttattatactttaagttttagggttcatgtgcacaacatgcaggttagttacacacgtatacatgtgccatgttggtgtgctgcacccattaactcgtcatttaccattaggtaagtttttaagagtcaggcatgatatcttagccatctttctatccaaaatgcatagcatgatccctgacatgtgtcatgtgcaatccaaatttaaaaataataaatcccctaccaaatacatttccattaaatatttcacatgagttatctggtttaatcatcccccaaacctcactttacaaatggagaaacaaaagtttcacaaatgtaacacgcccaatgccccacagatagaaagtggtggagccaaggtttgaacccaggctctttgactccagagcccctgcaagaaaatacaactctatgctgccttgacatagctcttcaaataaacagccattcaattatgctcagtgatttcctaatagtttccagaattctagccatgagaaaaataatggttactaatttgaataacgtaagaattatattaccaacaaaaaacgggaggccatgcttaggagacactgtgataacagtagaaagctcaaataaataatttttttaaagttccaagggatccattaaaaaaatacaaaaaaaaaaagtccatttctaatattttattcacagtgacgggcctgagcataacataaactgaaggctcttaccatgttagaaaataaacttaaagtagagatttcactggagagctgaggacccaggtaggtgaggttctgagtgcatctaacagaggggttattagccacatcattcaatcacttaaaataagactatatacgcatagcattagcgagtcaaccatcattaagacaagcggatttttcggagactttagcatgagtccagatgaccaaactcctctgctctgcagatgccatatgtaatgcagatttgcatatttctaatgtattcaggtattactgtttaaaatctactagaataacgacagctttaataaaatagagtttgaatggcttcaatagcaaagaaaattcttaaagattcaagggttcaagagtagtctacttagaaataatcatttaacccccattaatgaacattttttttggatcagtatctacagttctttttttaaagttttttaaattttaagttctgggaaacatgtgcagaacgtgcagatttgttacataggtacacatgtgccatagtggtttgctgcacctatgaacccgtcatttaggttttaagccccgcatgcattaggtatttgtcctaatgctctccctccccttgccccccacctcgcgacaggcctcggtgtgtgatgttcccctcccggtgtccatgtgttctcattgctcaactcccaattatgagtgagaaaatgcggtgtctgtttttccattcctgtgttagtttgctgaggatgatggcttccagctttatccatgtcccttcaaaggacatgaactcgttcttttttatggattcatagtattccatggtgtgtatgtgccaccttttctttatccagtccatcactgatgggcatttgggttgataaacatatataaagatcactttcttatcctaaggaaaagtatacttgtataatgggaccagatatataaagtgacttagttaaaatacaaatcaaccctaagtataaaattaaagggaattctaaatacaacatgtatatggaaatacctataataactaaattcctaatgttgacaaagcacttgacagtttacaaattcttttactatatcatagcatttaataatgttaatgaagtctgtcacgtaggcattttgcatgttttacagttcagaaaatgttttcttccagtaaatctcagctaaaaactgctgaagctagggcttgaacatctgtcttattcccatttttaacacggactgttacattttcatctactttttttgactaataaagtcaatatgaaagtcagtctagattcaggctttgcacatcttctttacaatgctagcgagtttggggcaaccagataaacaccaaaagcactcaaagaacatgaccataaattaaaaataaatccataataaattcagatgctatgctcttcaaggaaaaaaatcaaaaaggggtattgaaaatgtgcctgtatttgcgtgatatatgcatatatatgtacgtaggtacacatatttgtaatttatgtgtatatatgtatatagtttatggatgtatatacatgtaaatgcacatatatgtaaaaatcatataaatatatagaaataaataaagatctatagtaccattttagagaaacaataaagcataatttctggcaaaaaattaaagttgggtataattcaaatatcagtccattatacagaaaaagtaaaagtttgtcctaccttggattttactgattataaaatgaaagcacaaatgattaaaatttctagttttacaccaggtactatactgatggcatgcccaccctgtcttgctaatagtccagttttcataaactaccttgtttgaaaatgagaattttcatgtgaagtcagggctccacattggaaaacactgatgtttctaactcattctagatatttcattctctctttctacccatgtaattttagcattgcttgctcctagcacaatgtttggcacatacttgtttcttaatacaagttctttaactcaaacaatataatcatctcagtaaattcagtgccatacccatactttaccttctcttattctcccggggctaaatatgatcacttcaatcagaatgctcataaaacaaaatcacctgattaatgcaacttatgttttcatgaagtttaaatcaaaatcatttggtttgtttcatctcttcattttaaaacccttttaaaatagattagtctactttattgccttggtaaatatagaatgttgaatattaattttaatcattgctaatgattggggtcattaaaaagttccagaatcgtcatctttacaaatagtctctgagtatactgctgtgcatgttgagggcttaggcctttaaatttgtgaggcaaatctatggcctacagtgtgccctatgaacattgcttttaggaataaattgatgttaagaatgtactagtttacaatcccaccaacagtgtaaaagtgttcctatttctccccatcctctccagcacctgttgtttcctgactttttaatgattgccattctaactggtgtgagatggtatctcattgtggttttgatttgcatgtctctgatggccagtgatggtgagcattttttcatgtgttttttggctgcataaatgtcttcttttgagaagtgtctgttcattgtggaaggcagtgtggcgattcctcaggggcctagaactagaaataccatttgacccagccatcccattactgggtatatacccaaaggactataaatcatgctgctataaagacacgtgcacacatatgtttattgcggctctattcacaatagcaaagacttggaaccaacccaaatgtccaacaatgatagactggattaagaaaatgtggcacatatacaccatggaatactatgcagccagaaaaaatgatgagttcatgtcctttgtagggacatggatgaaactggaatacatcattctcagtaaactatcgcaaggacaaaaaaccaaacagcgcatgttctcactcttaggtgggaatggaacaatgagaacacatggacacaggaaggggaacatcacaccctgggaactgttgtggggtggggggaggggggagggacagcattaggagatatacctaatgttaaatgaagagttaatgggtgcagcactccaacatggcacaggtatacatatgtaactaacttgcacactgtgcacatgtaccctaaaacttaaagtataattaaaaaaaaaaaggatgtatcctaccatgatgtgtctttttcctaggactggcataaaataaactaatctggctcacagacaatttcagtttatcctcatttttatcaccatgtgacctcgggcataactaaacatgatctaattttatgttacttctggattcaatgcatttgcctctctctgagatctatttgtaatcaaatttgttaattccatcctgaaagggagaagtaaaaaggaaaaaaagttaacatctttctaacatttcaactttgaactaccccatccccagaagaaactgctattaaagataagttttgaaaactacacaagggccttacattatcttgaacatatatattatttacaagatcacctaactttcttcctcatttaactgaaaagctttcagatagcctacttttttctcacataagtagatgaaaaaaagaaagaaaatcactgtgtattattttcccagatatatatatatatatgtatatatatatatattagctactacggaaaatgtaaatgcatttatctcacaaggaagtttaaagccttggagccatgttttctgtattaacacgtgttttcatcgcttcttcctccacaattgttttttagatttacgctttttcaaagcataaataaccccagtttgtcttcagctgcaatgagaaaacatagcatggtatatatctcttgctatctgtcaatttgcctattaaaatattgttcaccttttctttggagggtttttcttcgcctcctctttcctgactaaagtttcttgcatcccgtgcatccgtcaaaggcttagctttctgttttgtttgttcaaagcccgccttttgggagcttggtcccatctttgcttccctcctgctatcatctccttctaagcattctgtttttagcttcacatctcccttcgccatgcttcttttgcttagaacaataacgcagcagcaagtacatcgattgctttaggaggattttatcttgtactcagttccatgttcctattcattcatttgtctttatttctttaagtttctcgaggcaaatatttagtgttacagatctatgcctacgagttgatgtctggttgccagaattttatcagatacatacacagctcatcacagacaatgtgattaacacttctgcatgaattatgtaaaatgttcgtatcagagtcttttcatagtaaagatattagtgatattatgtataagtgtttatatacattatattttgttatattttgttgcagaacatgttctgagttttcttcttttcacctagatttggagttttaatatggagaagcagtggtggtttaaaagaccacagaatgatgtcagacaggccagagttcaaatacaggttttactactctatggctctatgagcgtgagtaagttaccctagcctctctccagctcaatttaggattactacgaagaagctcggaaacctcacacagggaaaagtcatgtagtgggcatagcacgattagaactataacacaccctcaattaacgttgatacctgctcttattctcatcctcaccattgctattgtaactattttctccccttgcaattggttcccagaatttcacataaactatgaatccagtttgaacttaatatttattgaattattttcttctaaacatttctaattttcccatttcttgaaaagaacttttaccagatgttattcatattgaattgtaaatttaaaactattataataagctgaaatatatcccttggttagaggacttaacactttaccaatataacaattataatcagtaagaacattgcttctatataacattttattacaattttgctatagtttaaatgtgtcccccaaatttcatgtgttggaaacttaatccccaacgtggcagcaccgggagattgtgcctttaagaggtgattgcatcatgagggctctgcccttatgaatggattcatccattcataaattaataggttaatgggttatcatgggagtaggattcatgattttataagaacaggaagagagacatgaacacattagaatactcagccttcttgccatgtaatgtcctgcactgcctcagggctctgctgtgtccccatgagcaaaaaggctctaacaagtctacagccacaccagcctaaacgcgcccactcttatctgatcttggaagctaagtgaggttcgacctggttagtacttggatgggagaaggctctgaccagatgtggcccctcaaccttggacttctcagcctccgtaactgtaagaagtaaactccttttctttgtaaattacccattttcaggtattctgttacaagcaacagcaaatggacttagacgaattctttcacagtataagattttattgacacatagtgtgttgaataaataacagaatgatttcatcttttgtaatcaaaattaagtttgtattagtttcctgtattgttcctaactcattcaaagatcaggtggatgaaggacagactggaaaattttaatgactttacttaaataagtcatttacttatttaaaaagtcacatatttaaatgaataatttggttgtataacacagttactttagaataaaaatattatatctataatattttaaagtaataaataggaccataggctatttatgaaatatgacatgaatttagaatttcgagacaaatctatatttatttaaatgggcaatatggtttgagaacagttgatatgaaacacgatgatgaacccatcttctgatgaataagaaaaacactcaattggcaatggagctgatcatgcattcattgaaattaaattggctttaagttgtactagtcttcttatgcaacgagtagctccttattttgatgaaaattccccaatttataactaagactggatcttgttattttgatcagagatgcaaatgtctttggaaaaaaagttgggggttcttaatcacatgacttatcactgagaatttataaaaacattttatccccttgtagaaatcgatctcaaacttagggaacatataatttagagaaactatttttaacccaacggagctgcatttaggttactccctgtgattacttttgaacttggtagcactcttcttggttagcactgttatttggagacaatatcatacgaggtttatcttgtaggacatgttcagtaatttcctggatagtgttcaaattattaatagctaatcattattccagtgaatataatacagtgtactttaaaagtcatcattatatatatgctaacgataaatgaaaaataatcatacgcagatatgagaactataatgttggaataaagtgcttcattgctgccccacacgcgttagcacttgaataaatgtggatataaagtagaaagaaatattaaatatcaagtgttattccaaccattaaaggatttttactaagagaagaatctttcttcacatgatgactctataacttagctgaaaacaaaagcgcataaatggcctctcctgaagctatgtcttacactccttctgatgacatttcaattataagccgaagctccacgaaacaatcgattcctaaaggtctaacaattgatcactccgtacactgaagtgcctgtaatgactactgtttataaatgttttgctttaaaaaataaggcacactattaataaacagtttgctttaatagaacaaatgcaagttttcaaaatatttatcagaccacgactcttcctgactcagattggcttcagatgtatgtataaggaaggcctattatattcgtaaacactgctaagttgagagacctgtttctagatcccagtaaatagttaagagaaattcacatcattgatctggttgcatcagtttcacacagtgcacaatcttatataaccttttttccccccagtggctattcatttaggatatcctttagaacaaaagaataggattgagtgtcatttagcagaaagaagggagctaagctgacaggcatagtgttctgttgcagtattttgtgttttcatcattggacagcaatgactacagaaccggccacggcagcaaacccctcagagttcagggcttgggagtgggggagtgggatggacaacaactgaggaggcagagacagagaactgcttagcaaaaaggaagaagaaatcaataatgattatcttctctccttgggctactgcaactctgttaatttaggcatgatttttgtactacatattctttgaattggaaaatatatttttgatgtatttcgggaggtaatacataatccttctgataagcaatatttgttgagcattttatctgctctaattatgtcaggtgctttgctacttcacagtaaccacatgataaagaactatgaatagccctagcttagaaataaaagtaaaaactagagaggtaaagcaacccacccaacatcatatacatagtgaagaagctgccaggactggaggccagatttgcctgtgtcctctaatgctaaatgtgcacagggcttagagctgttctgaattctgtaatacccaatgtctccctttttagaaccaacatttagtaacaccctcatttaccaccctgaaatgaaatgaatagatctcataaacttgtctgcacagtgatctaaccatcatataaaaaagaaagaaaataattcataacacaacaatatatgttttattttattttaaaatactttgaaacgtgtgaatgttttcatggccacaccagaagacctattgaagatgccagacacttgcgcctatgttaagaatcccctttaatgtagaatttttcaaatgtcccctgaatataggtgagttgtatggaacactcaagtaccatgagtcgcaaggctattaagtcctagttttctgctatggaaaagagctcctaggaaacttctagaaattgttctataattgctgcattcttgaaaaattcagcaactatcaaaactgcatttcctctcctgtctccctgctccagtaaaaaacatccacacaaaacacgctttgtgtttatatgttaaatggatttacattctaggggaaattaactataaacaaggttttcctctatttgaatgtgcaggggtatgaggaaacactgtttacgcatcatgaagagtctagtcgcttaccaacacacgttagtgccagcagtgtccacctttcatcataacaaccaaaaatgcctcccttgttcaattcagagagaccatattccagcagaaacagaaatgcctcaggtaagaattgtaacattaagagaacatatgcaaagatctcagtgcagtacttttgcactcaacaagcactaaataaatggtagctattagtgaataatgacaattctatatttatacagaattgctcttacaaagcttatattaacagcttaaacagaaattgtaacatttatagcttaaaatgaataaagctatgtgtgatacattaaatgatttaaattttaaaaactgtaagaattaatgtggaaaactggttttaatttgagttatttcacatacacaaatgtttgctcttatacacattttattgcccatatgatagaggtagactttcttctaaaacaatcatattaatgatttaaacaaaaacgtgagtttaatatgcattattattcatgcttcataataatcacctgatctcttcaaatttaactgtcacacaaagctcagttccttttcatggctataaattacatttcagaactttgtgtctttatactgctaataagtcatatttgataatccagcatataataaaaggatcgtgtacaacattaattacaaggtcagttagatgtcaatgtagaaactcattgaatagtatttttgtggaagtagctagactctattatgtttaaacttcaccataatgaataatttgtatcagacttaattcacgagagaaaagtgaaagttctgcggcaaagtggctttttctcccgaaataatgttaataattgaaggctttcaaaattttttcctgcaaatttcagatgtgattaagtgttgactttataaaggctggaaacgtcaaacactttaaagtaaaattgtgttttcatcttaatttaatgatgaaaaacatacttatgctgtctaatagatctaaccaagaatttctgattcatttgattggtctacctggaaaataataaaattaataaaggagagtataaaatgcatattctgtagtacataaatgatgtgtcttttaaaatgtcaactgaaataatattttttaaaatgaagccatttaaaaatgatttttagtgtaaataagatgccagaagatggacaggtataaaattaacctctacccataaccataatttcatagtagttaatgagctcaactcaagaaaaggatagaagtctagtcaggaaaagggtaatgcaaagtgaaacattaaagttaaattatttccctcatttttggtaacaggttattaaaatagacttgaatgggtttttcaatatgaaacactaggatgagctttctgtgcttcagtttcttcatctgaaggagaggctgtctgagtaggggaccataagaatccacttcagcttctgtagtctatgatatatctgcatttttatcaggcatttattattattcccatgtagcagggaatgttctgctccctcccttgagccaggaagtacaatttgtatcaggatctcgaattatgttttgctccatctaatcccagtcatttctctacatatctgtatttttcaccatacttaataaaattatagggatttcttcttgttctaccacttcacttcatggtctccacttgagtaatgcaatcaactggcaggtacaattaccatgaggcagagggaaatgtttcttaggacccaggcaaaactgatttattttcctttgtgccaaatcttacatgtacttttacaccaagttaacctgcttaggcaaagggaggagccatctttttcaagctctgcaatgatccttgagaaagcagaaaagtcaatgggatctaatatttttatggtgtgagttccatctggggacatttgtatggggttgaagaggaatgcatttgatgaggcagtgactgtttgatcttaggtaccacgttcctcagtatgtgggagtgtaaagcttcatgaacaaattatttttagttgagctaaatggctatgagttgatcattaatgattaggaaaaagagccaggatggaggattacgctcttggccttgaagatctctaaggcagtagaaagagtaataaggagtatattagggttccttagagaaacaaaaggaataagagaatatgtatacacacacatatataattatatgtgtgtgtgtgtgtgtgtgtgtgtgtgtgtgtgtctctgtgtgtgtttgtatgtggtaagaaattggctcatgcaattatggaggcaactatggagactgacaactcccaaggtatacagggtgaacaagcaagctggagacccgagagagctgatagtgtagttccaatcgaagtagagcagacttgagatacaagaacagctaatattgtggttaaagtctgaaggcaggaaaaagcccatgtcccagtttgaaggcagtcgggcagaacgattcccttttgctcaggggagggtcagtgtttttcttctattcaggcctttaattaattacatgaagtctgctcacattaggaagggcaatctactttactcagtctaccaatttaaatgttaatctcatctgataacacttgcacagaatcacccagaataatgtttgaccaaatatctgggcaccttgtagcccagtcaagttgatgcacaaaattaaccattacgggcagtgttgacagatcaaagtagtggtaacagtaggtgcaaagtgaacaacagtatcattagaatgtccagggactttttcaattccagaaacatattgactgggtttgatgccccataactttacaagtaacaactattccacatgatactcaatgctcatatgactgccttggaggaataattgacattctctaccccctgtcccaaactttaaaaaacattttgtgtactgaaatgatttaggatgaactgtgaccggaaacaagaaaatagtaactcacggggtggtccaagcaagatgacagccaactttttgttctttgttttgttttagattcttaacgctttagtgaagttggatccacattttgatcattgcaaatattagaaacaacttacatgttcaacaaggtaagattggttaaaaaaaatcagcacaaatacaacaaaatactatcaggtcatttaaaaatgtgaaagaatgaaatttaagagcaaagaagaatctcatgctacagagatttctcttacaaagaaagtcatctaaattctcatggatagaatgcaatagattaattaggaaacagtatttatagaaacaggattgttactcgttaaattgccataaaattagaacaagaacaaacactagcttaaaagagaaaagtgccttttcctgaggacatgtgatacaatgatggcatttacagaaaaatgagttaatgatactgagggactggcaaaaagaaaggaggccattttcatggaaccaaggaaaactatattcaaaggtggtatcttttctctgctattggttttataatcatatacctatagctacacttaaaaattaaaatacttacagaaaatataactttgatattgatagtctgaaactctctaccccaacctcttctcttaatggataattatgtttaagatggttttttaaataacgtgaggttttttattagttaagaacacaaggagcatgttagaatacactgcatgttgtgaagttcagaaagcctgttataaaagagcagtatcttattgccttttcataaacatacgaatgtttaaaattcatatttatataacaggaaaaaagactattaggaaatgtttgaacatgaaaatgtatcaaaatgttaaaagtggtttgctggggaaagtgatattaaagaagatatttataattttttctctatgctcatctatcagcctatacatttttcataataaaccaatattatttgcatattctgaaaaaagtgttatttacttgttagctaaaatttcatgttatttgattcagactgtgtttcttctgctcagtttttggaatgctctctctctacactcaatctatctgagaagaatcaacagctacaatacaattttttttttgcatttagagactctatgcgcccagaataattctgtgatatgtatttctctttatctaaaagtctatatagacaaggggctctgatacatggtttcttctttaagccaccatcgaacatgctgcaggaaagttaatcgtggggatatccaacagagacctgtatcaataacataagaaaatgggaaattcacccgatacttttatttcctagggtgaaaaagaaattagagccaggtaatatctggtataaaaataggtaatatcatacaaaattcattaaagaaaatctgagtgcggaaattaccaaatcacagaatattagagctggaaaagacattgtacagatacagaaatttgaaaaaaaaaaaatacagagatgaagtgatcattctgctgtcctcacagaaatgcctgctacttctattgaattttcctctcatcttcctttaagcatttctggagtgcgtggtgtgtgtaatcataaagttttgtgttaaatgccaaaaaggaggaaatcataaaagagcggtgtaatttttctattatattttgatagtcctgccctctgcataattattttgtttctaatgtctccaacataatctcttaaacatttcttaaaatattttttttatcctaaatgcgagccgactaaggcaacttcttgacaaacacacgtcaaataacaccaacatcaaaatctaaccattcacatccatgaggtaaagaaaaccaaattaaccagtcattatttttcaatggctatgacttttataatagtacagcttagtttctatgcatcctcctatattctgagattcagcgttatacattttcaatttgattttgccagtcaaatttcatttgttcttgtttgattggctgtcgtttacctattaggtgctgccttcaattcatttttacattctctggggagacaacctacacacgaaggttttgccactttaaatgtttaattctgcaacacgttgcagagtaaaatcttcctcgatttatcctatagaagtttcctgtgacaatgcaagtgaaaaaccaaaactcaaagtgtggcaagttggagctaaggctgatcctggaatcaactagtttccacagtaaaaaaagaatgagaatgagacatagattccccacttaaatccaatagaggtagttttcactctgttatcatgcaacagtgtgtgatagtcaatgttgaagtcatataaacaagttatttggttttagcatttaaaataaaggagttctatcaatttgtggtaaacacaactacccatattgttctcttcctttagactctaactggagaagagagtatattttctgcctcttttcccaggtaatagcatttataggatgaggagctggctaatggcttcagttccacatggctagctacactagggggaaaaaaaaagcataatgctgcaagcaaaattccgatgtagtcacaagaaggacattctatttccttttgaaaaaatgtgtttcaggttcttgggtaaatctggtggtagaaagtttaccacctataattctgtaatgtgatcctcctttataaaattgttattacttgtggcaagaaaagaggaggcagatggtactgtgtcagatgctgaaaaagaaagtgagcatctcctagaatattacagtggaagtatccaacattgaaggcagatctctggaatacaaattcagaagtaaataaaatagacattctacaaacagtgaccaaataaatgtctggactgtgaaacagtttatccattgtttacataagaaataatgcggattatattgcatagctagtatgtaccccaaaccaacaaatatattttaaaggtccatcaaacagcccaataaggttccattttcacatacgcatgcagcattttataacagtcctaggatatgtgtatatacagagggatggaaaaaatacagttttaaaagacagaaatttaccctacattttattgccatctgggcagaaacacacgttccattcttttcgtttctccgtggcttctcccaaagagaaataggcctgtttctttaaacaatttttttataagcgctatcccttcttgaagttgagtatagcataacaaatttactaaaatttttttcttaaggataacagtagaataaagaacaatgagccactttgttacagagataagccatgtcattcttttggtttataatgtatttgcccaaaagtattatgtggctagctgatagctgcatagactaactacagctttttactatttgtgatacaccaggttccctttaatcaaacttcagttatctgtatctatattctccttaggataagcctagattgtctaaatttagagcttgctaccaccccagacattctttctttttggttatcatatcaagtcccaactgtgcagcctggaattcaatgtcaaccactttccatacctcacacaatccctgtgattccatcagctctgaccgaatcataataaacaacagtttattatgatgcttcaagtcccatctctgcagcaagtgcttctccaggtgatttaattaccaataatctttttaaaatctgaaaccccagtcccgtttttgcccattgagcagaggctaggatttattatacagaggatattgttttattatctatggcaataaattattctcttgttactctatagttatatattacattctgcaaacaaatttcagatacctcaagggcatgaataatatatttgattagctgatttattggcatagaatgcatttatcgagctttaattatgggccaaaaagtgtactacgccctgaagtcagaaagatgacaaagaaatgttcttggctttcaaggagatcccgtccctcgaattcattctaataatttttagaagagagttaaagaagaatgctctagaccagtggttctcaaactttagtgtgcatcaaattacctagagggctgataaaaatacaggctgctcatctccactctccaatgtttctgatcaagcaggtctgagatgaggcctgaggatctatatttctaatgaattcccagatggtgctgatgttgctggtccagcgaaagagtgatttagagaatggaaaggcaattaaataggcaatgcaaagacacaacgaggtagagggccaactgtattcaagtagcagcgggaaggtcatatggtgggtttagagggtgcatagggtgaccacaacatggcacttggagacgaatagattataataggttttggacatcatggtaatggtaaggaatgtagatattagaagaatcatcatcatcagaaatttgtaaataacggagggatgtgatcacacctgggctttagcttttagaaagaaaacaatagggcagaggatatgtctacacagaggattgtatcatactgatatttagaccacaaagatgagatttgattttctttcaacactgagggctaggtatcatgcttcatatttatggtctgtctcagctttcctcacctggccaattttaacaacctcctagggaaatcacagcctccagtccacctcctctctccctcccataatggcaagtagatatctggaatcccgctattaaatagcatcaacatctgaattcatgtgtttcaccgatttctcaggctattatagcaggagaaactcatgttgtaattttacttatcaggaatttgaaagccaaattagttaagtaaattaaagtaacgcagctagttaacagcagagtcaaaactagagctcaactatctcaatattgtgtttattagtataataaacgcatataaataaatgtaactatttaattaattgacaacaatatgaatagttacgtttgcacctgcacaggcaataataactaatgcacagctgtgacaccatcacctatgagacgtatctgttttcagaaatattaaaaacaaggtgcatccagtagggtgactatagttaatgacaatctattttgtatttcaaaatagctataataaaatacgtgaaatgttcccaacacaaagcaatggtaaatgtttgaggtgacggatacagaaatatccttatttgataattacacatggtatgcatgcatcaaaatatcacatgtatcccacaaatatgtacaattattatgtatcaatttaaaaatgcacatcttagttgcaataaaatacagcaaacacaggtgacttttcagggcctcgatttcgttcatgggaagaatgaaagatgacatgactctgatgactttttccatgccctatttccaggcaacagagtgtccttctaaaccagaagagttcagctctaacacagaagactattataaaagttagactcctttgagagcattggctgttctttatttttgtgtatatcctttcctttctcgatttcacaagcaactcctgacgattctaggaatttattgtccaattttaatttcctgatcatagttatagctttgaagttcattatcaaactttgacctcatgccctcattcctacctctcagacacaaattatattattacagggatatatattaatatttcaacatttctgcctttcctaaatccaaataaaacaatagaatactgaattaaattactacgataatttatcattgtttctaatattttcttgttttttttctgagaatgtggttattgaatagactacttttttgattatgcaaggctcaatgtcaacattttgttgctaaattataacattaagtaatccagatcacacaatatttttctttagctaagaaacatgtttaacttccagctacaacattttctcacagaataagaattacattgtttgtatttatctttagcttcagcacttattgcagttataaaatatgttaatatcatgggcataacaactgaaagcgtacttaattgttcaaccttggggaccacataatctacatcagatttctatgggtttttcatgtctctggttatgattgcacctttccaatttgtctctgtgcctcaactctctctctccccttatccatcctgtgtagcccttctaaaaagaatctttgaatatatacttttactcattttatgatcgcctgttcctccagctagcttctctttgacctcattgactcaattcaccttatgcctttcccctaatatcttgtgtctaatcatgtgagacttcttaatatttccagggcagaccgtcctcttttgtcctttcaaggttattcaagctgttgtccacacttctgatgttctccctctataatgacaagcttctactcagcctcccagatgagctaatctaccaccttctccgtgaagctgggtcttacgctctgttggagaagagactactctgattccttcacagattttactgtacctatcttgggatactataatgattttgatgctgttctacctgactaaacccagctgttactatttagcaatggatacaacatagtagatactcaacaaatgtcttttaattagtgcatgagcagcagtatctgcacagtgaaagccactgtctgtatatcctcacctcctactacattttaacctaccacaaatagttttttgatgcatgcttccagtgaaaatgtcttttatcaaggtcaagtatgagctccatattgcaaaacccaatggtctattcttttgtgtttgtctaattgtattttcaacatttgacactgtttttgattctatcatgaaggactttcttcatcccacttgcctggttttctctataaatcacagaagttgcttttgtctcctttgagtattttttttcttcctcctgttttgaaaggtgcagtcaattctcgggctcttttcccaaactctcctcctagaagacttcatccagtcccatgtctttaaaaaccatctaagggcctatgactgccacattatttatttatttattttgagacagggtctcactctgttgcccaggctggagtgcagcggtgtgatcacggctcactgcagccttgacttcccaggctcaagtgatccttcagcctcggcctcctgagtatctgggactacaggcatgtgccaccacacccgattaatttttgcgcgcgtgtgtgtgtgtagaggcgaggtctcgctgtgttacccaggctggtcttggactcctgggctcaagtaattctcctatcctggcctcccaaagtgctgggattataggagtgagccactgtgtccggccaactcttacgttattattccagtcacagtatctgtcttcagcttcagactgatctacccaactttctttccagcatttccacttggatatctaatgagactctgataataagagagactcttgatttcatcacaccttgtaccctaactttttcctcctccacttttccccagcaaagaacttagaaataattctcaattattctcatactttacatctaattcatcacagcaaatcctgtcagctttgtctttaaaatgtatcctaaataccagctctctaactgaccccaccactccaccctagtctgaaccacctctgatgtggactagtaacgtggcttcctgtgctatctccctgtattcactattgcttccatttcagtctaacctctactcagcaatgatgaatgaactctttgaagaaagcagatcaggtatctccactctatttttctaaattcttcaatgatgtcctgtcaaaattatgaaagagttaaattcttttatcacggcctgcaagatcccgtgtgatcttgcccttgcctatacttgcacctccttccttccccaccttctcttacactggaatccttgctatttgttggctaggtcaagtctcttttgaactcagtgcccttgcccttgtttcctctgcctggaatgtttttgcccaaattggagaatatctgctctcatatctgctcaaatactgccccctagagaagccatgccaatccacccaatctaaacaagtccaccttcaatatcattttctattcccttaaccagctttatttccaatatggatcactatctgaaatcatatgtgtatgcatataataaataatatcatttattctctagctcactactagagtgtaagttctacgagactagggacatacttatgtattcttgtatcccaagtacctggcatatatcatgtacttcacaaatatctgtggaataaatgaacacattgaagagatctacattatgccatcgtgatgtaaaaattgttttgagctaaagccatttgaggatcaacagatacgggaaggggctttttctgtactccccctatctgcctaaaagcaaagatttctgaaataattcaactgttttaaatcctcctttaaggaaagtttcttgcaccaggggtaaagagtgactcctgtcaccagagatgagaagttgtcgctgggaaaagaaaattacataaacagactttactaaaacaaacattacctttcattagtttctttcatatttcccaccaactttgtggcttgaaattctaacactcttcttttcaaaacccttgttaaaatagtacataagccccaaattctaacttcattgagctatgttttctgtgagctcccacatacttctctgaataaactttgtcttttctattgccaatctatctgtcgtcagtttaatttgcagccccccaagtaatgaacctaagaggggagtgaaaaagtttttcttccctgacaacacaaatggacacatcaataaatggatagcttgagtaaatttcctcatgtttctaagcctcactccattacatttttattgatcacagcaccagtgccagacgacaaatgggaattcttaagagaaagggcattagaagtgttaaaaggcaaccacagagagctgtcacatggagaaatggtccatgccatcttcatttgatctcactcctagttgggagtcatcagaatggggaacggagatatctttcagcaaggaggtcccagtgatatgattaataaaaatatgtcaaaagacacatgagaatagaagttcatttgatacaagcaaaggttattgtttattctactaatacggttccacagaatccaggtcccagcagtgccccctcttagaaggacaagcctccctagttttcaagtcttcacaaatgtggctagctgacaaaataccatctgatcaagtcataatcttctcagatccttcataaatcttcttactgccatgctcatgtttttaaccccttccaacctcttcgagctgacattaagtagcttcttttaaaaaccagcagaaggttcatgaatgcatatgggagaagagtgaattttaggtcaaattcccaggctatgatttaaccttgtcgcaatttgtactctcccaaatcagagaggaagcctgcctacagggcacttagaatctaagaaagtgccttcggtggagaaaatatttaaccaataggtttgtttgggggatggtttggatagggatcttctatatggacctagaaggattatcatcagagacaaagagtatgtgaactttctgttaatgcccagagatgtgacaaccagagaggctgggcagaacagaatctcagagggcatgtggagcaactgagaagactataaaggcattgtgttttcttacctcaagttcacgtaaggcttataactgtaaaatcatctatttttggattatccatgaaattctcaatcctaggctagcagttttctgcaacttacaagcccatgcctctcctacattcaaaggtttccaataacattacacccagggacaagaagtatattattttattggcctgtgaggtgggggaaggggacaaaatttatataataaagtatcctattttacacagtaaagtttattgctttactttattaaacactgatcactgatgatctgttctatagctttcccaaaaccctgtgtttctggattttcaattatgcagagaaaaaagtgaaatctcctgagctggcagctcttcccctccatcatagttcaaaaggtgacagggaatagcagcctacagagtgaacagaacataactctctgagccatggttaagctccagcaattttggtggtcgcagtaaacactgggctaaacccaaggaacttctccccctctatgtggctttggttatatattgataaccaaagctgatattgctttggttatcaaagcaatatcagcatgacctgggaacttattagaaaagtaaattctcaggtctcaccccacagctaccttatcagaactcctacgagtggggcacagcaatcagtattttaatgagtcacctggaaattttgatgcaggatcaaatgtgaaaaccatcgccctatagcagcaatccccaaccttttcggcaccagagactggtttagaggaagacaatttttccatggatcaggggcgggtggggttgtggggagaggtgcgtgggaggcgatggtttggggataaaactgttgcacctcagatcttcaggcattagattctcataaggagcacacaacctagatccctcgtgtggacagttcacaatagggttcgtgatcctatgagaatctaataccgctgctgagctgatagaaggtggagctcaagtggtaatgctggcggccctgcagctcacctcctgatgtggggccccggttcctaacaggtcactgacctgtactggtctgtggccccagggctggggacccttgctctatagtgttaaaagccaaaggaaagcgggcagatcacttgaggtcaggcgtttgagatcagtctgggcaacatggtgaaaccctgtctctactaaaaatgcaaaacttagcagggcctggtggcgccagagcacctgtaatcccagctacttgggaggctgtggcatgagaatcacctgaacctgggacgcggaggtttcagtgagcttagatcatcccagggcacttcacctggatgacagagtgagacagttaaaaaaaaaaaaaaaaaagccaaaaggattagagcacagaggattggcagtcttgagaactaacgtaaccctatttgcaaggtgacagtatgtatattgaactgtatcaggtccgcaatgcagcctttcgtataactaggctcctagtgcggttgtatgctaatcctagtcctaaaaccaagattaggcaaaaacagacttgagattcatttgagtcaaggtcccattactcagtaactcctgagatgaacacaatgcccatatataactaggatctccggtgtaccctcatcttctgatactgcctccttctcatttgccttgtccactgtgatgtggccctttctgtcttccatgtagatgcataaagccctataccaagcactgcaaacatatagctgagaaggtcctcagcctccagaaacttacttttgtcttaaccacatctgattgatgtttatctatgggtctttatgcgaactgtttcttctttctgaattacccttccctgctttcattcttcattttgggactgattccacagccctgggtggccatcacaccctgtggtcacccttttcagtgcacagtcttgcaattacttgattatacagctgacttgccacctcaactaggagctggttgaagggaggggctgtgtctttcatctctttatcaccagcatattgcacagttcctacctatagttgatagttgataacttttgatgaatgaatgaacgagaatcagacattaaattttcagaaggaaaaaacagtttatccttaaacaaatgtgtctggattcagaagaatcattttcccttcgactttatgctcacaaatgtgttgggattcagaagaattccaaccttttcatttgccttgtccatgttatatggtttcttatagcctagctaaagcagtggttttcacagcatgatcaaggccagcagcatcagcatcacctggtaacttgctagaaatgcaaattctggacctgcaccaaagttactggaccagcaactttgaaggctagcctagcaatctgtggtatagcaaaccctccagctgattctgacgtgagtactactggcctagagttgcttctaagactttggtataactaccagtcagaatctaggtcttcacacacagacactgattcagtaggtttgggatgaagggcaggcagtctacagcctttatcaagctgcccagatgatgctgaaaggtgttttatggattcagaagagtctcaacacattcgtgagcataaagttgaagggaaaaaatgtttaatgaatttgcctggggttttgttacttcttccactcctaacttcatttataatcaaggccctaagcagctggtttccacttaaccttaccaaactcatacaaattcagttgggattatttacaacttccagggttacttgcaattgtatactgagtctccaaggtggttaatgagccactttggatgataacaaccaccttggctgataactaaattgataggtaagcaatgtattataatagcaaccaaacccttgcttctctgatttactgacctgtcacagatatggaccaaaccaaatttctgaaattctggctgctcaaatcccaattgcaacctgattgaggcattattagtattggagtttgaagtaaataatacaaatgcatcgactgaaataggtagagaacaagcccggaagtgcaaacgttcgttagaagttactgatttgtgcagaactctgtgtggcttgggcagtcacttctctttgtcaagtaaacatacaaaacgtttgctccttccaattgcaatggtatccatggtagatacgtgcaatgcatttgaaaataataacttgagatcgaaagacaaaaaatgaatacgctaaggaagtgtggcagtcacaaagaggaatgtatctagttcttaatcagggcagacctcaatattcacatttttagcacaaaagccaaaagggagggttgaaatttacaagtcccttcatcttggttaggctctgtggggagttctccctgcagctggtgggctgcttcctgcttctgatgtctccacctgcaggtggtggcactggcccctgacctcctgaaataagcctgttgatcttctcccacattattcctgctgcctgtggactgctgacaggaagttaggggacgacaaaaagtccctcagtaaaagactcgattaagtggctaaataacgtttcctccgaaagctttcttttcaaataaggttttcaaaatatgtgtgcatatatatatatatatatatatatatatatatatatatatatatgtattcggttttattcagaatgcagaagtgtatctgcggagagcagaagggcattggaaggagtcaaaaaaaatgtgtgtgtgtgtgtgtgtatacacacactcactatatgccaaaaggaaaagcaaacaggagaaaaagatgtgttgaaatcttgacagagcacagacaacagtggcatatttgagttagaaaataaacaagggtgtgcattttagaattctcagatttatttgatttttgtccaaccactacaaagtaaggagtaaacgtgaatatgagggggtaagagaaaataagttgatttaatggtgaactagggacaaagtcctagtgttttgcatttgctctgtgacccaggtcttcagcacctttccttggcaagtcaggatgatttttaactagctcctaactagctttcttgtgttagttctgtttccttcgaatctataggccaagctgcagaagggggctttctaaaattcaggcctgtgaagtcattggccagtataaaagccttatatggtttttcctatagcgtagctaaagcagtggttttcaaagcacgatcaaggccagcagcatcagtatcacctggtaacttgctggaaatgcaaaatctggacctgcaccaaagttactggaccagcaactctgaaggctaacctagcaatctgtggtatagcaaaccctccagctgattctgatgtgagtattactggcctagagttgcttctaagactttggtataattaccagtcacaatctaggtcttcacacacagacactgattcaataggtttgggatgaagggtaggagtctacagcttttatcaagctgcccagatgattctgtaaggtgttatctggattgcatttagagaaatgctggccacagtctaaatagtatctgaaccactaaatacatctctctgtgccccctgcccaccccatctgtgaaattttttgagatcatcttgagctccccgtcacagcacagtgcctgcaacagaactgacacattcctctctaaatgtttctgaataaataaactgcactttggcagacaaattgcaatccctaatgtgaaccttttttctcttatctagacaaatgaggcaaaactactctgacagacttcagtggtagtttttaaattgttgttatttaaggaatacactactcataaggacttttcttctcacattgaacattacaagataaattaaaataattttatctaagtaaatgtcctgacactaagtttagccagacttcaccccttaatcggttttctaaaacacaaaaagaaaacaaatgacacctacatggaaattttacttttgaaaagcagtgaaagaaagcagtgaagacgctttgaccttgagtaagattacagcctctggtccccaaatgagacatgtgtagtcttaccttgtctcaggtaaatgtgtgttcatcttgtatacatacataccacatgaatacaggaaggggaatactaaaacctagtaaggtgaatggttttgtgagcatgcatatatatatatatatatatatatatatatatatatatataaatgatcaaaattgatgctaatgaaaaaaatctgtcttgttacaggatggacctttcttcccgtggttctttaacttgagtgtgcgttagaattgcctacagggcttgatcacagatctgcgggctccactctccaagaatttctgtttcagtaggtctgttgtgaggctcaagaatgggcatttctaaccatccccgtgatgctgatctgggacccacactttgaaaacaactgctctactccatagggggaaatgaatgtgtcaggaaaaaggtgctctgtttctgaagaaagagaaacatgaaaggttagacaaagaatataaaggtaactgaaatcctcgaagtaaaataaattccacctcttaactatacctataatcctttgtttcacaggccagcctaaatttaccactttatcttatagagttgtctgtgtgaatccgctttcttatgatatagtgagctcctttaaacattgtggcatgctttattcatctttatgtctgtcatagattagaagtagtaagtgttcaataaacatttgttgcgttaaaagtattagaaaggaaatagactgtacactttattctcgattggtagaaattttatggtgtaatcctaaggtaaggtacactattgatttcaatgtttgaattttttattttattttctatctaaaacaattcacatgtgtaatgaattaaacatctgtcttttgtgaggtgatacttaaaaaatacttagagacacttaaataaggagcataatgctgtagaaataccatatatggaatctattcaatttaacaaaactttatattgagcttctaccacatgcctgatagtatactcaatgctggaaatatctaatataatgatgttaagagcttcaatttattgattagttagcatacaacaggcaatctgcaaggtgtttacagcaaattatgcttatttactcatcgcaatacctctacgaagttggctttattagcatctccagattaaggaagaggaaatcaaagctttaaaacattaatttattctaaatcacacagctaagaaatgacggaaccatgattcggaccaacgttgtccgaagctagagtctgctttcaacagctctgctgtattgactcattccgaagacagggttagcccttaggaaagccacatgcaaaagagacccaattactttctactgtttaaacctgagcgaaactagggttacgtttacctaggtccaaagtcctaatagaccccaaaggggagctcttttttggatacatgtcaggaacatgttaaggtacaacttttcattcatcaattcaataaatttctcttgaatatttgttgtgtacaattactgtggttctatgaattcagtggtgagtaagtaaagaatgcccaatatctagtgggtgacacagataataatcaaatcctcacacaaataacatgtaattacaaactgaattaaggatgaggagaggaaaataaagagcactaggacagcatgcagcaagaggacttaattcaatttgtggagggggtgaccagggaaaccttcctgagcaagtgacaaccgatcaagaccggtaagacgggcaggaaaacgtgagtgtgtggagtgggtggagacagtgagcagattccctgacaaacggaatagtacgtgcaaaggaaaaagagattacagcactgtagttagagaaatctaaaaaaaaaaaaaaacaaagttagtgtagttggagtacagagaatgagcagatgagagggatagtaaaaaatactgccaacatagcaaaggacagactatgcaaagctttgcacaccattttaaggctaaaattaatgtgaaccttttgaaggagaaatctagccaaggctagatttatatttattaaatatcacactatctgtaggcagaacagtctggtgggtaggggggttactgtgttaattccaatgagagacgatggtagcttgcactaggatactaatgggcataaagaaaaactgtagagatattgagaaggttaaatcagtaggaccaggtgacagatttaataatggtagttgacggacagtgaggaagagtgaggaaaaaaaatccagacttttggcttgcttaactggatagtgtcattcactgggatggaggaacctggatgtgtatcgggtttgaaggacaaggtcgaacattcagtttggtccttgttgagtctgagttgcctctgatacatttaagtggagatgtcaattaggcaggggggtatgtatataagactagcattcaaatgagagtttcagggctggagatgtaaatattagaagctttgcagaaacattagttaggttaaatcaggaacatagataagattacctagggacagaagacaaagtgaagaaatgaaaggagatatcattccttctttggaaccttgtgtagtgaatcagaatcaaaccctgtttaattttaaattacaaagccaatctaaccactcactgtgtagatgaagagaactgaagtcctgcgagttttatccatttgctagattgtaaaagtcaagctggggcaagaactcaggtcttctgagctgcagtttaattctccacctttatcgatatttcttaaaatgtggtcctggaaccagcagcatcagcatcacttatacacttaaaaatgcaaatatttaggccccatcccagatctactgaatcagaagctctatggctagggctcagatgcatattcaggtcagagggctcctgctctattttgtgtaatccccttcctgagtgttagcaaagtgatgggttcacacttacgggtagagaggtagcaggaggaaagtgaagctgttcttgactctgtgccagaagagattacagaaactgaccctctcgaactcaacagaagctgtagaccacattggtacatgtgttttataaactacaatcatgcatgccgtttctgtgctttgcaaaagagacagatagtggtgccaggggaaaggacattagcagtccaagttgattaggtaaaatggtctgacacagtgaggcaaaagttgatttggtaaaaacttgacatagacggcactttcaaccatcggtatccacttaatagatgtaaacagctattttcacgacacaaacacccacacttacatctttagaacagtctcagcaattctgtatgcttgccagataaatctctgctgcaaattatcctccagccatgagatttaaaaccaagagtttctagtgttttgttcctttgaaatatgtaaccttaaccagatgtttataccctgggtcacaaaaatctaattgaatagttcacttgatgtgttcgcacaattaagaaactcttcttccttaataggggaagaggggcaaattcatatgtttaattttcaaaaacacagagcgttctctgctctacaacagtctatcagctagaaatgtctattaactgtctcttctctacttcatgagcacaaagataagttgtggttttagggaccctttgggggatattaagagatcttgaggtaaatgctaaaccaaacagtttagtttgtattcaggacagtagacacgttttatatactatcatcctactttaacattaattatattaaaaaattcttcttttaactgggctatctaattaataaggccagcaacattccttgaccaatatgcttgtataagcttagtttatttttgtgtataggatttatatattcaattgtactgatgaaaaaagtatcaggagcttctgatcttcctttgtgacagtgagaaatacagaactctcagcacttaacaactctgtccaaacccttgcactaagacttgactaaactctagtatggtttctagccccagaaggccatgtccctaggatgaccctagccttcccttaagtgcctgcttgagaaagctcagtgctgccaggaaaatttaatgtttgttctagccaacacacatctgttgataggactcttacctccgtttcttagaacatttactcaaaagggcttacaattgtgaacatgtagctcttggaaatcagaagtgtctctcactcaaggacctgaaagccattcttttcaaatgacatcatcaagaaggataagtcctctgtctcctgttctctgtgggaagatagaatcctaacttcaataacttccagctaacacagctggcctaatcacatttacactgtccagccctttgtacttttttacttctctaactcgaatgaacccccactccttctccctccttcttgccttaaaacaaccaagtcgcctctgcacaaattagaatggatctcagctctcccctaatttcacgaggtattgaataaaatctgtttttacctctttaatatccagctgtgtttatctctgacaatatatatgctctcaaaagcattccgataaataaattttcctcaatgatcaagcataataaaatacatcagctttgttaaatcacctaaatactcaaacaactctaccattagtatgtgaggtagctttgaaagtatttctaatttttctttctctttaatatgccacaggaagggacgaggcatttatttgaaccttcaattatatgctatcatagtaagaagatgattggaccataaatgcaaagacatgtatttgcaattgcattgctcaagaatgccagttatgtccattatccatcccttcaatgaaacaaagaccatccattttcttttagaggtaatcactactgtccaatgcaagacacagaaaataggcaatttggaagtatagtaactagttagcaatattcttttaactttctatataggtatactttttacatgcattaatttcactgtaaaacaagtaaaattatatgattaaaaagaaaaccagcttctaagattttgagaatgcattgcatacaatggtcaatgttaatctagtcaacaaagaactgttcaataaaacatgtttgtttacaaaatcagtggaagacttcctcagaaatattttatgtaacaaatgcctagggtgggctgaagagaaaaatccagtaaaatggcatttcaaaatttatattttcctttacatgcctctaatttaaaataaatatctgatatttttcatagatttagtttgtagtacaaaatcatgaattaaatcctaatgatttgaactataatttaaaaaattatattccaaatagcaagccaatcgattgacatttacaatcttctgataaatgcaaagtaccaattccctaaacatagcgttttatggtgactttttcaaaataactacatcattcaaaactattgagttgcctgtaaaacctaaattgcttgaacattagttctggagaaattttcatgatgcctttaaactctcagtgtcaaattcaacatttaggctttaaagcctatgggtggtatttatcaccattcaacactcgcatttatcacataaggaaaatatgtttaagaaagcaaaactgaaataggaactcagggtttaaaacacttctacttataacctgtgtcgttcctctttgtgtaaagtctatgacctgctgtttggaaagacaccagatatggagaagattttgaaatgcccaaatctttataacaaagcatcgaacagaggatctgaaagaaagagcacaacagaaactcaatgaaatatctagcttatcagtctgacaattaatcatatctaaggccccacctctaatctcagtaccttagccaaaaattaaataccaaggacagttacagtttgctctagatacctagaggaaagagaacctccttttcctcatcttttccatactaaaaatgtatactgtatctttcagattaatatatcagctaaaattttgttacttcaataaaccatttttgcagcataactcttgactgcaaataaaagtatatatactgacaatcctcaaattttgtttttcagctttgcttcatcagattactagaatgaggcagtgtcatgcattgattcaataaaatttccaaagtcacctaataaaagtacattttatgatgagaaaacaacaccaaaaaatagttaccaatgcttgatacctcttgagatgtggacctcttagaggccaatttgacagtcagaagagtatgagtaatgtttttcaaaagtttcatgagtacaaaattaaaatcctacaatgtaataccagcttctcttcctacttaaaggagatcataacgattgaatcaggattacattcaaataagccaatgacaaatgtgaaatgaaagagttattctcaccaataatcattgcatcctaaaagccaaagaaaaactgctataagggacttctcaatcagtccctatagataggaattggtagttcctacagaaaaaatatatatacatctatatatatatagatatggagagagagagagagagggagggagagagagagagagagagagagagagaaaattggtaattctacagaaaacattatgtccaagattttttccttggcttctgatttcgaggccaacgagtttgggtcattttaaagggcagacatcagcaagtgcctgcagtgacaaatagttattagctgcaacacaatactttttatttccaaaggttggccagattgaccaaaggagaatcttttcttctatccttcctttctcatttttcaaagactttttttttttttttttggtcccagaaacctttaagtctttttaagctggcttttttcccccttacgctttagctttgctcttttctttgaggtctcagtgacatataggtcagggacgtctttaccaatgtaatattagtggagagttataacaagggggtgaggacactgaaggcttacacaggtgcctgaataatttgccttatcactccacactggtgcaagtggtgcagaaataagagcagattatggcttttgctacatatacttttggatttacagatcaagtgtaggttttcagaaagtttgagtgttacacacaattattaccaccatacccactactatcaatgccagaattatcaatggataaaatttgtttttattattttctattgacactgagttttatatatatatatatgtgaaatcttgtttctgtataaattcccataatgcacactccatccaagaacaaacataatttaactatagatcatatcacataactcctctggttaaaaaccccaatggcttaacatttaatttataaacaaaaaaagcccaactctttacaacgtcccggaagactgcacatcatctgatgcatgccagatctctcccttcatctcctggcacttacctctccatcaccaaaatccactcacacttttcctcaagtaggctaagttgactatgcaattgcacgctttttgtttcctttgtctggaacatattctttaggtatctgcctctgtcactattcaggttccttttcaaatgtcatttcctcaaacaaaagtccttctctggcttctctgtctggtgttatgtctcaactcacattccagttacactctaccacactgctcacttttctgtataagacatattgatatttaaaaattgttattactttttaatgccaggtgcgctggctcatgcccgtaatcccagcactttgggaggccgtggagggcagatcacctgaggtcaggagctcgagaacagcctggccaatatggtgaaaccccatctctactaaaaatacaaaaattagccaggcatggtggcgcatgcctgtaatcccagctactcggtaggctgaggcaggagaatcatttgaacccgggaggcagaggttgcagtgagcagagactgtgccactgcactccagcctgggtgacagagtgagactctgtctcaacaaaataaaataaaataaaatgaaacaaaaattgttattttttaacatctatttcattagcatataagatccttgagagtaagaactttttgcttctgattcattcctgtaattcagcacctagaaaaacatttggcatatagaagataatcaatggataggtgattgaacaaacagctctttgaaacaggtacgagttttcttgttatcttaaggataaaaaattcctgaagtttagaaggggtaagtgacaggttctagatcacatagcatccagcagagccaaccattgaaagtaagactacatgcctgtctagccaaataaaatgaatttggacacattgtgatggagctagggattgtcaagatcatgtatagacatcctaacattcttgtcgcattggaaaacgcagatattatcatgtattatgagaataatttcttagtcagggatggtcattagtgatgaagaaaaaaccctttaaaactaagataacttcaagaaaatgggtcatttaatcctctgttctactgctgctgttttacacgacattctcctctaggtattacgtattcagtggaaaatatttagtgcttgtaataaagtaagccaatggccatattgtgaagtatagtgctctacactggatgtcagaagacctcagtgccagaccctgcttcttcacacagtagttggagggtaaagtcatctgagactgtcagttccgtaattttaaaatggaaaaagcatatctgtcatatcaacctcaagggactgagagatcaatggagatgatggctataaaagcacattttaaatgccagagggatataaaaatggaaggtcccatcattgttatttagggatgaaggctttttaatctatatgtgttcagtaacatatattgcatgagaaaataggtgaatgatgaatattataaaataatacaaaaatacaatattaatagatataatgcttacctataaggtcaatttgttttgacctaaatttagattaggcaacatgttgcataaatgggtgggtcagtaacggaaatgtcactctaaaaaatgtgcaaggaagcaactgtccatcatggtcaaattacttcagatgccttgaattcatgaataaaacactccatcaaattttatgcatctcaagcacttctcacacatttaaatccacaacatcctagtgaggtagggaaggaggaatatttcatttttcttatttggtgaaatgaggataatgaggcacaaggaggttaatgatagatttgaagtgaatgcaatcagtcagcagcaaaaccatggttggaatttaggttccctgaattccacttagggttcttttcgagatactacgttaactacatttcattgttggaggaatttaattcagtcatgtagatacagatgctcacaacatcttttttcatcctactaaggaatcttgctgctaattcaaccactgagacaaataatacgtggacctgcgctggagatttggcttcggtgttcattcaagtcatttcctgagctaacttctgttccttttcctatgaatactatattttttcacattataccactgaattattcagattcattgaatacccttagagttattaacatgttatatctaaaaaaattactgctttctccttttggttatatagctagaaagtcaggatatagtaaaaggagacccaaaatgtaggttttgaaaatagaacgtcagtttttgaggacaccacacacttttgtttttcttcccatctcattgatcactccttttcttttcttttttttttttttttttttttttttttttttagatgaagtctcgctccatcgcccaggttggagcgcagtggcacaatcttttggctcactgcaacctctgtctcctaggtacaagcaattcttctgcctcagcctccagagcagctgggactacaggtgtgtgccaccacacccagctaattttgtatttttagtagagatggggtttcaccatgttggccaggctggtctccaactcctgacctcgtgatctgcccgcctcggcctcccaaagtactaggattacaggtgtgagccaccatgcctggctgatcattccttttcattatcctgtgctgttttctcctttgtcaatccacctcttaatgttagagtccttagtcacgttgtcatttctatctatattcttccttagtgatacaatctgatatcacagctttaaatgttatcttatacaaacacctccgaaatttaaacgtccaacctggaccttttttgctgaactctaaaggtatttattcaattgcctattcaatatatctggtgatatgtctaacagatatccaaatttaatgcctccctaatcgccccattctatctatagtctttattatttcagtttagggcaactttatcccttccagttaatcagagcaaaaacgttggagccattcatgactccatttttctcccatgccccttatccaattcatccagaaatccttgttggccccacttccaaacacgttcagaatatgactatttcttatcaccctggtctcagtcagcatcatcttctcacacttagaaagagaaaaacgtccttacaatggcttcaaaggtccaccctcacctcactaacattctctcctaaacctctctcacttacttcactctagccacactgcagataaccagccccaaacagcagataaaccgatggcttaggaattctgcattgactgtttactgaacccaaaatgagtttactgctgatatctacatgattcaaccccatgcctcattctttgagatctttgctcaaatgtcaccttctcaatgaagaataccatgataccctatttaaaattggaatgtactccagcatgagccatctcttattttacccttcttcttttttttcacagcacttatcacttttgaacatactatacaatatacttatcgtatctgtctttcactatttgagacccccaagaatccagagggcatacatcttttctgctttgttcactgacacattcaaaacatctacagtagtggctgacatatggtggtggctcaataagtatttttcaaattaacctgatgctaagtccagaactttcaactgcccagtcacagagctagcttcagggcatttaaagaactgaacaaacagataatggaagtgggttcatgtagatagagaagaaattaaaagaattctcattctcatgtagaatgagaagacaatggggaatagggatacacatgtcctttttttttctactgcaggcaaggcacagaagcggggatgtaaacaaaggagacatccgtgaagatgctaatataggttttcacaattctaaaaaaaagataaaataaactatgtgtttaacggtgacatggttttaaagagttgctgaatgatcagtctccctttccttttctttcttccagcgctatattatttcaaagggtcactggttacttcatgggaaccagacgttgttattgccacttgtataagtcagatgaataaagagaaattcttgataaatgaggtatactttgaaggcaaaatgttcagaaaatagggtatatgtgagatgaaaaagtatcctcagagatgaaaggatttgccaaaaactgatataaattccatgggtgcaaacagagttctaagcctactgcaataagatttgactttattggattatctatgaaatatattattgtagtaggggtctatttttatggccacatctggtctagacttcacaaaagaattacaatgggaatatactctaccaagatgccaaaaaacacatatctcttcattcctgaaagatattgcctagactgtctaaatctgaaaattaacaaggattctgtaattacttcattttcatctacatttccccaaactaaaaggtatcctagattatttgagctatagatgtgtttttatgtacagctttttaaattaatagtccactagctctatcggttacagcagtaataaaaaaacttttatggaaagttctctgagactaaaagtgatttacatgcaaatatatggaaatgattcccttcttaaaacagtaacaaaaggtgtgtttgaaaattcatgctttggaagaataaatgattttcacataatcattctagtaagttgtttatttttattgacatgcatcttttattagctatttaatggtggttcacaggggtgagtgcactggatcacgcctgtaatctcggcattttgggaggccaaggtgggcagattgcttgagctcaggagtttgagaccagatggtgaaacaccatctctaaaaaaaaatacaaaaaattagctgggcatggtggcgtgcgccagtagcctcagctacccgggaggctgaggtgggaggatcacctgagcctggatggttgaggcagtgagccatgaatgcaccactgcactcaagcctgggcagcagagcaagactttgtctcaaaaaaatgtgatccacaaaaaacaaatttaagttgttgaatattttaggctagctcaaatacttaactttaattttctattaaaatatataccttatttaatgctaatggtatctaatttgcagctatcgttactatacacataaactgcacaaatcaaaataaatagaaaacaaatattaataaaatttagtcattaacccttctggatgacatgttataattaggatattaattggaattggcattataaaaccatttagaattcgttgtattaaaaaaatctgattccataaatcatggggaattttttattttaatgacccatgtattagacttacagaaaattgtggaccttaagtaatgttttattaaaatgttctgctatttaatttgtcatatttaaaaatagctaaaatcatagttttaattttagtaatatttttcattgtgttctaagtaagccaacccttaaacatcaaatgctttcttttgggatatgtcttttcaacttctggttccctcaggtttgatccattgacattctaggcactgttggtgtgtcccacctagtatataccagccaggccttctttatcatgccccctgggcaaagaaaaactgattccatttatactagaataatatcattgttgtcactacttattacctaggcaattggtcacactctactcccttcttatggtactttcattaaggcatatgttcctttatgaaaaacattccattcctggcagccgaagtcaatctacaaatagccaggtagcaaatcaatgcagattacaagagaaagtgaacaagcaacagagattaaacaaaacaaaacaaaacaaaacaaaacaaaacaaaacaaaacaaatgttagagattgtgacttgaacgtggcacagcctagttccttgttctgccttgtccttcaaaaaacagggtcattattttgtgagattcaaactggttttgaaaattaatcatctcatggtatacaaattctaatccaccgatggatgaagtagaactttccatgtttcttccactgccacttagaaaataatattgggaattgaacaatgagaacacatggacacaggaaggggaatatcacactctggggactgctgtggggtggggggaagggggagggatagcattgggagatttaccttaagctagatgacgagttagtgggtgcagcgcaccagcatggcacatgtatacatatgtaactaacctgcacattgtgcacatgtgccctaaaacttaaagtataataataaatttaaaaaaaagaaaataatattttattatgtacagcgtgcattatcagcacagataacataaaactttttttaaaaatgtgggtttattctagatttttaaatctatgaggcttatttagaatgctgaattaaactatacaagttaatcttgaagaaccagatattggaattgctgctctcattaattcctcccacctgatttgtgtatgccatcgccagcaaaccacatagttggtgcctcctttacaaaaaaaagttgtgctaggagacaagcataaattacaaggtcagaggaataccttcaagaatcttaaacccatttgaacagtatagaaacctagggatggaaaaaactctaatagaagaaaactacaagaaccaaaggggtaagccagtacaacctctgcaaaggtaatcttactccatccactaaacatagcattatatgtttagtcactcacacacaaagatagtgaatgactgataaggagaacctggccaggcattaacaggggatggcctttcattgagtaaaagatattccttccagagtagagctggtaaagccgaagagaactgtattcaaatgaaagtatagttttttttttcaactttaattttggactagggagtacctatgcaggattgttacatgggtatgttgcatgatgaaaagcaaagtttttgatttcaggtttttggagaaacaagagtgcctcggagctgtccatggtgctgcatgagaccaggccttcattctgcagaattcctgcctcttgaaaattctctaggccctgacttacaaccctgtttgctgtatggttaacctgccaaccctgctatgtcccctataagtgattatttaacataatctataatttcagtactaaatatttcatgactaattataacagctctctatgtttccctgggtgatatcaccacacattccaatttggcagatctcggtgggcccaggaatttgtatgcaaatatacatcctcatataattcttatgagggactaaagtcctgcttagactctagtcttcccaaggtcgcccaccttaatcccgagccaactcgtccccagttggagacaagagcagaaattttgattccacaaagctgtttgattaggcctcacatacatcatctggaatcacacaactgaagcttcatttatgacactgctacagtgtaccaattcctttccctatatattttttctttttttcaaatcctatttatcctacttcaaatctctatagcaccatatttagagtcattcagatcttgatttgaatcaataactacattgaaacaactcacttaaccctatattcaagccttcatgaattcacctgtcaaatgaaaaaaataacacctacagctttgcagaattattttcagggtaatatgagacatggtttctaactcagctagcacattatctgatacacagttgctctacttgcatgtgagttctgttccctttccttctctaaatcttttttaaattcttgcatcatttattactttatttcatctaatgaactcttgtttctatcatttgtctcatcaactagctttccagatccttgactaataaagatagatattgcatactaagtgtgtggtggatggttgccaagacctgcacagagcactttacatatcttggccatgaggactcaaatattgagaggcagagttggaattctgaatctcaagctacagctcctgtcatgccatactacagtctattaccattccatttcctccaactgtgcctaagctaagtgcctggtatgtggattaactgctatcagagtcttttttactgtaatggagtagatgcattgtctatatcctatttgctgcatccacataattatcagtccgttcaaaaagcatagccaattgctctatcacttagtaaacgactaacttagaccactggacggaactttttttggaaaccaaaagaaaacagctcctaaattgctgtacctgctctcctcagattattatgtgctggaaaatcggagacgattattcattctcatacacttcacattttccagaatggaaaattaagtagcaaaggcagatgtcccctgttggggcaacgattgagctggatatagaagactcatatcctgtttgctaaactgggctgttcttactattctcaacatgttcacatcatcataataaaacaagcgccccttaagacaccataaatattacaatctcagtcaatatatttatagagtcaggaagagttggatattctcatattcatcaactgtaattcatcaggattattatagttagggagggaaacccaaagttatgacactgaaagacatgatcagtgagttttaataactcaaaacatacttgctatataacacaggaatggcttttgacacatttgtcattactttataaaaataatcctttaagttactttgtggtgatgaaacacttctttatcttgatagtggtagtaactatataaatctatagacatggttaatgtcatagaataacagataatgactcacagtaaaagagcatgtgcaaaaacaggtgaaatccaagtaaggtctacagtctagttgattgcactgtgccaatgtcagtttattgggtttggtaatatactgtatttggttaatatgtaactggggaaagttgggttatgtatacacaggaaatctctgtactgtttttgcaactccttgtgagtctatgaatatttcacaataaaaaaatcttaaaacattcttaaaactttatagaaattttgcctgccttcaaagagactgtaagggaaaatagagaaagaagagagaaaattaaaatgtctggctaattcctaataggaagttttctttatttttatacaagaaacggaaaacatagttgctatatcaacaggattttagtctattttcttcacaaagctgaagaaggtgtgaatgacttttctctgtgcaagtgaataatatactaaaattacttgttccacccttgtttttgtcttgtttacatcctacttccataaacctgccaatatttagtcactaatcttaagctatgacagaatttaaaacagattcaatgatatgatttgaattcaccttatgtaagatattgtaaagcaatatgatgccacaacacacatctagaaaactgtgtcttctctcaaatggaactgagttgttcctaagatgtttaactaaagtgattaaatgggctgaattataacatattgatttttaaatggtctagccacatttgcattgttaattttttacaagattgcaccatagatataaatcactgacaaaatattttaaaagtagcatacaaaaatcgtcaacactgggataaaatttaactttcaaaattaaaataatcttagaaaattcagttatccaaaggcattaagcaatgacttttcaaagttgataaggatatagtttctattgtgaaagtctattagacaagtacttttcaaaattatataggttattgtattagtccgttttcatgctgtgataaagacatacttgagactgggaagaaaaagtagtttaattgaacttatagttccacatgactggggaggcctcagaatcatggtgggaggtgaaaggcacttcttacatggaagcagaagagaaaatgtggagacgcaagagcagaaacccctgataaaaccaacagatctcgtgagacttattcagtaccatgagaacagtatgggggaaaccgcccccatgattcaaatgacctcccactggatccctcccacaacaagtaggaattatgggagtagaattcaagatgagatttgggtggggacacagccaaaccatatcagttattgaaggaaaaatggaagcaaggcattttcaccaccaaattttgctcaaacaaggcagatataacctgcagctgcagaacaattaggtttatgtttttgagaagtttatagttaaaaacatttgatacattgctctgcatggtacataggagttttggtcacctcattgttaagcccattactccctatgcagtaacatttaatatttttaaatgaataaaaataaggtcaggtgcagtggatcacacctataatcccaacactttgggaggctgagtcgggtggatgacttgaggctaggagttcgagaccagcctggccaacatggtgaaaccccgtctctactaaaaatacaaaaaaaaaaaacaaatagcctggcgtggttgtgggcgcctctaatcccagctgcttgggaggccgaggcacaagaatcacttgaacccgggaggtggaggttgcagtgagccgagatcataccactgcacttcagcctgggtgacagagcgagactccgtctcaaaacaaaaacaaaaacaaaaacaaaaacaaaaacaaaaacaaaacacgttaattctcttctaaatggcctcagtgtgctctctttactcaatggcaattagtatgcacaaccccaaacctgcaatttttattctcctttgctctctgtgcctcctaaaacatcttattcctatttttaaagaactatttttaaaattttatttataagaaaaaatccagaattcaatataatatagagtgcaacacacacacacacacacacacacacacacacacacacacacacacgatcttgcatggtttctcaaataatagacactcatgtagaaagccttaattttaatttaaaaattaacactctggaagttacacaagaaatgatgggccttggggccttttgtgaaaatggcaagataacaaggcaggacaagagagatggagataacagacacaatgaatatgtatcagatttcgttgatacgttcattcttttttctacaaatagacattgagggctcactatatcccttgcgctgctacacacgggggatatgctgatgcaaacactggcaacataccttccttcatggtgcttacatcataattgcagactcagacaaaaacaaggcaggaaacagaaacaaggagctgagctatagaataatgttagaggatggtgcaaggggggtagacagccctctccaggactctccttggagaggattacctacccaaagccctgaggctatatagaagacacgattgcagaggaggatgtctactccagagagacactctgcaaattgtattaaaacttcccacatcaagggggatttgctgactctccttttgtttgaatattgtcagaagactacataggaaatggtccatccttcctcaccaacctttacggcccttccatcctctgagaaaaagagaggttttgacaaagggctttaaagtttcattgttttacttgcacttgctgagtccccttggggattttatctacactatccatctcacagaaaagtcgagagcattaagcaaagtaacggttaagaatatgcactgaatatcatcccttcttcattaacacaggacattataattttaaaacatctgactaagtccatgataatatggaaccattcctatccttctctgcacaaaggaggagaaatatctgtacagtctttgaacttagttagatatgggtctgaatttcagatattttactccatgctacgaccttgcaaagcttacctaaattctgaaccccaataaactcatggatacattaaagtaaaagctctgtgcatgcttgttagaatagcacactatacatttaccaaatggcaaagtgcctggcatggagaatgatagttatagtcataaacactagcatcgtcataattgaagaaattactgtccatgggatctagtcaatcattgagtattcactcagcattcaagactgatattttatctgaattccacaaatcacccttcactcaacacggttttcttatcatcatccttcaggtagagcccctccatcctatctctggatttgcatacactgtttggaatatctttaccattttcttttcatcagatatcgacaacttttataggtctactagatcatgaaatcaagggttatgttcatgtattacttggtttttgttctgtcctcagcacccaccacaaggccctgtatttttaaaggagctcaatataaatatattgaatggaattaaatgccattgctaaagttttcctcctcatgttaatctttacccgtgtaaaagaaactatcctttacctagttacacaacttcataataatttattactctgaattttcacaagaacttttgacttaaccactcatttaaaaaaaatctgcagataatcctgtaatatatttctccagcacagttcaccctcatgaagcaggcagtattgagcaagaggctaggctcactggttagacaagtaattgacccctcacattaaatccatgcaatctaaataatgaacactaattgtatgctgtaggctgccagggtctctcgctgtagttaaaagtaaaaatacattttttttttttttctttttgagatggagtctccctctgtcgcccaggctggagtgcagtggcctgacctctgctcactgcaagctccgcctcccgggttcacgccattctcctgccttaacctcccgagtagctgggaccacaggcgcccgccaccacgcatggctaatttttttttttttgtattttttagtagagacgaggtttcaccgtgttagccaggatggtctcggtctcctgacctcgtgatccgcccgcctcggcctcccaaagtgctgggattacaggcgtgagccaccgtgcccggccacaaatacatctttatatgtttactgtctactagatactgaagactgtcattcactaactggtcactgtgtataactaaatccttgtatttcaatgtgattatgaggcccaagaaaatatgtttcgttctgggtacctaataaactcttaagacttgcccatctcccacaaactgtaggcaaataattcttctaatctgcttttatttctttattaagataaagcatttgaggtcacaatgttctatggaaatctagaaattcctaaggcaaaatctaggtgacacaattatagaagatgccgcaactgatttccctcaagcacatttctgttgccatagaatcatctcaaatctgccaactttgaagctgaactcctctccattccactcatatggattctcacatgggttttagtagaaaaatttaaactattagaacatggactgatttttctctggattattaaatgagaagggtctggattccccattacttttctaattaaaatagtatcaaaagcaaagacaaaccaatcctcagcatgtatattacagagaacctgttacagagacattatcaaggccatatttttggtaaaattacttaaaatctgattgaataaaagttgcctctaattcgtttatattaatagcactttaaagtaatacatacggatacaactttaaaaagttgggatttatcttattattatgtcctgttaaaatacgcttataaggaagaccaaaaagagtacactgatgaggatctttgagaaaattaaaaatgaaaacaataataaataaaattgtcatggctaaaaagcatatttagtcttcatgatgttaaactattatgcaattaggcaaggacattcttgtctttcaaaaataaaattcacgggctgggcgcggtggctcacgtctggaattccagtgctttgggaagctgaggagggtggatcacctgaggtcaggagttcgagaccagcctggccaacatggtgaacccctgtctctactaaaaatacaaaaaattagccaggcgtggtggtgcacatctgtaatcccagctactagggaggctgaggcaggagaatcgcttgaacctgggtggtagaggttgtggtgagccgagatcgcaccattgcaccccagcctgggcaacaagagtgaaacaccgtctcaatgaatcagtcaatcaatcaatcaaattcacactttgaaatctattttttgaaagtatataatcataaatgaaaaccaaacaaaaccctcactggctaaaacaacatgatggaaacataaaagtgacaaagtttaagacccatgacacatgtatgtaagttatttcaaaagagatcactgttagaaatttgctggaagtgtttttgttactgtgaataataacacaatttttgtaatttgcaatacatcatagataaggcatatacacacataaacattgtgaatagtggtaacacattcagttattggggctttcactataatatgcctgggtgtgcctccaacggatgctaaatttagtgcatttgaagtctcttggaaaaaaacagtcccaaggagtttgaaagggaaggtgttttaagttcagcacagcatgctccttgcagcagcaaatgtgtctgaaagcttcttgctctgttgcactgtgagagaactatattaaaatgtgttaatagtagaaagaataagttcacctcaaatactatatttccttgatttttgagacaacagtgatttcctgtatgttaaaaattatagagagcaaaatacagccatttcacgctaatttattatctccatgtgaatgtgcatttacattttagataatatatagattacttgtgaattataagccttaaaatgaattcaaacatgtcagtaggaagaagctaccatattacagattcttgaaaatcacaaattgaaattacctaatgatatgattataatttaatactagtatcaaaggtatttttcctattattttattttactaattactgtaaactatcggtaggattataggagcaagacgtcaagatatttattaaccatactaattttttattggaagccatattaaatttaacctgtaaaatgagaaaaataaaaatagtaacctcatagattgtggtaagagtcaaatgaaataacttacatgaaattgctttgtaagttttatagggctgccatgttttgattgtatgatactatgtatccctactgtttaggacatctcttcctgtttaggacatctctttcatatgtgcagagacctgtgtttactgctttttttattcacaatgtggtcttttgttaccataagttaatgaaaacatttttcagtcttgtaatttataaaatgttagtgttattaacaactatacatagatgatagagatagatagatgatagataaaccgatccatcgatagatagataagtaaaggagagtgacagagacagggagagggagagggaaagggaaagggatggtgggagagagagaagtaactgagtggatggatgggtagatgaataagtggatggatggatggaaggagacaggtagacagccagatgggtatatatggatagatagcgtatgatctttgtcctattatttaacttcccttgcttcaattttagaagatataaaataggataacaagagtacctatcttataggattgctatgagcattaaggtagttaagcctgacacatactaagagctcagcaagtgttaagtatttttcactgtagttggtatttggctcttaaagaatctgtcacatatttctatacagtttttaaattcatagattagatgtagcctaataatgagagcaatcatccattaagcaccctctatgtgtctaaacgcagatgttttacataccgtaagtcatataacatgagaataaacctttaagacacttactgctctccccattttacagatgagacaaccaagacttaaagtattgcccaaggtcttagagttggtaacttgcaaaggcaagaacaatgaccacaaaaccagaacaactgacagcagagtatctgttccagctccaataattactggctacatcagttctgtgggtcccttcatgatggtacctatacctctagagtttaaaaataaattatcgtttaatttttgcataaactctatgatgtaagtcaataataattcctcttctttcttaactcactagcatactgtaataaacatccatatacccaccatgcagatcccagcaattataaactcaagggcccatatggtttcatctacatcccaccaagcgcaacccacccctaaacctagctttgtattattttgcaagtgacctaagtgatccttcttttgctgcttggaataccaagttaatgagttatttcatgtgagatagctaataaatcacaaagctgttgcttgagaataggtgtcccaatattgctgtgtttcattttcattctatgataggtagcgtttttatgatatatgtcattggcagcaaaaaattatatactttactgattgacatatgacttctggtgaacgcttaaaatacttgattttgtttttatatacatatgtatgtatgtataagcaaagatcatcccatattcctattaaatagataagttgatatttgacaaatacactgactttagaaaaaatatgaaatcaaatataaaataatacagctgtgtacggtacattgtgatgttaacataaaagaagtagtgaacaggaatttgtgtatgtgtgtatttttgtatgtcatatatgtttgttagcatagaaaaagcagccagaaagttacacaccaaaatgttaattctggtttccaactggcacttagattttctagtatgcttaggttttcatattagcatactgataagaaaggtatccttgagtcttactgtttgggtctgaattcccattttgccattttctaactgtatacactcaaaaaaatttcttcttttttttttttttttttgagatggagtctcgctctgtcacccaggctggagtgcagtggcgcgatctcggctcactgcaacctccacctcccgggttcacgccattctcctgcctcagcctcccgagtagctgggactacaggcacccactaccacgccaggctaattttttatatttttagtagagacggggtttcaccgtgttcgccaggatggtctcgatctcctgacctcgtgatcagcccgcctcggcctcccaaagtgctgggattacaggcgtgagccaccgcacccggccaaaaaatttcttatttatacctctacttcctcatttctcatatagaagtaatagtgccatctaccttactatttagaagactcaattaatccatgtaagttacttagacctgtcattttagatattattatgactacatcagaagatattatgttagtaataagaaaaacattgttaaagaatttgaaaataaggagaataagatttgttaaggtattttgaaaattaattttaaattgttgttttgttagttagtagggtcttaaaatccttcatatcacctccaataagcttctgagaaataaataaatataagactctacatatcccatttcagggatgacttacagagggacttaataaaaatgcagaataaactattgtttttgttttgttttgttttaccagaatatctcccctttgattaaaaaaaaaaagattattgtaaaagatgatgctctaagtctgctttacactggcaggccatagacattcataaataaattcctacaaaatgaaataggaattaatccttgtacaaatactatagctaactaagtacagtttctagaagtatattttgaaatgaaatttatgtatatcactggtgataacttgtactcatttaaatgcttctgaagcattctcttcagaagttaataacttttctaaaataagtcaaatcatgcaatttgacgaatataaattgcagcaattttaccattgctaaaatggtttccgagcattacaagaagagttcacttggctactgtctttacactgaatactttgatgaggttacaataataaagtgacaaagtgatatgcattttcttttataccattttctttaaaaaaaggagtccttaattttttctaagaactccaaaatatgaaagtagaaaaaggcagctatgactgaatacatttcaagaaaaatgtcattcatctttcttaaattgatctgctgagtccagcagaaatgtctccaaggttttctcgtgacgagccaaggctaaagggatacacggagccagcagttagaggcatctagtggggcaccggttaattaactttttcttctatgcttcaagtttcaatgcctataccaataccttttgttctttgcataggatattatgcaccgaaaatgaaacaatactcataaaaacagctaatatttaatgagcatgagtaattgccaattgtgattctcaacacttggcatatatcatttcattcgtttttaagtctactctatgagataagtagcattattgtgctgattttacagatgcaaaactgtggcccagagaggtcaatagaatttcaggtgtacagatataaaatattcatgaaccataatatcctaactatggtataaatataatatgccataaaataggcacgtggtaagtgtttgctgactaaagattgaagaatgtgttgtaatggagtctattaattaaagacagggaatttggacccagaaagatttggcttggtcttatattggccatctactaagacagtttggaaactttatcaataaagtttctattttagagaatatcttagtttgggttccctaaatggaggttctgagatgaagcttcatgcaaaaatgatctaatgggatgtgttttcaagaaacactggtaagggaaaatgaagtgagattgggaagggaaacagaccaaacacatatatggcataaaagcccagggtggcagtgccattcacacttctgaatttctcagttgggaacaagaaagctcacgtatttatgtgtctgcaaccagcagtcattgattaagggcttcccacacacagggacataaattccaggatagatccatctctctctttacacagaccaaataggctctggcagcctcaaggccaccctccaacagagcgattagggagctagttgttgggagtaaaagcacagcagggaaaatgttaaacggatgtgaaaggatatgagtggatcaatgacagcatctctacagagaacttgtttcttcattcaggaataaaaataacgtggaaagttatgaggataaaacagggtaatgtgttcaaagcccttagcctgggcactggcacacagcaacactcactggcactctcttgttgtgaggatggaatgtaatactgtgaagaactgacagcacctggcacatgaaaacatcagatagctggcattgccaatcatttttcctattgcagttgccggtgccgctggtggtggcatacctaaattagaataacactgctatatttaactccaaagtctgtaaaatgcttgaatacctgccaccgtctgtggaggtgagggtgctcgttcaggacctgaacaccatagaagaagcaattttctcaccatctttattgctaccatggtattaggtaagaacctcaggatgcaagaacaaaaggcagcaccttttttgctatcacatatgagatgctgaatttattgataacagtattaaggagaatggcagctgaaaggaaatttctgatatttctttcatgatcctcccagattttgacattcctttcaaaattattagtgagagcaatcagtaagtgtcttctgctaccaaaaatgtgagcccttgcttgaaacatctttaggtaagtaaagtcagcccctaggaaagcacttaagcaaaaggctagggaaagagagctatatcaggtccaaactaccgtgctgctactcctcactcttggaagaaaatttaggcctttgcaatgaaaattaatggagaagcacatgacacctaaatgttaatattaagggaggggatagggagaatatgatatatttctctatgtgactccatcctgtttcatttgttctagtgagtacatattactattatactttgtgtgtaagataaaagaaagtttaaaaaaagaaaaattgaagttattttagaacagatcaaactgcttatgagaggcttactaccttttaaaatattattttgattaaactaaaaataaattcttaaaaacccagccaaggtaagaaaagaaaatagttttccttctcatgctctcaaactaagagtatacataaattggctaagaaacggataggatgactcccctttttccagggacaagagtgggtttaggagataatccagttctctagttatatacttgtttaaaaaccagatgaggagatcacttcctcacccgtcttttgcctctggaggcaaaaggtatggtcagagttcagtgacaaagtgacaatcatcaagggagtttagtcagctgaggttatgtttctctaggcattcttatacagtcagaccatgaaacaagactactgcttccaggaaatgccacaatacctccttattatttacatttctggaagcaaaggcagcagaatttagccactggagtcctctccactgtcttctctagtacaggtagttcctgaacattactccaaatctacagagacccttattgacagatattacagagatactcaccaacatgccagcgaaacatggtttattgttttttgttttttattggctattgtagttttacttatcctcatctattttattagggtcttgttgagtcttcactatcgtgagcacctcagtattccttgtctccagaaagaaaatgtcttgaggttagaaattgtatgtaattaattaattttctcttccatcttaaaaaagatggctgttaattctatactgacatagtatctaataactgcttctttatatcttggagattttccctggcatattcaaataaatagctgtttaaatagccctgacctgtgagtatatatgcccttgtacacatgaatgtatatgtaaatatgcaaagatacaaaatgataaatacaaagtgaaaggcaaattgttaatatattttaactcattcaacagaagaaagaaggcaggataacttcctctataatttcaggttttcttcaggatgcataccacatatgggctacattacaatgttccctccaggtagcaaatatgttcaattttaaagtagacaactgtcggaaattgattttttaaagatggggggtgggcgttgagtaaatctattatgcttgtatattgcaaatgctgtaactattatttttttaaaagacttgactttcactaacaacaaattttcttctttatatgaatatactgatctcccatcggatcatagtgttggacagttcctaatgtaccttgagataagagatgctcaagggtttcattagatttttagagagagtaaaagccaggctgaaaatgttcctggattctatatttgtctcttcacttatctttttaataacactcacacacagacacatttttatactcaacttcaaataaaagtatgccctgccctttcttttgctgataataaatatgtggatggtatagtctccagagagcgaaagtgcccttaaacatttgttttaagatcataaaaactactgttatttttaaagtagaaaaatccatgaatattgaaattgtaaaatcaagggaaaagaaaatagttttaaatattttgggcaaaatcttcttaagaaaaagaatgtcctatttccaatgactctggcacgtttaaacataggaaagaattagaaaaacaattttagtatattttggaccctttaaaatttaagtaaaacattaagatgtattttatacctttactttgaatatgtgataattctcctttactccatagaatacaaaaactctgcaaatatcattatcttaaaaatgtatttgtatatatgtgttaaattgaatctttctaatgaggaaagttaacgttcactctcaggttgttcttatcagatgagtttgtagttgtattatgaagaaacaacacattccttactgacgtctctattagcttagttatttcagttgagaacaagggaaaacataagaatggtattattggagtgtattgctatacattttattcacatcacagtattttatatttctctttttttaagtttgtacacagacaatatctctggaattatttttattaagggatatttaatgattaaataagcactcttagcgaagacctttaagtgttattttttaccaaatcgtatatagcttccacatacaatgcaaacattccagtactgcagataatatacaggggtacacaggtttgaagtagtggagagactgatggaccataagccataaatctttttaaaaaaatcaccaaaatctcagctataatcttgatcatacaaaataaaaagaggagctctaaagaaataaagcaaaaaaaaaaatttataatccacattactgcaatcatctagtttgtgaaagaagagtatgtattttaaattaaatccttaatgatttgatattttgtttttggaacttcacaaccaagactatcctaaggaattcagagctttcctcacaagaccaaagcaacagtgcatgaaattgaactcaaaaagagccaccattctgtgtgacttcttggctgacacaatttagatatttatagctttacgaatgggccactggagaagaacttgaagctttctctagccaggaaggattaatgaacgtgcgcacctggtaattacaccactccatcttcctgaaagccctcacgctgcctccatggcagaaactataatgaaaatgcattgaaaaatatcaatctgcaattctacaattaaatctaaataataaaacttggtatcttttctccccacacattccagatgtgataaaacacagacagcatttaaatttaaaacatagaagctgaatgtcagcctatttttgaacatgcctcatttccaaagtaaacctcacaagagaaaaaagaggttattaaatacagcaaaaaataacaacattcaaatgtgcaacagagaacccataactgttttccctttattaaaacacagcatacaccataagtgatgcatttacttcaaagcagaggcatttcaatgattaaatcacaaccgaagtgtacaaaggtaaaatttagaagtgcaaaggtatctttatcttccaagtccagttacttgttctggctattttttctaaactcttactgaaaggaaaacctcacttaataacttttaaaaatataaataaaaaataaatcattatcttctttacataaccgtatgttaattgcaaaattacttgaactaaagagatatacgatgacatagtatgcaactcaaataacttgttacaaagaaattttcatcctaaaacttgaacaaatcaaactttttgcagtagtatttttctcagataaaacacagtatagaggttcaacctagtgtttcttaatgtgacacaaagcaatttgatattccaaggaaggcagctatgtatatataaactgagaaggctgctttcagaaaacaatcaaggttctctaagcaaagcagggttttatgataaagtttcatggtactcacactgaattttaatgactgctttagtaaagcagaaagagagaaaatttaatgtaagcactgatactaaaagttaattgccgtcttaacacacaggcgccaagattcccctagcaggagtctcttaaaaaacacctttaaacgcagaagagggcacaagctttgaaaaaaaaaaaaaattgcctgttactgttaaactctattgttccctgatggagtatagaagaaagaaatgctccaggagagggaagtggatatgaattgccccctccagaggagccaaacaaattggctgtaggaagacttcaaaagctggacgaacagagaagctcaaagaccttacagatttgggctacttgcccttgctgtgttttttttttttttttaatttcccctagaatgaatatggtttaacttgagagcaaataatggaaggatgcatttttaaatgctttgattcccagctttttattctgcctctaactagctattacaataccacttaatccggacctcagcattccaagtaccaaagcatctcctcccacccactgctcacacgctcctgcatcagaatagaagacttacagaaaagctgccagacccacagaagagcactttcctctcaacagatgtcttccagcttttaggcacacacacactcagacacacttgcctaccttaataaggtgtgcaaaaacctctttcggtccccacggatgcttttagttcagagcagccagcaatgcctccgcacaaagctttgccattgctagtgt

SEQ ID NO: 2732 - DNA, 1036243 bp, Homo sapiens; identical to SEQ ID NO: 2731

SEQ ID NO: 2733 - DNA, 1036243 bp, Homo sapiens; identical to SEQ ID NO: 2731

SEQ ID NO: 2734 - DNA, 2092330 bp, Homo sapiens; identical to SEQ ID NO: 1863

SEQ ID NO: 2735 - DNA, 2009202 bp, Homo sapiens; identical to SEQ ID NO: 1864

SEQ ID NO: 2736 - DNA, 1036243 bp, Homo sapiens; identical to SEQ ID NO: 2731

SEQ ID NO: 2737 - DNA, 1036243 bp, Homo sapiens; identical to SEQ ID NO: 2731

SEQ ID NO: 2738 - DNA, 915937 bp, Homo sapiens; identical to SEQ ID NO: 2415

SEQ ID NO: 2739 - DNA, 785177 bp, Homo sapiens; identical to SEQ ID NO: 2416
